US008299233B2

(12) United States Patent
Andre et al.

(10) Patent No.: US 8,299,233 B2
(45) Date of Patent: Oct. 30, 2012

(54) MOLECULAR IN VITRO DIAGNOSIS OF BREAST CANCER

(75) Inventors: Fabrice Andre, Sceaux (FR); Stefan Michiels, Paris (FR); Suzette Delaloge, Longjumeau (FR); Marc Spielmann, Cachan (FR); Philippe Dessen, Ivry sur Seine (FR); Philippe Vielh, Sceaux (FR)

(73) Assignees: Centre National de la Recherche Scientifique, Paris (FR); Institut Gustave Roussy, Villejuif (FR)

( * ) Notice: Subject to any disclaimer, the term of this patent is extended or adjusted under 35 U.S.C. 154(b) by 0 days.

(21) Appl. No.: 12/811,792

(22) PCT Filed: Jan. 5, 2009

(86) PCT No.: PCT/EP2009/050060
§ 371 (c)(1),
(2), (4) Date: Sep. 29, 2010

(87) PCT Pub. No.: WO2009/087139
PCT Pub. Date: Jul. 16, 2009

(65) Prior Publication Data
US 2011/0009286 A1 Jan. 13, 2011

(30) Foreign Application Priority Data
Jan. 4, 2008 (EP) .................................... 08100106

(51) Int. Cl.
C07H 21/04 (2006.01)
(52) U.S. Cl. ................... 536/24.31; 536/24.3; 536/23.1
(58) Field of Classification Search .................. None
See application file for complete search history.

(56) References Cited

U.S. PATENT DOCUMENTS

| 6,881,571 | B1 * | 4/2005 | Schweighoffer et al. | .. 435/287.2 |
| 2001/0053519 | A1 * | 12/2001 | Fodor et al. | ............. 435/6 |
| 2002/0048763 | A1 * | 4/2002 | Penn et al. | ............. 435/6 |
| 2003/0219741 | A1 | 11/2003 | Isogai et al. | |

FOREIGN PATENT DOCUMENTS

| WO | 01/57270 A | 8/2001 |
| WO | 03/106648 A | 12/2003 |
| WO | 2004/106495 A | 12/2004 |

OTHER PUBLICATIONS

GenBank Accession AC004505.1 GI:2996633 (http://www.ncbi.nlm.nih.gov/nucleotide/2996633?report=genbank&log$=nuclalign&blast_rank=12&RID=EYKP3F0H01N, Jun. 20, 1998).*
Affymetrix: "GeneChip exon array system for human, mouse, and rat", Affymetrix Data Sheet, 2006, XP002480421.
"Affymetrix GeneChip Human Genome U133 Array Set HG-U133A", GEO, Mar. 11, 2002, XP002355386.
Miao Lixia et al: "Alternative splicing of breast cancer associated gene BRCA1 from breast cancer cell line" Journal of Biochemistry and Molecular Biology, Jan. 1, 2007, pp. 15-21, vol. 40, No. 1, XP008091534.
Mandusic Vesna et al, "Expression of estrogen receptor beta wt isoform (ER beta 1) and ER beta Delta 5 splice variant mRNAs in sporadic breast cancer", Journal of Cancer Research and Clinical Oncology, Aug. 2007, pp. 571-579, vol. 133, No. 8, XP 002480405.
Span Paul N et al: "Do the survivin (BIRC5) splice variants modulate or add to the prognostic value of total survivin in breast cancer?", Clinical Chemistry, Sep. 2006, pp. 1693-1700, vol. 52, No. 9, XP002480406.
Agrawal Shirpa et al: Differential expression of PTEN and its splice variants in heritable and sporadic breast cancer, Proceedings of American Association for Cancer Research Annual Meeting, Apr. 2006, pp. 841, XP001536928.
Landi Stefano et al: "Interleukin-4 and interleukin-4 receptor polymorphisms and colorectal cancer risk", European Journal of Cancer, Mar. 2007, pp. 762-768, vol. 43, No. 4, XP002480876.
European Search Report in Corresponding Application No. EP 08 10 0106 Dated May 20, 2008.
International Search Report in Corresponding Application No. PCT/EP2009/050060 Dated May 4, 2009.

* cited by examiner

Primary Examiner — Steven Pohnert
(74) Attorney, Agent, or Firm — Young & Thompson

(57) ABSTRACT

The invention relates to the use of a multiplicity of polynucleotide probe sets, the multiplicity of polynucleotide probe sets consisting in a combination of pools of polynucleotide probe sets, each polynucleotide probe set containing at least one polynucleotide probe chosen among a library of nucleic acid sequences, the polynucleotide probes involved in the combination of pools of polynucleotide probe sets of the multiplicity of polynucleotide probe sets being such that each polynucleotide probe specifically hybridizes with one gene, and/or at least one of its variants when present, for determining the variation of expression at least 12 genes, and their variants when present, in order to diagnose the benign or malignant state of a breast tumor.

12 Claims, 7 Drawing Sheets

3A

3B

3C

3D

3E

3F

3G

MOLECULAR IN VITRO DIAGNOSIS OF BREAST CANCER

The present invention describes a molecular in vitro diagnosis of breast cancers. More particularly, the invention relates to the use of molecular probes for the diagnosis evaluation of breast tumors.

Breast Cancer is the most frequent cancer in women in western countries (40,000 new cases in France/year). Although several advances have been achieved in the last 10 years the mortality rates remain high (11,000 death/year in France). There is therefore a need for a new generation of advances in this disease. Two axes have allowed improvement of breast cancer survival rates: i. an earlier and more accurate diagnosis, ii. the development of adjuvant therapies.

Breast Cancer diagnosis is currently performed in a vast majority of cases by a preoperative core needle biopsy. This exam is currently considered as a level 1 recommendation in France (www.has-sante.fr). In selected centers that are experts in this field, a fine needle aspiration is used to perform breast cancer diagnosis. Overall, the preoperative diagnosis of breast cancer is currently allowed by microscopic assessment of samples obtained either fine needle aspiration (FNA) or core needle biopsy (CNB). Each of this approach presents some limitations that hamper the quality of care in patients who present a breast lesion. FNA is associated with an unacceptable rate of misdiagnosis. The rate of uncertain diagnosis is indeed around 30% (Oyama T, Koibuchi Y, McKee G. Core needle biopsy (CNB) as a diagnostic method for breast lesions: comparison with fine needle aspiration cytology (FNA). Breast Cancer. 2004; 11(4):339-42; Orell S R, Farshid G. False-positive reports in fine needle biopsy of breast lesions. Pathology. 2001 November; 33(4):428-36; Meunier M, Clough K. Fine needle aspiration cytology versus percutaneous biopsy of nonpalpable breast lesions. Eur J Radiol. 2002 April; 42(1):10-6). CNB exhibits better performance for diagnosis but is associated with some major limitations. First, since CNB is a complex procedure, the appointments are usually given several weeks after detection of breast lesions. This induces a delayed diagnosis and therefore treatment. With the increase of mass screening, this delay will probably increase over time. Second, the CNB is associated with clinical side effects. The rate of hematoma related to the procedure indeed range between 0.6 and 4% (Barreau B, Tastet S, Lakdja F, Henriques C, Valentin F, Labat M J, Dilhuydy M H. [Patients' information in percutaneous core breast biopsy] Bull Cancer. 2005 March; 92(3):257-65). In addition, CNB is associated is a more painful procedure as compared to FNA. Finally, CNB is an expensive procedure for a frequent disease (200 Euros/procedure). Overall, from these considerations rises the need for a diagnostic test performed on FNA samples that would be accurate, quick and cost-saving. This test could either substitute cytological exam of FNA sample or be performed in complement to this one. This test would allow an earlier, safer and cost-saving diagnosis procedure.

Regarding mass screening, mammogram is currently considered as the gold standard for mass screening. Nevertheless, this approach is limited by a high rate of false negative results, especially in young women and in aggressive tumors. In addition, mammogram is limited by the fact that a significant proportion of women do not perform the test. These considerations point out the need for a screening test that would be better or complementary to mammogram and that would be based on an easier procedure.

So, there is a need to provide test for the patients to diagnose and give a diagnosis of the status of the breast tumor detected.

Many methods based on the knowledge of the molecular mechanism of the breast tumor evolution have been extensively described. These methods describe in particular large-scale process for the determination of variation of expression of genes, or proteins, which can define a hallmark of the breast tumor evolution.

WO 2007/048978 describes methods and compositions for the detection of molecular markers in order to diagnose cancer. In particular, this document describes methods and compositions that can be used to detect the presence or evolution of a breast tumor in a patient.

However, this document discloses in particular micro-arrays for the evaluation of miss-regulated expressed genes, without interest for the expression of variants of genes.

WO 2004/065545 discloses a diagnostic and prognostic method of the breast cancer tumor status, wherein said method consists to compare the expression profile of at least 5 genes of a determined list of 70 genes to the expression profile of said at least 5 genes of a determined list of 70 genes of a control tumor.

However, this document never teaches that the disclosed method can detect splicing variant of the mentioned at least 5 genes chosen among the list of 70 genes to determine the breast cancer status of a tumor.

The setting-up of new arrays to analyse the large-scale expression of exons allows a highly accurate identification of differential molecular events between two conditions. This approach not only analyzes genes differentially expressed (as it is the case with conventional DNA array) but also the differential splicing events. Applied to breast cancer, this large scale analysis could identify differential expression of gene sequences between cancer and benign lesions. Based on these data, it would be possible to set-up molecular assays that could allow a molecular diagnosis of breast cancer based on FNA samples, that would allow a quick, accurate and cost-saving diagnosis. In addition, this approach could allow to set-up a molecular test for breast cancer screening based on blood samples, ductal lavage or breast sampling by FNA.

One aim of the invention is to provide a molecular diagnosis to determine the status of a breast tumor.

Another aim of the invention provides micro-arrays to determine the benign or malignant status of a breast tumor.

Another aim of the invention provides a method using the micro-array to determine the benign or malignant status of a breast tumor.

The invention also provides a kit for the breast cancer diagnosis.

The invention discloses the use of a multiplicity of polynucleotide probe sets, said multiplicity of polynucleotide probe sets consisting in a combination of pools of polynucleotide probe sets, each polynucleotide probe set containing at least one polynucleotide probe chosen among a library of nucleic acid sequences, each nucleic acid sequence specifically hybridizing with a gene, and/or at least one of its variants when present, said gene being chosen among the group of genes consisting in SEQ ID NO 5419 to SEQ ID NO 5693, each given gene, when it presents NO variant, comprising at least one target region, the nucleic acid sequence of which is chosen among SEQ ID NO 2939 TO SEQ ID NO 4578, said target region characterizing said gene, each given gene, when it presents at least one variant, comprising at least two target regions such that:

at least one of the respective nucleic acid sequences of said target region chosen among SEQ ID NO 2939 to SEQ ID NO 4578 is present in a given variant of said gene, at least one of the respective nucleic acid sequences of said target region chosen among SEQ ID NO 2939 to SEQ ID NO 4578 is either absent in a given variant or is present in a configuration that differs from the one of said gene, said two target regions characterizing said gene, each variant of a given gene presenting at least one target region, said target region being such that its respective nucleic acid sequence is chosen among SEQ ID NO 2939 to SEQ ID NO 4578, each variant is characterized by:
  either the combination of the presence of at least one target region also present in the gene, the respective nucleic acid sequence of which being chosen among SEQ ID NO 2939 to SEQ ID NO 4578, and the absence of at least one target region present in the gene the respective nucleic acid sequence of which being chosen among SEQ ID NO 2939 to SEQ ID NO 4578,
  or the presence of a target region, the respective nucleic acid sequence of which being chosen among SEQ ID NO 2939 to SEQ ID NO 4578, said target region presenting a configuration that does not naturally exist in the gene, each polynucleotide probe of a polynucleotide probe set hybridizes with a specific nucleic acid sequence contained in a given target region of the target regions characterizing a given gene, and/or at least one of its variants when present, each given gene, and its variants when present, is specifically recognized by the polynucleotide probes of at least a given polynucleotide probe set, each polynucleotide probe of a given pool of polynucleotide probe set being such that it hybridizes with a given gene, and/or at least one of its variants when present, and cannot hybridize with any other gene different from said given gene, and cannot hybridize with any other variants of a gene different from said given gene, the polynucleotide probes involved in the combination of pools of polynucleotide probe sets of said multiplicity of polynucleotide probe sets being such that each polynucleotide probe specifically hybridizes with one gene, and/or at least one of its variants when present, of a sub-group comprising 12 genes among the genes of the group consisting in SEQ ID NO 5419 to SEQ ID NO 5693, for determining the variation of expression a gene, and its variants when present, of said sub-group in order to diagnose the benign or malignant state of a breast tumor.

The invention discloses the use of a multiplicity of polynucleotide probe sets, each polynucleotide probe set containing at least one polynucleotide probe chosen among a library of nucleic acid sequences, said library comprising or consisting of at least one copy each of the nucleic acids consisting of SEQ ID NO 1 to SEQ ID NO 2938, said polynucleotide probes being such that the nucleic acid sequence of each polynucleotide probe specifically hybridizes with the nucleotidic sequence of one target region of one gene, and/or of at least one of its variants when present, for determining the variation of the expression of
  at least 12 determined genes belonging to a group of determined genes represented by the nucleotidic sequences SEQ ID NO: 5419 to SEQ ID NO: 5693 and
  at least one variant of said genes at least 12 determined genes, when they exist,
  said 12 determined genes being represented by the following nucleotidic sequences:
  SEQ ID NOs 5421; 5423; 5432; 5434; 5486; 5491; 5525; 5552; 5599; 5652; 5654 and 5683,
in order to diagnose in vitro or ex vivo the benign or malignant state of a breast tumor,
  wherein
  a) each given gene,
    a. when it presents no variant, comprises at least one target region, said target region characterizing said gene,
    b. when it presents one variant, comprises at least one target region, said target region characterizing said gene and its variant, and preferably said variant being characterized by the fact that its nucleic acid sequence is shorter than the nucleic acid sequence of said gene,
    c. when it presents at least two variants, comprises at least two target regions, said two target regions characterizing said gene, such that:
      i. at least one of the respective polynucleotidic sequences of said target region is present in a given variant of said gene, and
      ii. at least one of the respective polynucleotidic sequences of said target region is either
        absent in a given variant, or
        present in a given variant in a configuration that differs from the one of said gene,
        preferably said variant being characterized such that its nucleic acid sequence is shorter than the nucleic acid of said gene,
  b) each variant of a given gene presents at least one target region,
  and
    if said variant is the unique variant of a gene, said variant has the same target as said gene, and
    if said variant is one of the variants of a gene that has at least two variants, each variant of said gene is characterized by either:
      a. the combination of the presence of at least one target region also present in the gene, and the absence of at least one target region present in the gene, or
      b. the combination of the presence of at least one target region also present in the gene, and the presence of a target region, said target region presenting a configuration that does not naturally exist in the gene,
  c) the nucleotidic sequence of each given gene, and its variants when present, is specifically recognized by the nucleic acid sequences of polynucleotide probes contained in at least one given polynucleotide probe set,
  d) the nucleic acid sequence of each polynucleotide probe of a polynucleotide probe set hybridizes with a specific polynucleotidic sequence contained in a given target region of the target regions which characterize a given gene, and/or at least one of its variants when present,
  e) the nucleic acid sequence of each polynucleotide probe of a given pool of polynucleotide probe set being such that
    a. it hybridizes with the nucleotidic sequence of a given gene, and/or of at least one of its variants when present, and b. cannot hybridize with
   i. the nucleotidic sequence of any other gene different from said given gene, and
   ii. the nucleotidic sequence of any other variants of a gene different from said given gene,
   with the proviso that said gene, and its variants when present, is not KRT17, LOC440421, KRT6C and KRT6A, said genes being respectively represented by SEQ ID NO 5431; 5689; 5651 and 5682.

In the case of KRT17, LOC440421, KRT6C and KRT6A genes, said genes being respectively represented by SEQ ID NO 5431; 5689; 5651 and 5682, the above mentioned definition of the nucleic acid sequence of each polynucleotide probe of a given pool of polynucleotide probe set applies with the exception that:

1—polynucleotide probes of a given pool of polynucleotide probe set recognizing KRT17 can hybridize with LOC440421 and at least one of its variant when present, 2—polynucleotide probes of a given pool of polynucleotide probe set recognizing LOC440421 can hybridize with KRT17 and at least one of its variant when present, 3—polynucleotide probes of a given pool of polynucleotide probe set recognizing KRT6C can hybridize with KRT6A and at least one of its variant when present, and 4—polynucleotide probes of a given pool of polynucleotide probe set recognizing KRT6A can hybridize with KRT6C and at least one of its variant when present.

The invention is based on the unexpected observation made by the inventors that the variation of expression of some genes, and their variants when they exist, may characterize the evolution of a diagnosed breast tumor. More particularly, the variants of the invention are the products of a differential splicing, or alternative splicing.

The inventors have demonstrated that the variation of expression of at least 12 determined genes of a group of 275 determined genes, and of variants of said at least 12 determined genes when they exist, hallmarks the benign or malignant status of a breast tumor.

Then, the invention describes the use of polynucleotide probes to characterize a benign versus malignant hallmark of a breast tumor, each polynucleotide probe hybridizing specifically with one gene, and at least one of its splicing variants when they exist, said gene splicing variant being able to be recognized by at least one polynucleotide probe.

In genetics, splicing is a modification of genetic information after transcription, in which introns of precursor messenger RNA (pre-mRNA) are removed and exons of precursor messenger RNA are joined. The splicing prepares the pre-mRNA to produce the mature messenger RNA (mRNA), which then undergoes translation as part of the protein synthesis to produce proteins.

Alternative splicing, in the sense of the invention, is the RNA splicing variation mechanism, in which the exons of the pre-mRNA are separated and reconnected so as to produce alternative ribonucleotide arrangements. In this way, alternative splicing uses genetic expression to facilitate the synthesis of a greater variety of transcripts.

When the pre-mRNA has been transcribed from the DNA, it includes several introns and exons. The exons which are retained in the mRNA are determined during the splicing process. The use of alternative splicing factors leads to a modification of the definition of a "gene" and imposes the variant notion.

For example a pre-mRNA containing 3 exons, if it is considered that variants must contain at least one exon of the gene and at least one exon missing of said gene, can hypothetically produce 6 different variants, as the result of alternative splicing.

In the invention, a gene is defined by the fact that it comprises the deoxyribonucleic acid sequence corresponding to the mRNA which results of the transcription of the DNA sequence, and after the splicing process. Then, the gene is characterized in that it comprises all the exons present in the genomic sequence of said gene.

All the 275 genes considered in the invention present a nucleic acid sequence chosen among the group consisting in SEQ ID NO 5419 to SEQ ID NO 5693.

In the invention, there are two alternatives for a gene:
said gene is not submitted to alternative splicing, and presents no variants, or
said gene presents at least one variant.

In the case of a gene having no variant, this gene can is characterized in the invention by the presence of a target region. This target region corresponds to a nucleic acid sequence contained in the total nucleic acid sequence of the said gene.

In the case of a gene having one variant, this gene is defined by a target region, and its variant is defined by the same target region. The difference between the gene and its variant is preferably determined by the fact that the nucleic acid sequence of said gene is longer than the nucleic acid sequence of its variant.

This recognizing by one target region allows a redundancy of the representativity of said gene. Indeed, the target region contained in a gene having one variant is thus recognized at least twice, i.e. when the gene is present and when the variant of this gene is present. This redundancy enhances the specificity of detection of the gene expression variation.

In the case of a gene having at least two variants, this gene is defined by at least two regions, these two regions characterizing the gene. These regions are therefore present in gene. These regions, also called target regions correspond to nucleic acid sequences contained in the total nucleic acid sequence of said gene. Moreover, these target regions of said gene are located at a different position in the sequence of said gene.

The targets regions that are involved in the invention present a nucleic acid sequence chosen among the group consisting in SEQ ID NO 2939 to SEQ ID NO 4578.

According to the invention, a "variant" is defined as a polynucleotide molecule that differs from the reference polynucleotide molecule (the gene), but retains essential properties. The gene and its variants share similar polynucleotide sequences with, for example, 70% of nucleic acids identity, preferably 80% of nucleic acids identity, preferably 90% of nucleic acids identity and more preferably 95% of nucleic acids identity. The variants of the invention can be also considered as isoforms.

To be considered as a variant of a given gene, a polynucleotide sequence must contain at least one nucleotide sequence present in the said gene, this sequence corresponding to the target sequence defined above.

If a variant is the unique variant of a gene, this variant has the same target region as its gene, preferably with a nucleic acid sequence with a size that is shorter than the size of the nucleic acid sequence of said gene. Since said variant corresponds to a splicing product of a gene, it generally has one or more exons lacking that are present in said gene. Nevertheless, it is possible, in some rare examples, that a variant of a gene has a nucleic acid sequence with a size which is higher than the size of the nucleic acid sequence of said gene.

If a variant is a variant of a gene that has at least two variants, said variant has at least one difference in the presence of a nucleic acid sequence with respect to the given gene nucleic acid sequence. The specific combination of the presence of at least one target sequence and the absence of at least one target sequence defines the specific characteristic of a given variant. Therefore, each variant is defined by a "bar code" corresponding to the diversity of the presence and absence of all the target sequences present in a gene.

For example, if a gene contains 3 exons, all the nucleic acid sequences consisting in least one exon of said gene, and missing at least one of the other 2 exons of the said given gene, are considered as variants of said given gene.

FIG. 1A illustrates this example.

In the invention, a variant of a gene is characterized in that it comprises at least on target region. These target regions corresponds to polynucleotidic sequences chosen among the group consisting in SEQ ID NO 2939 to SEQ ID NO 4578.

So, a given variant of a gene can be characterized with respect to the target sequence by the fact it contains at least a target region, present in the gene corresponding to said variant, and must is devoid of at least one target region, present in the gene corresponding to said variant, only in the case of a gene that has at least two variants.

As defined above, a variant of a gene having at least two variants is then characterized by a bar code which corresponds to a combination of the presence of at least one target region of the gene, corresponding to the variant, and the absence of at least one target region of the gene corresponding to the variant.

A variant can also be alternatively defined. This other definition is supported by the feature of the invention: the alternative splicing.

When a gene, constituted by at least 3 exons, is differentially spliced, in the corresponding variants, some exons are fused to exons which are not naturally fused in the sequence of the gene. For example, in a gene constituted by 3 exons E1, E2 and E3, one variant can be constituted by the fusion of E1 and E3. In the gene, the natural configuration corresponds to the sequence E1-E2-E3. Then the configuration observed in the variant, E1-E3, is considered as a non natural configuration.

In this case, variant presents a sequence that does not exist in the natural configuration of the gene. It generally corresponds to a junction of to distant exons, separated by at least one other exon. If the target region characterizing the variant corresponds to the junction between two exons, naturally distant in the normal configuration in the gene, said target region characterizes specifically said variant. This example is illustrated by FIG. 1B.

Example of genes having, or not, at least one variant are represented in FIG. 3.

According to the invention, polynucleotide probes are used to detect the variation of expression of a gene, and/or its variants when they exist, to determine the status of a breast tumor.

Artificially, polynucleotide probes are grouped to form a polynucleotide probe set. The term "polynucleotide probe set" used in the invention defines a group of polynucleotide probes as described above. A given set of polynucleotide probe contains from one polynucleotide probe to several polynucleotide probes. Preferably, the polynucleotide probe set of the invention contains one polynucleotide probe to three or four polynucleotide probes. Thereby, polynucleotide probes regrouped in a polynucleotide probe set of the invention are able to hybridize to the same target region.

The polynucleotides probes are also brought together to form a "pool of polynucleotide probe sets". The polynucleotides probes contained in the polynucleotide probe sets of a pool are able to specifically hybridize with nucleic acid sequences of a gene, and/or variants of said gene when they exist.

Alternatively, the polynucleotide probes contained in the polynucleotide probe sets of a pool are able to specifically hybridize neither with nucleic acid sequences of a different gene, nor with nucleic acid sequences of variants of said different gene, when they exist.

However, in few cases, the above definition should be modulated. In the case of genes KRT17 (SEQ ID NO 5431) and LOC440421 (SEQ ID NO 5689), these genes are two different genes, but share a high similarity/identity in their nucleic acid sequence. Thus, these two genes present some gene regions in their nucleic acid sequence which can be identical. If a target region is present in said gene region, therefore, the polynucleotide probe that recognize the target region contained in said gene region will be able to recognize the two genes.

A similar example applies with genes KRT6A (SEQ ID NO 5682) and KRT6C (SEQ ID NO 5651).

Then, polynucleotide probes of a pool of polynucleotide probe sets are able to characterize a gene and its variants. Moreover, a given gene, and its variants when they exist, can be detected only by the polynucleotide probes of the same pool of polynucleotide probe sets.

According to the invention, each gene, and its variants when present, can be detected by all the polynucleotide probes of a probe set. Moreover, each gene can be recognized by all the polynucleotide probes of at least one polynucleotide probe set, i.e. each gene and its variants can be defined by at least one polynucleotide probe set.

A variant can be detected by two polynucleotide probes belonging to two different polynucleotide probe sets, provided that they belong to the same pool of polynucleotide probe set.

The multiplicity, pool, polynucleotide probe set, and polynucleotide probe interconnection are represented in FIG. 2.

Terms "library comprising or consisting of at least one copy each of the nucleic acids consisting of SEQ ID NO 1 to SEQ ID NO 2938" means that the library can contain one, or two, or three, or four, or five or six or seven or eight, or nine or ten copies of each polynucleotide probes represented by the nucleic acids consisting of SEQ ID NO 1 to SEQ ID NO 2938. Thus, the minimal library contains 2938 polynucleotides probes, and the maximal library contains 29380 polynucleotides probes. Preferably the preferred library of the invention contains 4582 polynucleotides probes.

In the invention, a "benign breast tumor" is any non-cancerous breast abnormality. Some (not all) benign conditions can signal an increased risk for breast cancer. The most common benign breast conditions include fibrocystic breast condition, benign breast tumors, and breast inflammation. Depending on the type of benign breast condition and the patient's medical situation, treatment may or may not be necessary.

In the invention, a "malignant breast tumor refers" to a malignant tumor that has developed from cells in the breast. Malignant tumors penetrate and destroy healthy body tissues. A group of cells within a tumor may also break away and spread to other parts of the body. Cells that spread from one region of the body into another are called metastases.

The term "base" is used to define the components of the DNA or RNA, i.e. deoxyribonucleotides and ribonucleotides respectively.

Terms "nucleic acids", "nucleic acid molecule", "nucleic acid sequence", "polynucleotidic sequence", and "polynucleotide" are uniformly used to define a chain of bases that characterizing a DNA or an RNA molecule.

In the invention, "polynucleotide probe" represent a fragment of nucleic acid molecule, corresponding to DNA or RNA, with a variable length. The length of the polynucleotide probe is commonly comprised between 15 bases to 1000 bases, and preferably between 20 bases to 500 bases. Advantageously, the polynucleotide probes defined in the invention comprise from 20 bases to 30 bases. These polynucleotide probes are defined by their nucleic acid sequence.

In the invention, terms "multiplicity" and "combination" are used to define a group of polynucleotide probes sets and polynucleotide probes, respectively. Theses groups correspond to an ensemble of probes, or sets of probes, characterized in that they contains similar information.

According to the invention, each nucleic acid sequence corresponding to nucleic acid probe "specifically hybridizes with" a target region of the said gene. These terms mean that each polynucleotide probe is able to hybridize with a gene, and/or its variants when they exist, defined above. The polynucleotide probe thereby hybridizes to single-stranded nucleic acid molecule (gene and/or its variants, which are DNA or RNA) whose nucleic acid sequence allows base pairing due to complementarity between the nucleic acid sequence of the probe and the nucleic acid sequence of the gene and/or variants of said gene. The base pairing (A-T;G-C) is a concept well known by the skilled man in the art.

Each polynucleotide probe is able to hybridize with one gene and/or at least one variant of said gene, in a specific region of said variant called target region.

Said target region is then defined as the region allowing the base pairing between polynucleotide probe and a gene and/or its variants, when they exist.

Thereby, each polynucleotide probe is able to define a gene and/or at least one variant of said gene, when they exist.

According to the invention, each polynucleotide probe specifically hybridizes with a specific nucleic acid sequence contained in the target region. Moreover, each polynucleotide probes can recognizes a sequence overlapping partially with the sequence recognized by another probe of the same polynucleotide probe set.

To sum up, in the invention each gene, or reference transcript, can be expressed differentially in the form of variants. These variants differ from each other by the presence or absence or the variation of a sequence of a specific region: the target region. This region is liable to be recognized by one to three polynucleotide probes, said polynucleotide probes hybridizing with the same target region being brought together in a polynucleotide probe set.

Then, the use of the multiplicity of polynucleotide probe sets of the invention allows to detect the variation of expression of at least 12 determined genes consisting in SEQ ID NO 5421, SEQ ID NO 5423, SEQ ID NO 5432, SEQ ID NO 5434, SEQ ID NO 5486, SEQ ID NO 5491, SEQ ID NO 5525, SEQ ID NO 5552, SEQ ID NO 5599, SEQ ID NO 5652, SEQ ID NO 5654 and SEQ ID NO 5683, and their variants when they exist, of the group of determined genes constituted by genes of the group constituted by SEQ ID NO 5419 to SEQ ID NO 5693, and a skill man in the art can determine if the breast tumor is malignant or benign.

Thereby, if the expression of a given gene and/or at least one of its variants belonging to the group of 12 determined genes corresponds to a "profile" similar to that of a benign tumor, the tumor of the patient will be considered as evolving to a benign status. In contrast, the expression of a gene and/or at least one of its variant belonging to the group of 12 genes corresponds to that of a "profile" similar to a malignant tumor, it will be considered that the tumor is a malignant tumor.

In one embodiment, the invention discloses the use of a multiplicity of polynucleotide probe sets, wherein the multiplicity of polynucleotide probe sets consisting in a combination of pools of polynucleotide probe sets chosen among 1640 probe sets of polynucleotides, each polynucleotide probe set containing at least one polynucleotide probe chosen among a library of nucleic acid sequences consisting in SEQ ID NO 1 to SEQ ID NO 2938, each nucleic acid sequence hybridizing with a gene, and/or at least one of its variants when present, said gene being chosen among the group of genes consisting in SEQ ID NO 5419 to SEQ ID NO 5693, each given gene, when it presents NO variant, comprising at least one target region, the nucleic acid sequence of which is chosen among SEQ ID NO 2939 TO SEQ ID NO 4578, said target region characterizing said gene, each given gene, when it presents at least one variant, comprising at least two target regions such that:
at least one of the respective nucleic acid sequences of said target region chosen among SEQ ID NO 2939 to SEQ ID NO 4578 is present in a given variant of said gene,
at least one of the respective nucleic acid sequences of said target region chosen among SEQ ID NO 2939 to SEQ ID NO 4578 is either absent in a given variant or is present in a configuration that differs from the one of said gene,
said two target regions characterizing said gene, each variant of a given gene presenting at least one target region, said target region being such that its respective nucleic acid sequence is chosen among SEQ ID NO 2939 to SEQ ID NO 4578, each variant is characterized by:
either the combination of the presence of at least one target region also present in the gene, the respective nucleic acid sequence of which being chosen among SEQ ID NO 2939 to SEQ ID NO 4578, and the absence of at least one target region present in the gene the respective nucleic acid sequence of which being chosen among SEQ ID NO 2939 to SEQ ID NO 4578,
or the presence of a target region, the respective nucleic acid sequence of which being chosen among SEQ ID NO 2939 to SEQ ID NO 4578, said target region presenting a configuration that does not naturally exist in the gene, each polynucleotide probe of a polynucleotide probe set hybridizes with a specific nucleic acid sequence contained in a given target region of the target regions which characterize a given gene, and/or at least one of its variants when present, each given gene, and its variants when present, is specifically recognized by at least a given polynucleotide probe set, each polynucleotide probe of a given pool of polynucleotide probe set being such that it hybridizes with a given gene, and/or at least one of its variants when present, and cannot hybridize with any other gene different from said given gene, and cannot hybridize with any other variants of a gene different from said given gene, the polynucleotide probes involved in the combination of pools of polynucleotide probe sets of said multiplicity of polynucleotide probe sets being such that each polynucleotide probe specifically hybridizes with one gene, and/or at least one of its variants when present, of a sub-group comprising 12 genes among the genes of the group consisting in SEQ ID NO 5419 to SEQ ID NO 5693, for determining the variation of expression a gene, and its variants when present, of said sub-group in order to diagnose the benign or malignant state of a breast tumor.

In one preferred embodiment, the invention discloses the use of a multiplicity of polynucleotide probe sets defined above, for determining the variation of the expression of at least 20 determined genes of a group of genes represented by the nucleotidic sequences SEQ ID NO: 5419 to SEQ ID NO: 5693, said 20 determined genes being represented by the following nucleotidic sequences:
SEQ ID Nos 5421; 5423; 5432; 5434; 5457; 5486; 5491; 5513; 5516; 5525; 5532; 5552; 5599; 5616; 5624; 5643; 5652; 5654; 5673 and 5683.

The invention resides in the unexpected observation that the variation of expression of a group of at least 20 determined genes chosen among 275 determined genes is sufficient to determine the malignant or the benign status of a breast tumor.

In another preferred embodiment the invention discloses the use of a multiplicity of polynucleotide probe sets as above defined, for determining the variation of the expression of at least 35 determined genes of a group of determined genes represented by the nucleotidic sequences SEQ ID NO: 5419 to SEQ ID NO: 5693 said 35 determined genes being represented by the following nucleotidic sequences: SEQ ID Nos 5421; 5423; 5431; 5432; 5434; 5440; 5457; 5462; 5470; 5486; 5491; 5505; 5513; 5516; 5525; 5532; 5546; 5552; 5594; 5599; 5601; 5603; 5616; 5618; 5624; 5627; 5630; 5643; 5645; 5652; 5654; 5660; 5669; 5673 and 5683.

The invention also resides in the unexpected observation that the variation of expression of a group of at least 35 determined genes chosen among 275 determined genes is sufficient to determine the malignant or the benign status of a breast tumor.

In another preferred embodiment the invention discloses the use of a multiplicity of polynucleotide probe sets previously defined, for determining the variation of the expression of at least 43 determined genes of a group of determined genes represented by the nucleotidic sequences SEQ ID NO: 5419 to SEQ ID NO: 5693, said 43 determined genes being represented by the following nucleotidic sequences:
SEQ ID Nos 5421; 5423; 5431; 5432; 5434; 5440; 5455; 5457; 5462; 5470; 5475; 5486; 5491; 5499; 5505; 5513; 5516; 5520; 5525; 5532; 5546; 5549; 5552; 5594; 5599; 5601; 5603; 5616; 5618; 5623; 5624; 5627; 5630; 5643; 5645; 5651; 5652; 5654; 5660; 5669; 5673; 5683 and 5686.

The invention also resides in the unexpected observation that the variation of expression of a group of at least 43 determined genes chosen among 275 determined genes is sufficient to determine the malignant or the benign status of a breast tumor.

In another preferred embodiment the invention discloses the use of a multiplicity of polynucleotide probe sets such as defined above, for determining the variation of the expression of at least 206 determined genes of a group of determined genes represented by the nucleotidic sequences SEQ ID NO: 5419 to SEQ ID NO: 5693 said 206 determined genes being represented by the following nucleotidic sequences: SEQ ID Nos 5420; 5421; 5422; 5423; 5425; 5426; 5427; 5428; 5429; 5430; 5431; 5432; 5434; 5435; 5436; 5437; 5438; 5439; 5440; 5441; 5442; 5443; 5444; 5445; 5446; 5447; 5449; 5450; 5451; 5452; 5453; 5454; 5455; 5456; 5457; 5459; 5460; 5461; 5462; 5463; 5465; 5467; 5468; 5470; 5473; 5475; 5476; 5479; 5480; 5482; 5484; 5485; 5486; 5487; 5488; 5489; 5490; 5491; 5492; 5493; 5495; 5496; 5497; 5498; 5499; 5502; 5503; 5505; 5506; 5507; 5508; 5509; 5511; 5512; 5513; 5515; 5516; 5517; 5518; 5519; 5520; 5523; 5524; 5525; 5526; 5528; 5529; 5530; 5531; 5532; 5533; 5534; 5536; 5538; 5539; 5540; 5543; 5544; 5545; 5546; 5547; 5549; 5550; 5552; 5553; 5554; 5556; 5558; 5559; 5560; 5562; 5563; 5564; 5565; 5566; 5567; 5568; 5569; 5570; 5571; 5573; 5574; 5575; 5576; 5577; 5578; 5581; 5582; 5585; 5587; 5588; 5590; 5591; 5593; 5594; 5595; 5597; 5598; 5599; 5600; 5601; 5602; 5603; 5604; 5605; 5606; 5608; 5609; 5610; 5611; 5612; 5613; 5615; 5616; 5617; 5618; 5622; 5623; 5624; 5625; 5627; 5629; 5630; 5631; 5632; 5633; 5634; 5635; 5637; 5638; 5639; 5640; 5641; 5642; 5643; 5644; 5645; 5647; 5648; 5649; 5651; 5652; 5653; 5654; 5656; 5657; 5658; 5660; 5661; 5665; 5667; 5669; 5672; 5673; 5675; 5676; 5677; 5678; 5680; 5681; 5683; 5684; 5686; 5687; 5689 and 5692.

The invention also resides in the unexpected observation that the variation of expression of a group of at least 206 determined genes chosen among 275 determined genes is sufficient to determine the malignant or the benign status of a breast tumor, and provide the best results.

In another preferred embodiment the invention discloses the use of a multiplicity of polynucleotide probe sets such as above defined, for determining the variation of the expression of 275 determined genes represented by the nucleotidic sequences SEQ ID NO: 5419 to SEQ ID NO: 5693.

The invention also resides in the unexpected observation that the variation of expression of 275 determined genes is sufficient to determine the malignant or the benign status of a breast tumor.

Then, in an advantageous embodiment, the invention describes the use of a multiplicity of polynucleotide probe sets that allow the detection of variation of expression 12 genes, and their variants when they exist, said variation defining the benign or malignant hallmark of the breast tumor.

More particularly, the 12 genes, and their variants when they exist, are represented by their nucleic acid sequences consisting in SEQ ID NO 5421, SEQ ID NO 5423, SEQ ID NO 5432, SEQ ID NO 5434, SEQ ID NO 5486, SEQ ID NO 5491, SEQ ID NO 5525, SEQ ID NO 5552, SEQ ID NO 5599, SEQ ID NO 5652, SEQ ID NO 5654 and SEQ ID NO 5683 and are specifically recognized by their target sequences.

In one preferred embodiment, the invention relates to the use of a multiplicity of polynucleotide probe sets for determining the variation the gene expression as defined above, and of at least one variant of said genes when present, said variant being represented by the nucleic acid sequences SEQ ID NO 4579 to SEQ ID NO 5418 and SEQ ID NO 5694, the correspondence between each variant and its corresponding gene being represented in Table 1A-E and in Table 6.

Thus, according to the invention the inventors have demonstrated that the determination of the variation of expression of at least 12 genes chosen among a group of 275 genes, and of at least one variant of each at least 12 genes give a good information about the benign or malignant status of a breast tumor, without important false positives.

Also, others aspects of the invention demonstrate that the study of the variation of expression of:
at least 20 determined genes, or
at least 35 determined genes, or
at least 43 determined genes or
at least 206 determined genes
of a group of 275 determined genes, and the expression of at least one variant of said at least 20 determined genes, or
of said at least 35 determined genes, or
of said at least 43 determined genes, or
of said at least 206 determined genes
allows to the pathologist to clearly and without ambiguity determine if a breast tumor is, or will be, benign or malignant.

In one particular embodiment, the variation of expression of all the 275 determined genes and at least one of their variant allows the diagnostic.

In another particular embodiment, the invention relates to the use as defined above, for the determination of the variation of expression of at least 12 determined genes of the group of 275 determined genes represented by SEQ ID NO 5419 to SEQ ID NO 5693, and of at least one of the variants of said at least 12 determined genes, wherein the correspondence between genes and their variants is indicated in the following table 1A.

Table 1A represents the correspondences between the group of 12 determined genes and their corresponding variants.

| Gene Name | Gene SEQ ID | Variants SEQ ID |
| --- | --- | --- |
| AK5 | SEQ ID NO 5654 | SEQ ID NO 4620 |
| COL17A1 | SEQ ID NO 5683 | SEQ ID NO 4739; SEQ ID NO 4784; SEQ ID NO 5242; SEQ ID NO 5384 |
| DMD | SEQ ID NO 5421 | SEQ ID NO 4664; SEQ ID NO 4860; SEQ ID NO 5058; SEQ ID NO 5095; SEQ ID NO 5150; SEQ ID NO 5381; SEQ ID NO 5410; |
| KIT | SEQ ID NO 5423 | SEQ ID NO 5107 |
| KRT14 | SEQ ID NO 5434 | SEQ ID NO 4819; SEQ ID NO 4825; SEQ ID NO 4845; SEQ ID NO 4877; SEQ ID NO 4891; SEQ ID NO 4969 |
| KRT16 | SEQ ID NO 5525 | SEQ ID NO 4826; SEQ ID NO 4881 |
| KRT5 | SEQ ID NO 5432 | SEQ ID NO 5279 |
| MYH11 | SEQ ID NO 5599 | SEQ ID NO 4697; SEQ ID NO 4870; SEQ ID NO 5361; SEQ ID NO 5365 |
| NRG1 | SEQ ID NO 5552 | SEQ ID NO 5084 |
| PTN | SEQ ID NO 5486 | SEQ ID NO 4666 |
| SFRP1 | SEQ ID NO 5491 | SEQ ID NO 5161 |
| TSHZ2 | SEQ ID NO 5652 | SEQ ID NO 4962 |

In another particular embodiment, the invention relates to the use as defined above, for the determination of the variation of expression of at least 20 determined genes of the group of 275 genes represented by SEQ ID NO 5419 to SEQ ID NO 5693, and of at least one of the variants of said at least 20 determined genes, wherein the correspondence between genes and their variants is indicated in the following table 1B.

Table 1B represents the correspondences between the group of 20 determined genes and their corresponding variants.

| Gene Name | Gene SEQ ID | Variants SEQ ID |
| --- | --- | --- |
| AK5 | SEQ ID NO 5654 | SEQ ID NO 5224 |
| C2orf40 | SEQ ID NO 5616 | SEQ ID NO 4832 |
| C9orf61 | SEQ ID NO 5516 | SEQ ID NO 4661 |
| CNN1 | SEQ ID NO 5457 | SEQ ID NO 5181; SEQ ID NO 4666 |
| COL17A1 | SEQ ID NO 5683 | SEQ ID NO 4739; SEQ ID NO 4784; SEQ ID NO 5242; SEQ ID NO 5384 |
| DMD | SEQ ID NO 5421 | SEQ ID NO 4664; SEQ ID NO 4860; SEQ ID NO 4908; SEQ ID NO 5058; SEQ ID NO 5095; SEQ ID NO 5150; SEQ ID NO 5381; SEQ ID NO 5410; SEQ ID NO 5107 |
| DMN | SEQ ID NO 5643 | SEQ ID NO 4610; SEQ ID NO 5120 |
| EDN3 | SEQ ID NO 5673 | SEQ ID NO 5405 |
| IL33 | SEQ ID NO 5624 | SEQ ID NO 4927 |
| KIT | SEQ ID NO 5423 | SEQ ID NO 5177; SEQ ID NO 4748; SEQ ID NO 4817; SEQ ID NO 4821; SEQ ID NO 5152 |
| KRT14 | SEQ ID NO 5434 | SEQ ID NO 4969 |
| KRT16 | SEQ ID NO 5525 | SEQ ID NO 4826; SEQ ID NO 4881 |
| KRT5 | SEQ ID NO 5432 | SEQ ID NO 5279; SEQ ID NO 4740; SEQ ID NO 4819; SEQ ID NO 4825; SEQ ID NO 4845; SEQ ID NO 4877; SEQ ID NO 4878; SEQ ID NO 4891 |
| MYH11 | SEQ ID NO 5599 | SEQ ID NO 4697; SEQ ID NO 4870; SEQ ID NO 4972; SEQ ID NO 5103; SEQ ID NO 5323; SEQ ID NO 5361; SEQ ID NO 5365 |
| NRG1 | SEQ ID NO 5552 | SEQ ID NO 5084; SEQ ID NO 5413 |
| NTRK2 | SEQ ID NO 5532 | SEQ ID NO 5121 |
| PIK3C2G | SEQ ID NO 5513 | SEQ ID NO 5109 |
| PTN | SEQ ID NO 5486 | SEQ ID NO 5317; SEQ ID NO 4909 |
| SFRP1 | SEQ ID NO 5491 | SEQ ID NO 5161 |
| TSHZ2 | SEQ ID NO 5652 | SEQ ID NO 4962; SEQ ID NO 4620; SEQ ID NO 4694; SEQ ID NO 4786; SEQ ID NO 4794 |

In another preferred embodiment, the invention relates to the use as defined above, for the determination of the variation of expression of at least 35 determined genes of the group of 275 determined genes represented by SEQ ID NO 5419 to SEQ ID NO 5693, and of at least one of the variants of said at least 35 determined genes, wherein the correspondence between genes and their variants is indicated in the following table 1C.

Table 1C represents the correspondences between the group of 35 determined genes and their corresponding variants.

| Gene Name | Gene SEQ ID | Variants SEQ ID |
| --- | --- | --- |
| ACTA2 | SEQ ID NO 5462 | — |
| AK5 | SEQ ID NO 5654 | SEQ ID NO 4586; SEQ ID NO 4620; SEQ ID NO 4658; SEQ ID NO 4694; SEQ ID NO 4786; SEQ ID NO 4794; SEQ ID NO 4856; SEQ ID NO 5078; SEQ ID NO 5224; SEQ ID NO 5391 |
| C2orf40 | SEQ ID NO 5616 | SEQ ID NO 4832 |
| C9orf61 | SEQ ID NO 5516 | SEQ ID NO 4661 |
| CNN1 | SEQ ID NO 5457 | SEQ ID NO 5181 |
| CNTNAP3 | SEQ ID NO 5627 | SEQ ID NO 4675 |
| COL14A1 | SEQ ID NO 5594 | SEQ ID NO 5102 |
| COL17A1 | SEQ ID NO 5683 | SEQ ID NO 4739; SEQ ID NO 4784; SEQ ID NO 5242; SEQ ID NO 5384 |
| CRYAB | SEQ ID NO 5470 | SEQ ID NO 4858 |
| DMD | SEQ ID NO 5421 | SEQ ID NO 4664; SEQ ID NO 4860; SEQ ID NO 4908; SEQ ID NO 5058; SEQ ID NO 5095; SEQ ID NO 5150; SEQ ID NO 5381; SEQ ID NO 5387; SEQ ID NO 5410 |
| DMN | SEQ ID NO 5643 | SEQ ID NO 4610; SEQ ID NO 5120 |
| DST | SEQ ID NO 5660 | SEQ ID NO 5309 |
| EDN3 | SEQ ID NO 5673 | SEQ ID NO 5405 |
| FAM126A | SEQ ID NO 5618 | SEQ ID NO 5157 |
| FBXL7 | SEQ ID NO 5546 | SEQ ID NO 4932 |
| GRAMD3 | SEQ ID NO 5601 | SEQ ID NO 4857 |
| IL33 | SEQ ID NO 5624 | SEQ ID NO 4927 |
| IRX1 | SEQ ID NO 5603 | SEQ ID NO 5140 |
| KIT | SEQ ID NO 5423 | SEQ ID NO 5107; SEQ ID NO 5177 |
| KRT14 | SEQ ID NO 5434 | SEQ ID NO 4740; SEQ ID NO 4819; SEQ ID NO 4825; SEQ ID NO 4845; SEQ ID NO 4877; SEQ ID NO 4878; SEQ ID NO 4891; SEQ ID NO 4969 |
| KRT16 | SEQ ID NO 5525 | SEQ ID NO 4826; SEQ ID NO 4881 |

-continued

| Gene Name | Gene SEQ ID | Variants SEQ ID |
|---|---|---|
| KRT17 | SEQ ID NO 5431 | SEQ ID NO 4876; SEQ ID NO 4992 |
| KRT5 | SEQ ID NO 5432 | SEQ ID NO 4748; SEQ ID NO 4817; SEQ ID NO 4821; SEQ ID NO 4919; SEQ ID NO 5152; SEQ ID NO 5279 |
| MME | SEQ ID NO 5440 | SEQ ID NO 4579; SEQ ID NO 5054 |
| MYH11 | SEQ ID NO 5599 | SEQ ID NO 4697; SEQ ID NO 4870; SEQ ID NO 4972; SEQ ID NO 5053; SEQ ID NO 5103; SEQ ID NO 5323; SEQ ID NO 5361; SEQ ID NO 5365 |
| MYLK | SEQ ID NO 5630 | SEQ ID NO 5376 |
| NDRG2 | SEQ ID NO 5669 | SEQ ID NO 4868; SEQ ID NO 4911 |
| NRG1 | SEQ ID NO 5552 | SEQ ID NO 5084; SEQ ID NO 5148; SEQ ID NO 5413 |
| NTRK2 | SEQ ID NO 5532 | SEQ ID NO 5121 |
| PIK3C2G | SEQ ID NO 5513 | SEQ ID NO 5109 |
| PTN | SEQ ID NO 5486 | SEQ ID NO 4666; SEQ ID NO 5317 |
| SFRP1 | SEQ ID NO 5491 | SEQ ID NO 4909; SEQ ID NO 5161 |
| TANK | SEQ ID NO 5505 | SEQ ID NO 5069 |
| TSHZ2 | SEQ ID NO 5652 | SEQ ID NO 4962 |
| WIF1 | SEQ ID NO 5645 | SEQ ID NO 5397 |

In other preferred embodiment, the invention relates to the use as defined above, for the determination of the variation of expression of at least 43 determined genes of the group of 275 determined genes represented by SEQ ID NO 5419 to SEQ ID NO 5693, and of at least one of the variants of said at least 43 determined genes, wherein the correspondence between genes and their variants is indicated in the following table 1D.

Table 1D represents the correspondences between the group of 43 determined genes and their corresponding variants.

| Gene Name | Gene SEQ ID | Variants SEQ ID |
|---|---|---|
| ACTA2 | SEQ ID NO 5462 | SEQ ID NO 4633; SEQ ID NO 4795; SEQ ID NO 4956; SEQ ID NO 5052; SEQ ID NO 5093; SEQ ID NO |
| AK5 | SEQ ID NO 5654 | SEQ ID NO 4586; SEQ ID NO 4620; SEQ ID NO 4658; SEQ ID NO 4694; SEQ ID NO 4786; SEQ ID NO 4794; SEQ ID NO 4856; SEQ ID NO 5078; SEQ ID NO 5224; SEQ ID NO 5391 |
| C2orf40 | SEQ ID NO 5616 | SEQ ID NO 4832; SEQ ID NO 4862 |
| C9orf61 | SEQ ID NO 5516 | SEQ ID NO 4661 |
| CNN1 | SEQ ID NO 5457 | SEQ ID NO 5181; SEQ ID NO 5185 |
| CNTNAP3 | SEQ ID NO 5627 | SEQ ID NO 4597; SEQ ID NO 4675 |
| COL14A1 | SEQ ID NO 5594 | SEQ ID NO 5102 |
| COL17A1 | SEQ ID NO 5683 | SEQ ID NO 4739; SEQ ID NO 4784; SEQ ID NO 5242; SEQ ID NO 5384 |
| CRYAB | SEQ ID NO 5470 | SEQ ID NO 4858 |
| DKK3 | SEQ ID NO 5549 | SEQ ID NO 4933; SEQ ID NO 5208 |
| DMD | SEQ ID NO 5421 | SEQ ID NO 4664; SEQ ID NO 4860; SEQ ID NO 4908; SEQ ID NO 5058; SEQ ID NO 5095; SEQ ID NO 5150; SEQ ID NO 5381; SEQ ID NO 5387; SEQ ID NO 5410 |
| DMN | SEQ ID NO 5643 | SEQ ID NO 4610; SEQ ID NO 5120; SEQ ID NO 5396 |
| DST | SEQ ID NO 5660 | SEQ ID NO 5309 |
| EDN3 | SEQ ID NO 5673 | SEQ ID NO 4629 |
| FAM126A | SEQ ID NO 5618 | SEQ ID NO 5126; SEQ ID NO 5157 |
| FBXL7 | SEQ ID NO 5546 | SEQ ID NO 4932 |
| GRAMD3 | SEQ ID NO 5601 | SEQ ID NO 4857 |
| IL33 | SEQ ID NO 5624 | SEQ ID NO 4927 |
| IRX1 | SEQ ID NO 5603 | SEQ ID NO 5140 |
| KIT | SEQ ID NO 5423 | SEQ ID NO 5107; SEQ ID NO 5177 |
| KRT14 | SEQ ID NO 5434 | SEQ ID NO 4740; SEQ ID NO 4819; SEQ ID NO 4825; SEQ ID NO 4845; SEQ ID NO 4877; SEQ ID NO 4878; SEQ ID NO 4891; SEQ ID NO 4969 |
| KRT15 | SEQ ID NO 5475 | SEQ ID NO 4619; SEQ ID NO 4867; SEQ ID NO 4967 |
| KRT16 | SEQ ID NO 5525 | SEQ ID NO 4826; SEQ ID NO 4881 |

-continued

| Gene Name | Gene SEQ ID | Variants SEQ ID |
|---|---|---|
| KRT17 | SEQ ID NO 5431 | SEQ ID NO 4876; SEQ ID NO 4992; SEQ ID NO 5036 |
| KRT5 | SEQ ID NO 5432 | SEQ ID NO 4748; SEQ ID NO 4782; SEQ ID NO 4817; SEQ ID NO 4821; SEQ ID NO 4827; SEQ ID NO 4919; SEQ ID NO 4970; SEQ ID NO 5323; SEQ ID NO 5279; SEQ ID NO 5406 |
| KRT6C | SEQ ID NO 5651 | SEQ ID NO 4840 |
| MGC70870 | SEQ ID NO 5686 | SEQ ID NO 5201 |
| MID1 | SEQ ID NO 5623 | SEQ ID NO 4706 |
| MME | SEQ ID NO 5440 | SEQ ID NO 4579; SEQ ID NO 4607; SEQ ID NO 5054 |
| MYH11 | SEQ ID NO 5599 | SEQ ID NO 4697; SEQ ID NO 4870; SEQ ID NO 4972; SEQ ID NO 5053; SEQ ID NO 5103; SEQ ID NO 5323; SEQ ID NO 5361; SEQ ID NO 5365 |
| MYLK | SEQ ID NO 5630 | SEQ ID NO 5376 |
| NDRG2 | SEQ ID NO 5669 | SEQ ID NO 4868; SEQ ID NO 4898; SEQ ID NO 4911; SEQ ID NO 5010 |
| NRG1 | SEQ ID NO 5552 | SEQ ID NO 5084; SEQ ID NO 5085; SEQ ID NO 5148; SEQ ID NO 5395; SEQ ID NO 5412; SEQ ID NO 5413 |
| NTRK2 | SEQ ID NO 5532 | SEQ ID NO 5121 |
| PDE1C | SEQ ID NO 5520 | SEQ ID NO 4657 |
| PIK3C2G | SEQ ID NO 5513 | SEQ ID NO 5109 |
| PTN | SEQ ID NO 5486 | SEQ ID NO 4666; SEQ ID NO 5317 |
| SFRP1 | SEQ ID NO 5491 | SEQ ID NO 4909; SEQ ID NO 5161 |
| TANK | SEQ ID NO 5505 | SEQ ID NO 5069 |
| TOP2A | SEQ ID NO 5455 | SEQ ID NO 5153 |
| TP63 | SEQ ID NO 5499 | SEQ ID NO 4588 |
| TSHZ2 | SEQ ID NO 5652 | SEQ ID NO 4962 |
| WIF1 | SEQ ID NO 5645 | SEQ ID NO 5397 |

In another preferred embodiment, the invention relates to the use as defined above, for the determination of the variation of expression of at least 206 determined genes of the group of 275 determined genes represented by SEQ ID NO 5419 to SEQ ID NO 5693, and of at least one of the variants of said at least 206 determined genes, wherein the correspondence between genes and their variants is indicated in the following table 1E.

Table 1E represents the correspondences between the group of 206 determined genes and their corresponding variants.

| Gene Name | Gene SEQ ID | Variants SEQ ID |
|---|---|---|
| A2M | SEQ ID NO 5420 | SEQ ID NO 4855; SEQ ID NO 4945; SEQ ID NO 5092; SEQ ID NO 5248; SEQ ID NO 5328; SEQ ID NO 5363; SEQ ID NO 5364 |
| ACTA2 | SEQ ID NO 5462 | SEQ ID NO 4632; SEQ ID NO 4633; SEQ ID NO 4795; SEQ ID NO 4956; SEQ ID NO 4959; SEQ ID NO 4981; SEQ ID NO 5052; SEQ ID NO 5057; SEQ ID NO 5093; SEQ ID NO 5316; SEQ ID NO 5350; SEQ ID NO 5369 |
| ACTG2 | SEQ ID NO 5463 | SEQ ID NO 4774; SEQ ID NO 4777; SEQ ID NO 4940 |
| ADD3 | SEQ ID NO 5588 | SEQ ID NO 4629 |
| AK5 | SEQ ID NO 5654 | SEQ ID NO 4586; SEQ ID NO 4620; SEQ ID NO 4658; SEQ ID NO 4694; SEQ ID NO 4786; SEQ ID NO 4794; SEQ ID NO 4856; SEQ ID NO 5071; SEQ ID NO 5078; SEQ ID NO 5224; SEQ ID NO 5391 |
| ALDH7A1 | SEQ ID NO 5456 | SEQ ID NO 4836 |
| ALKBH3 | SEQ ID NO 5641 | SEQ ID NO 4756 |
| ANLN | SEQ ID NO 5587 | SEQ ID NO 4734; SEQ ID NO 4792; SEQ ID NO 5210 |
| ANXA1 | SEQ ID NO 5436 | SEQ ID NO 4651; SEQ ID NO 4760; SEQ ID NO 4888; SEQ ID NO 5066; SEQ ID NO 5343 |

| Gene Name | Gene SEQ ID | Variants SEQ ID |
|---|---|---|
| ANXA8L2 | SEQ ID NO 5465 | SEQ ID NO 4901; SEQ ID NO 5018; SEQ ID NO 5246 |
| APCDD1 | SEQ ID NO 5647 | SEQ ID NO 4871; SEQ ID NO 5001; SEQ ID NO 5081; SEQ ID NO 5182 |
| AQP1 | SEQ ID NO 5661 | SEQ ID NO 4676; SEQ ID NO 4865 |
| ARHGAP26 | SEQ ID NO 5560 | SEQ ID NO 5215 |
| ARL4A | SEQ ID NO 5453 | SEQ ID NO 4793; SEQ ID NO 5002; SEQ ID NO 5004 |
| ARRDC3 | SEQ ID NO 5591 | SEQ ID NO 4642; SEQ ID NO 4973 |
| ASPM | SEQ ID NO 5581 | SEQ ID NO 5050 |
| ASPN | SEQ ID NO 5573 | SEQ ID NO 4854 |
| ATP8B4 | SEQ ID NO 5608 | SEQ ID NO 4814 |
| B4GALNT4 | SEQ ID NO 5656 | SEQ ID NO 5007 |
| BCL11A | SEQ ID NO 5577 | SEQ ID NO 5204 |
| BUB1 | SEQ ID NO 5509 | SEQ ID NO 5082 |
| C1orf112 | SEQ ID NO 5582 | SEQ ID NO 5268 |
| C2orf40 | SEQ ID NO 5616 | SEQ ID NO 4832; SEQ ID NO 4862 |
| C3orf64 | SEQ ID NO 5653 | SEQ ID NO 4626 |
| C9orf61 | SEQ ID NO 5516 | SEQ ID NO 4661; SEQ ID NO 4788; SEQ ID NO 5034; SEQ ID NO 5290 |
| CCNB1 | SEQ ID NO 5615 | SEQ ID NO 5138 |
| CCNE2 | SEQ ID NO 5631 | SEQ ID NO 4656 |
| CDKN3 | SEQ ID NO 5523 | SEQ ID NO 4837 |
| CENPA | SEQ ID NO 5467 | SEQ ID NO 4637 |
| CENPE | SEQ ID NO 5468 | SEQ ID NO 5097 |
| CENPF | SEQ ID NO 5568 | SEQ ID NO 4843; SEQ ID NO 5130 |
| CFI | SEQ ID NO 5422 | SEQ ID NO 4719; SEQ ID NO 5105 |
| CHST9 | SEQ ID NO 5613 | SEQ ID NO 4582 |
| CLDN8 | SEQ ID NO 5667 | SEQ ID NO 4720; SEQ ID NO 4953 |
| CLIP4 | SEQ ID NO 5606 | SEQ ID NO 5314 |
| CNN1 | SEQ ID NO 5457 | SEQ ID NO 5079; SEQ ID NO 5181; SEQ ID NO 5185 |
| CNTNAP3 | SEQ ID NO 5627 | SEQ ID NO 4597; SEQ ID NO 4675 |
| CNTNAP3B | SEQ ID NO 5692 | SEQ ID NO 5399 |
| COL14A1 | SEQ ID NO 5594 | SEQ ID NO 4727; SEQ ID NO 4936; SEQ ID NO 5102; SEQ ID NO 5326; SEQ ID NO 5382; SEQ ID NO 5418 |
| COL17A1 | SEQ ID NO 5683 | SEQ ID NO 4739; SEQ ID NO 4747; SEQ ID NO 4784; SEQ ID NO 4897; SEQ ID NO 5008; SEQ ID NO 5242; SEQ ID NO 5384 |
| CRK | SEQ ID NO 5571 | SEQ ID NO 4757 |
| CRYAB | SEQ ID NO 5470 | SEQ ID NO 4611; SEQ ID NO 4685; SEQ ID NO 4688; SEQ ID NO 4689; SEQ ID NO 4773; SEQ ID NO 4858; SEQ ID NO 4863; SEQ ID NO 4894; SEQ ID NO 4975; SEQ ID NO 5407; SEQ ID NO 5416 |
| CTHRC1 | SEQ ID NO 5639 | SEQ ID NO 4598 |
| CX3CL1 | SEQ ID NO 5490 | SEQ ID NO 4630; SEQ ID NO 4951 |
| DHCR7 | SEQ ID NO 5459 | SEQ ID NO 5025; SEQ ID NO 5339 |
| DKK3 | SEQ ID NO 5549 | SEQ ID NO 4624; SEQ ID NO 4831; SEQ ID NO 4933; SEQ ID NO 4989; SEQ ID NO 5049; SEQ ID NO 5184; SEQ ID NO 5205; SEQ ID NO 5207; SEQ ID NO 5208; SEQ ID NO 5378 |
| DMD | SEQ ID NO 5421 | SEQ ID NO 4593; SEQ ID NO 4664; SEQ ID NO 4860; SEQ ID NO 4908; SEQ ID NO 5058; SEQ ID NO 5095; SEQ ID NO 5150; SEQ ID NO 5381; SEQ ID NO 5387; SEQ ID NO 5388; SEQ ID NO 5389; SEQ ID NO 5410 |
| DMN | SEQ ID NO 5643 | SEQ ID NO 4610; SEQ ID NO 5120; SEQ ID NO 5396 |
| DOCK8 | SEQ ID NO 5672 | SEQ ID NO 4623; SEQ ID NO 4728; SEQ ID NO 5118 |
| DST | SEQ ID NO 5660 | SEQ ID NO 4587; SEQ ID NO 4679; SEQ ID NO 5236; SEQ ID NO 5309; SEQ ID NO 5336 |
| EDN3 | SEQ ID NO 5673 | SEQ ID NO 4714; SEQ ID NO 5405 |
| EGR2 | SEQ ID NO 5429 | SEQ ID NO 4020; SEQ ID NO 5356 |
| ETV1 | SEQ ID NO 5518 | SEQ ID NO 4730; SEQ ID NO 5080; SEQ ID NO 5197; SEQ ID NO 5209; SEQ ID NO 5214; SEQ ID NO 5218; SEQ ID NO 5241; SEQ ID NO 5329; SEQ ID NO 5417 |
| ETV5 | SEQ ID NO 5511 | SEQ ID NO 4999; SEQ ID NO 5330 |
| FAM126A | SEQ ID NO 5618 | SEQ ID NO 4641; SEQ ID NO 4646; SEQ ID NO 5126; SEQ ID NO 5157 |
| FAM130A2 | SEQ ID NO 5609 | SEQ ID NO 5149; SEQ ID NO 5281 |
| FAM13A1 | SEQ ID NO 5559 | SEQ ID NO 4680; SEQ ID NO 4804; SEQ ID NO 5293 |
| FBXL7 | SEQ ID NO 5546 | SEQ ID NO 4932 |
| FDXR | SEQ ID NO 5503 | SEQ ID NO 5318 |
| FLJ25770 | SEQ ID NO 5684 | SEQ ID NO 4735 |
| FMO2 | SEQ ID NO 5460 | SEQ ID NO 4600; SEQ ID NO 5065 |
| FN1 | SEQ ID NO 5675 | SEQ ID NO 4608; SEQ ID NO 4609; SEQ ID NO 4636; SEQ ID NO 4649; SEQ ID NO 4842; SEQ ID NO 5015; SEQ ID NO 5022; SEQ ID NO 5098; SEQ ID NO 5141; SEQ ID NO 5164; SEQ ID NO 5165; SEQ ID NO 5183; SEQ ID NO 5186; SEQ ID NO 5258; SEQ ID NO 5307 |
| FRZB | SEQ ID NO 5461 | SEQ ID NO 5174 |
| FTO | SEQ ID NO 5687 | SEQ ID NO 4971; SEQ ID NO 5151; SEQ ID NO 5257 |
| FZD1 | SEQ ID NO 5497 | SEQ ID NO 4652 |
| GABRP | SEQ ID NO 5554 | SEQ ID NO 4614; SEQ ID NO 5031; SEQ ID NO 5061; SEQ ID NO 5067; SEQ ID NO 5347 |
| GALE | SEQ ID NO 5446 | SEQ ID NO 4618 |
| GJB3 | SEQ ID NO 5602 | SEQ ID NO 5262 |
| GLTSCR2 | SEQ ID NO 5566 | SEQ ID NO 4775; SEQ ID NO 4834; SEQ ID NO 4872 |
| GPM6B | SEQ ID NO 5443 | SEQ ID NO 5104 |
| GPR177 | SEQ ID NO 5444 | SEQ ID NO 5051; SEQ ID NO 5267; SEQ ID NO 5298 |
| GRAMD3 | SEQ ID NO 5601 | SEQ ID NO 4587; SEQ ID NO 4857; SEQ ID NO 4926; SEQ ID NO 4934; SEQ ID NO 5087; SEQ ID NO 5088; SEQ ID NO 5240; SEQ ID NO 5291; SEQ ID NO 5354 |
| GRIA4 | SEQ ID NO 5437 | SEQ ID NO 4772; SEQ ID NO 5238 |
| GSTA1 | SEQ ID NO 5644 | SEQ ID NO 4655 |
| GUCY1A3 | SEQ ID NO 5438 | SEQ ID NO 4716; SEQ ID NO 4886; SEQ ID NO 4913; SEQ ID NO 5044; SEQ ID NO 5070 |
| GYPC | SEQ ID NO 5473 | SEQ ID NO 5133 |
| HNRNPA1 | SEQ ID NO 5612 | SEQ ID NO 5273 |
| HOXA7 | SEQ ID NO 5538 | SEQ ID NO 5005 |
| IFNGR1 | SEQ ID NO 5430 | SEQ ID NO 4925 |
| IGF1 | SEQ ID NO 5435 | SEQ ID NO 5414 |
| IL33 | SEQ ID NO 5624 | SEQ ID NO 4927 |
| IMPAD1 | SEQ ID NO 5574 | SEQ ID NO 5360 |
| INTS8 | SEQ ID NO 5575 | SEQ ID NO 4724 |
| IRX1 | SEQ ID NO 5603 | SEQ ID NO 5140 |
| ITM2A | SEQ ID NO 5517 | SEQ ID NO 4592 |
| KCTD12 | SEQ ID NO 5638 | SEQ ID NO 5162 |
| KIAA0101 | SEQ ID NO 5556 | SEQ ID NO 4648; SEQ ID NO 4808; SEQ ID NO 4809; SEQ ID NO 4904 |
| KIAA2013 | SEQ ID NO 5637 | SEQ ID NO 4990 |
| KIF11 | SEQ ID NO 5512 | SEQ ID NO 4988 |
| KIF23 | SEQ ID NO 5640 | SEQ ID NO 4725; SEQ ID NO 4732; SEQ ID NO 4899 |
| KIF4A | SEQ ID NO 5547 | SEQ ID NO 4964 |
| KIT | SEQ ID NO 5423 | SEQ ID NO 5107; SEQ ID NO 5177 |
| KLHL13 | SEQ ID NO 5625 | SEQ ID NO 4979 |
| KMO | SEQ ID NO 5498 | SEQ ID NO 4653 |
| KRT13 | SEQ ID NO 5648 | SEQ ID NO 5261; SEQ ID NO 5351 |
| KRT14 | SEQ ID NO 5434 | SEQ ID NO 4740; SEQ ID NO 4818; SEQ ID NO 4819; SEQ ID NO 4825; SEQ ID NO 4845; SEQ ID NO 4877; SEQ ID NO 4878; SEQ ID NO 4891; SEQ ID NO 4969 |
| KRT15 | SEQ ID NO 5475 | SEQ ID NO 4619; SEQ ID NO 4645; SEQ ID NO 4737; SEQ ID NO 4844; SEQ ID NO 4849; SEQ ID NO 4866; SEQ ID NO 4867; SEQ ID NO 4869; SEQ ID NO 4882; SEQ ID NO 4890; SEQ ID NO 4967; SEQ ID NO 4978; SEQ ID NO 5147 |

| Gene Name | Gene SEQ ID | Variants SEQ ID |
| --- | --- | --- |
| KRT16 | SEQ ID NO 5525 | SEQ ID NO 4826; SEQ ID NO 4881 |
| KRT17 | SEQ ID NO 5431 | SEQ ID NO 4820; SEQ ID NO 4824; SEQ ID NO 4873; SEQ ID NO 4876; SEQ ID NO 4920; SEQ ID NO 4992; SEQ ID NO 5036; SEQ ID NO 5048 |
| KRT19 | SEQ ID NO 5476 | SEQ ID NO 4750; SEQ ID NO 4941 |
| KRT28 | SEQ ID NO 5657 | SEQ ID NO 5154 |
| KRT5 | SEQ ID NO 5432 | SEQ ID NO 4748; SEQ ID NO 4782; SEQ ID NO 4817; SEQ ID NO 4821; SEQ ID NO 4823; SEQ ID NO 4827; SEQ ID NO 4919; SEQ ID NO 4970; SEQ ID NO 5152; SEQ ID NO 5179; SEQ ID NO 5277; SEQ ID NO 5279; SEQ ID NO 5406 |
| KRT6C | SEQ ID NO 5651 | SEQ ID NO 4840; SEQ ID NO 5310 |
| KRT7 | SEQ ID NO 5524 | SEQ ID NO 4896; SEQ ID NO 4995 |
| KRT72 | SEQ ID NO 5633 | SEQ ID NO 5311 |
| LGR4 | SEQ ID NO 5585 | SEQ ID NO 4764; SEQ ID NO 5116 |
| LMOD1 | SEQ ID NO 5544 | SEQ ID NO 4710 |
| LMOD1 | SEQ ID NO | SEQ ID NO 5280 |
| LMOD1 | SEQ ID NO | SEQ ID NO 5302 |
| LOC147804 | SEQ ID NO 5680 | SEQ ID NO 5211 |
| LOC440421 | SEQ ID NO 5689 | SEQ ID NO 5006 |
| LPHN2 | SEQ ID NO 5545 | SEQ ID NO 4625; SEQ ID NO 5160 |
| LPHN3 | SEQ ID NO 5562 | SEQ ID NO 5187 |
| MAF | SEQ ID NO 5451 | SEQ ID NO 4850; SEQ ID NO 5390 |
| MAGED4B | SEQ ID NO 5611 | SEQ ID NO 5284 |
| MAML2 | SEQ ID NO 5617 | SEQ ID NO 4862; SEQ ID NO 5156 |
| MAP2K6 | SEQ ID NO 5485 | SEQ ID NO 4722; SEQ ID NO 4917 |
| MATN2 | SEQ ID NO 5479 | SEQ ID NO 4677; SEQ ID NO 4861; SEQ ID NO 5017; SEQ ID NO 5100 |
| MED20 | SEQ ID NO 5507 | SEQ ID NO 4830 |
| MERTK | SEQ ID NO 5536 | SEQ ID NO 5124 |
| MFGE8 | SEQ ID NO 5530 | SEQ ID NO 4580; SEQ ID NO 4711; SEQ ID NO 4765; SEQ ID NO 4839; SEQ ID NO 5301 |
| MGC70870 | SEQ ID NO 5686 | SEQ ID NO 5201 |
| MID1 | SEQ ID NO 5623 | SEQ ID NO 4698; SEQ ID NO 4699; SEQ ID NO 4700; SEQ ID NO 4701; SEQ ID NO 4702; SEQ ID NO 4703; SEQ ID NO 4705; SEQ ID NO 4706; SEQ ID NO 5074 |
| MKI67 | SEQ ID NO 5480 | SEQ ID NO 4754; SEQ ID NO 4790; SEQ ID NO 4884; SEQ ID NO 4921; SEQ ID NO 4954 |
| MME | SEQ ID NO 5440 | SEQ ID NO 4579; SEQ ID NO 4607; SEQ ID NO 5054 |
| MXI1 | SEQ ID NO 5635 | SEQ ID NO 5269 |
| MYH11 | SEQ ID NO 5599 | SEQ ID NO 4602; SEQ ID NO 4697; SEQ ID NO 4870; SEQ ID NO 4972; SEQ ID NO 5053; SEQ ID NO 5103; SEQ ID NO 5323; SEQ ID NO 5361; SEQ ID NO 5365 |
| MYLK | SEQ ID NO 5630 | SEQ ID NO 4682; SEQ ID NO 4687; SEQ ID NO 4931; SEQ ID NO 5358; SEQ ID NO 5376; SEQ ID NO 5400; SEQ ID NO 5401 |
| MYO18A | SEQ ID NO 5632 | SEQ ID NO 4907 |
| NCAPG | SEQ ID NO 5597 | SEQ ID NO 4630 |
| NDRG2 | SEQ ID NO 5669 | SEQ ID NO 4601; SEQ ID NO 4715; SEQ ID NO 4766; SEQ ID NO 4781; SEQ ID NO 4822; SEQ ID NO 4859; SEQ ID NO 4868; SEQ ID NO 4898; SEQ ID NO 4911; SEQ ID NO 4914; SEQ ID NO 4947; SEQ ID NO 4977; SEQ ID NO 4986; SEQ ID NO 5010; SEQ ID NO 5027; SEQ ID NO 5028; SEQ ID NO 5030; SEQ ID NO 5062; SEQ ID NO 5194; SEQ ID NO 5198; SEQ ID NO 5200; SEQ ID NO 5212; SEQ ID NO 5222; SEQ ID NO 5227; SEQ ID NO 5229; SEQ ID NO 5234; SEQ ID NO 5235; SEQ ID NO 5252; SEQ ID NO 5256; SEQ ID NO 5292; SEQ ID NO 5304; SEQ ID NO 5342; SEQ ID NO 5344; SEQ ID NO 5346; SEQ ID NO 5348; SEQ ID NO 5367 |
| NECAB1 | SEQ ID NO 5598 | SEQ ID NO 4797 |
| NEFH | SEQ ID NO 5593 | SEQ ID NO 4976; SEQ ID NO 5266 |
| NEK2 | SEQ ID NO 5482 | SEQ ID NO 4976 |
| NFIB | SEQ ID NO 5526 | SEQ ID NO 4628; SEQ ID NO 4767; SEQ ID NO 4833; SEQ ID NO 5271; SEQ ID NO 5370; SEQ ID NO 5371 |
| NME4 | SEQ ID NO 5519 | SEQ ID NO 4806; SEQ ID NO 5372 |
| NR3C2 | SEQ ID NO 5439 | SEQ ID NO 4606 |
| NRG1 | SEQ ID NO 5552 | SEQ ID NO 4713; SEQ ID NO 5084; SEQ ID NO 5085; SEQ ID NO 5086; SEQ ID NO 5148; SEQ ID NO 5393; SEQ ID NO 5394; SEQ ID NO 5395; SEQ ID NO 5412; SEQ ID NO 5413 |
| NTRK2 | SEQ ID NO 5532 | SEQ ID NO 4946; SEQ ID NO 5056; SEQ ID NO 5121; SEQ ID NO 5178; SEQ ID NO 5385; SEQ ID NO 5386 |
| NUSAP1 | SEQ ID NO 5570 | SEQ ID NO 4639; SEQ ID NO 4768; SEQ ID NO 4929; SEQ ID NO 5335 |
| ODZ2 | SEQ ID NO 5677 | SEQ ID NO 4665; SEQ ID NO 5176 |
| OGFRL1 | SEQ ID NO 5605 | SEQ ID NO 5040 |
| OSR1 | SEQ ID NO 5642 | SEQ ID NO 4937 |
| P2RY13 | SEQ ID NO 5600 | SEQ ID NO 4993 |
| PDE1C | SEQ ID NO 5520 | SEQ ID NO 4657 |
| PDGFRA | SEQ ID NO 5533 | SEQ ID NO 4918; SEQ ID NO 4938 |
| PELI1 | SEQ ID NO 5590 | SEQ ID NO 5014 |
| PFKM | SEQ ID NO 5425 | SEQ ID NO 5380 |
| PIGR | SEQ ID NO 5484 | SEQ ID NO 4663; SEQ ID NO 4916; SEQ ID NO 5345 |
| PIK3C2G | SEQ ID NO 5513 | SEQ ID NO 5109; SEQ ID NO 5345 |
| PKD2 | SEQ ID NO 5426 | SEQ ID NO 5111; SEQ ID NO 5128 |
| PPP1R14A | SEQ ID NO 5622 | SEQ ID NO 4592; SEQ ID NO 4721; SEQ ID NO 5137 |
| PRC1 | SEQ ID NO 5502 | SEQ ID NO 4631; SEQ ID NO 4744; SEQ ID NO 4785; SEQ ID NO 4994; SEQ ID NO 5075; SEQ ID NO 5188; SEQ ID NO 5191; SEQ ID NO 5312 |
| PRNP | SEQ ID NO 5427 | SEQ ID NO 4644; SEQ ID NO 4915 |
| PROS1 | SEQ ID NO 5428 | SEQ ID NO 5206 |
| PTN | SEQ ID NO 5486 | SEQ ID NO 4666; SEQ ID NO 5317 |
| PTPRZ1 | SEQ ID NO 5487 | SEQ ID NO 5064; SEQ ID NO 5112; SEQ ID NO 5125 |
| PTTG1 | SEQ ID NO 5506 | SEQ ID NO 4885; SEQ ID NO 5073; SEQ ID NO 5136 |
| PZP | SEQ ID NO 5488 | SEQ ID NO 4673; SEQ ID NO 4738; SEQ ID NO 4851; SEQ ID NO 5313 |
| RACGAP1 | SEQ ID NO 5550 | SEQ ID NO 4589; SEQ ID NO 5237; SEQ ID NO 5283; SEQ ID NO 5288; SEQ ID NO 5322 |
| RBMS3 | SEQ ID NO 5445 | SEQ ID NO 4980 |
| RIC3 | SEQ ID NO 5604 | SEQ ID NO 4612; SEQ ID NO 5140; SEQ ID NO 5155; SEQ ID NO 5270 |
| ROPN1B | SEQ ID NO 5447 | SEQ ID NO 4718; SEQ ID NO 5144 |
| RPL3 | SEQ ID NO 5441 | SEQ ID NO 4763; SEQ ID NO 4963 |
| RRM2 | SEQ ID NO 5452 | SEQ ID NO 4691; SEQ ID NO 4798 |
| S100B | SEQ ID NO 5534 | SEQ ID NO 4798; SEQ ID NO 4948; SEQ ID NO 4974 |
| S100P | SEQ ID NO 5531 | SEQ ID NO 4835 |
| SAA1 | SEQ ID NO 5665 | SEQ ID NO 4690; SEQ ID NO 4813 |
| SAA2 | SEQ ID NO 5610 | SEQ ID NO 4584; SEQ ID NO 4813; SEQ ID NO 4816; SEQ ID NO 5170; SEQ ID NO 5409 |
| SAMD5 | SEQ ID NO 5450 | SEQ ID NO 5158 |
| SATB1 | SEQ ID NO 5489 | SEQ ID NO 4709; SEQ ID NO 4815; SEQ ID NO 4852; SEQ ID NO 4950; SEQ ID NO 5249; SEQ ID NO 5337 |
| SFRP1 | SEQ ID NO 5491 | SEQ ID NO 4674; SEQ ID NO 4909; SEQ ID NO 5161 |
| SFTPD | SEQ ID NO 5492 | SEQ ID NO 4674 |
| SIRPA | SEQ ID NO 5634 | SEQ ID NO 4880; SEQ ID NO 4997; SEQ ID NO 5131; SEQ ID NO 5379 |
| SLC25A27 | SEQ ID NO 5508 | SEQ ID NO 5253 |
| SLC26A8 | SEQ ID NO 5629 | SEQ ID NO 4672 |
| SMARCA2 | SEQ ID NO 5493 | SEQ ID NO 4810 |
| SMC4 | SEQ ID NO 5678 | SEQ ID NO 4998; SEQ ID NO 5244; SEQ ID NO 5320 |

-continued

| Gene Name | Gene SEQ ID | Variants SEQ ID |
|---|---|---|
| SORBS1 | SEQ ID NO 5564 | SEQ ID NO 4681 |
| SPARCL1 | SEQ ID NO 5515 | SEQ ID NO 4585; SEQ ID NO 4693; SEQ ID NO 4832; SEQ ID NO 4910; SEQ ID NO 4924; SEQ ID NO 4935; SEQ ID NO 4939; SEQ ID NO 4960; SEQ ID NO 4961; SEQ ID NO 5029; SEQ ID NO 5035; SEQ ID NO 5055; SEQ ID NO 5059; SEQ ID NO 5090; SEQ ID NO 5127; SEQ ID NO 5199; SEQ ID NO 5202; SEQ ID NO 5228; SEQ ID NO 5230; SEQ ID NO 5232; SEQ ID NO 5254; SEQ ID NO 5276; SEQ ID NO 5325; SEQ ID NO 5353 |
| SPG3A | SEQ ID NO 5567 | SEQ ID NO 4966 |
| SPRY2 | SEQ ID NO 5529 | SEQ ID NO 4742; SEQ ID NO 4982; SEQ ID NO 5233 |
| TAGLN | SEQ ID NO 5442 | SEQ ID NO 4594; SEQ ID NO 4662; SEQ ID NO 4906; SEQ ID NO 5024; SEQ ID NO 5082; SEQ ID NO 5355 |
| TANK | SEQ ID NO 5505 | SEQ ID NO 4895; SEQ ID NO 5069 |
| TESC | SEQ ID NO 5576 | SEQ ID NO 5360 |
| TF | SEQ ID NO 5454 | SEQ ID NO 4654; SEQ ID NO 4668; SEQ ID NO 4669; SEQ ID NO 4758; SEQ ID NO 4892; SEQ ID NO 5032; SEQ ID NO 5099; SEQ ID NO 5411 |
| TLE4 | SEQ ID NO 5539 | SEQ ID NO 4595; SEQ ID NO 4616; SEQ ID NO 4635; SEQ ID NO 4729; SEQ ID NO 4733; SEQ ID NO 4889; SEQ ID NO 5122 |
| TMEM16A | SEQ ID NO 5578 | SEQ ID NO 4708 |
| TMPRSS2 | SEQ ID NO 5528 | SEQ ID NO 5231; SEQ ID NO 5247; SEQ ID NO 5296 |
| TOP2A | SEQ ID NO 5455 | SEQ ID NO 4686; SEQ ID NO 5153 |
| TP63 | SEQ ID NO 5499 | SEQ ID NO 4588; SEQ ID NO 4590; SEQ ID NO 4653; SEQ ID NO 4828; SEQ ID NO 5043 |
| TPM1 | SEQ ID NO 5449 | SEQ ID NO 5319 |
| TPM2 | SEQ ID NO 5676 | SEQ ID NO 4581; SEQ ID NO 4638; SEQ ID NO 4789; SEQ ID NO 4800; SEQ ID NO 4983; SEQ ID NO 5366 |
| TPM3 | SEQ ID NO 5649 | SEQ ID NO 4634; SEQ ID NO 4741; SEQ ID NO 4769; SEQ ID NO 4771; SEQ ID NO 4799; SEQ ID NO 4800; SEQ ID NO 4803; SEQ ID NO 4875; SEQ ID NO 4985; SEQ ID NO 4987; SEQ ID NO 5264; SEQ ID NO 5265; SEQ ID NO 5274; SEQ ID NO 5299; SEQ ID NO 5308; SEQ ID NO 5315 |
| TPX2 | SEQ ID NO 5543 | SEQ ID NO 4596; SEQ ID NO 5129 |
| TRIM2 | SEQ ID NO 5563 | SEQ ID NO 5119 |
| TRIM29 | SEQ ID NO 5681 | SEQ ID NO 4847; SEQ ID NO 4848; SEQ ID NO 5333; SEQ ID NO 5357; SEQ ID NO 5392 |
| TSHZ2 | SEQ ID NO 5652 | SEQ ID NO 4962 |
| UBAP2L | SEQ ID NO 5558 | SEQ ID NO 5072 |
| UBE2C | SEQ ID NO 5658 | SEQ ID NO 5077; SEQ ID NO 5172; SEQ ID NO 5173; SEQ ID NO 5403; SEQ ID NO 5404 |
| UBE2T | SEQ ID NO 5553 | SEQ ID NO 4660; SEQ ID NO 5041 |
| UTRN | SEQ ID NO 5540 | SEQ ID NO 5091 |
| VIM | SEQ ID NO 5495 | SEQ ID NO 4643 |
| WIF1 | SEQ ID NO 5645 | SEQ ID NO 5142; SEQ ID NO 5397; SEQ ID NO 5415 |
| YWHAZ | SEQ ID NO 5496 | SEQ ID NO 4749 |
| ZDHHC2 | SEQ ID NO 5569 | SEQ ID NO 4768; SEQ ID NO 5106; SEQ ID NO 5260 |
| ZNF462 | SEQ ID NO 5595 | SEQ ID NO 4851 |
| ZNF521 | SEQ ID NO 5565 | SEQ ID NO 4723; SEQ ID NO 5195; SEQ ID NO 5196; SEQ ID NO 5219; SEQ ID NO 5321; SEQ ID NO 5359 |

In another particular embodiment, the invention relates to the use as defined above, for the determination of the variation of expression of 275 determined genes represented by SEQ ID NO 5419 to SEQ ID NO 5693, and of at least one of their variants when they exist, wherein the correspondence between genes and their variants is indicated in the following table 6.

Table 6 summarizes the correspondence between all the sequences disclosed in the invention. In this table:
    SEQ ID NOs 1-2938 represent polynucleotide probes, and targets, variants and genes they can recognize,
    SEQ ID NOs 2939-4578 represent target regions, and variant and genes containing them, and polynucleotide probes recognizing them,
    SEQ ID NOs 4579-5418 and SEQ ID NO 5694 represent variants and their corresponding gene, and target they comprises, and also polynucleotide probes recognizing them,
    SEQ ID NOs 5419-5493 represent genes.

In another preferred embodiment, the invention relates to the use of a multiplicity of polynucleotide probe sets for determining the variation of the gene expression as defined above, and of its variants when present, wherein target regions are characterized by the polynucleotide sequences SEQ ID NO 2939 to 4578, each target region of each gene, and of each variant when they exist, being represented in Table 6.

For example, in the invention, for detecting the variation of expression of the group of at least 12 determined genes of the group of 275 genes, each of the 12 genes has the following target region:
    AK5 (SEQ ID NO 5654) contains the following target regions: SEQ ID NO 2979 and 2988
    COL17A1 (SEQ ID NO 5683) contains the following target regions: SEQ ID NO 2944; 2955; 2971; 2973 and 2974,
    DMD (SEQ ID NO 5421) contains the following target regions: SEQ ID NO 2939; 2940; 2941; 2942; 2943; 2945; 2947; 2949; 2950; 2952; 2953; 2957; 2961; 2962; 2963; 2964; 2970 and 2980,
    KIT (SEQ ID NO 5423) contains the following target regions: SEQ ID NO 2984; 2946; 2951; 2954; 2958; 2960; 2965; 2969; 2975 and 2978
    KRT16 (SEQ ID NO 5525) contains the following target regions: SEQ ID NO 2966 and 2972,
    KRT14 (SEQ ID NO 5434) contains the following target regions: SEQ ID NO 2946; 2951; 2954; 2958; 2960; 2965; 2969; 2975 and 2978,
    KRT5 (SEQ ID NO 5432) contains the following target regions: SEQ ID NO 2985,
    MYH11 (SEQ ID NO 5599) contains the following target regions: SEQ ID NO 2948; 2956; 2959; 2967; 2976; 2981; 2982 and 2986,
    NRG1 (SEQ ID NO 5552) contains the following target regions: SEQ ID NO 2977,
    PTN (SEQ ID NO 5486) contains the following target regions: SEQ ID NO 2983,
    SFRP1 (SEQ ID NO 5491) contains the following target regions: SEQ ID NO 2968, and
    TSHZ2 (SEQ ID NO 5652) contains the following target regions: SEQ ID NO 2987.

With Table 6, knowing gene and variants, it is easy to identify the sequence of the corresponding target region.

In another particular embodiments, the invention discloses the use of a multiplicity of polynucleotide probe sets for determining the variation of the gene expression as defined above, and/or of their variants when present, wherein each polynucleotide probe contained in a polynucleotide probe set is represented by the nucleic acid sequence of the library consisting in SEQ ID NO 1 to SEQ ID NO 2938, the correspondence between each polynucleotide probe and its corresponding target region, said target region corresponding to a gene and its variants when present, being represented in Table 6.

For example, in the invention, for detecting the variation of expression of the group of at least 12 determined genes of the group of 275 genes, each of the 12 genes is recognized by the following polynucleotide probes:

AK5 (SEQ ID NO 5654) is recognized by the polynucleotide probes SEQ ID NO 790; 791; 792; 793; 794 and 795, COL17A1 (SEQ ID NO 5683) is recognized by the polynucleotide probes SEQ ID NO 157; 158; 159; 167; 168; 169; 171; 172; 173 and 177, DMD (SEQ ID NO 5421) is recognized by the polynucleotide probes SEQ ID NO 312; 313; 314; 315; 316; 317; 324; 325; 326; 327; 328; 329; 330; 331; 333; 334; 335; 336; 339; 340; 341; 345; 346; 347; 348; 353; 360; 361; 364; 365; 366; 367; 368; 369; 370; 374 and 375, KIT (SEQ ID NO 5423) is recognized by the polynucleotide probes SEQ ID NO 1081; 1082 and 1083, KRT14 (SEQ ID NO 5434) is recognized by the polynucleotide probes SEQ ID NO 1165; 1158; 1159; 1160; 1161; 1162; 1166; 1167; 1168; 1169; 1170; 1171; 1185; 1186; 1194; 1198; 1199; 1200 and 1203, KRT16 (SEQ ID NO 5525) is recognized by the polynucleotide probes SEQ ID NO 1262; 1263; 1264; 1267; 1268 and 1269, KRT5 (SEQ ID NO 5432) is recognized by the polynucleotide probes SEQ ID NO 1129; 1140 and 1141, MYH11 (SEQ ID NO 5599) is recognized by the polynucleotide probes SEQ ID NO 1522; 1519; 1520; 1521; 1523; 1524; 1534; 1535; 1536; 1544; 1545; 1546; 1551; 1552; 1553; 1554; 1555; 1556 and 1557, NRG1 (SEQ ID NO 5552) is recognized by the polynucleotide probes SEQ ID NO 969; 972 and 981, PTN (SEQ ID NO 5486) is recognized by the polynucleotide probes SEQ ID NO 2026; 2027 and 2028, SFRP1 (SEQ ID NO 5491) is recognized by the polynucleotide probes SEQ ID NO 2179; 2180 and 2181, and TSHZ2 (SEQ ID NO 5652) is recognized by the polynucleotide probes SEQ ID NO 136; 137 and 138.

To summarize, for the same example of at least 12 determined genes of the group of 275 genes, the correspondences are the following ones:

NRG1 (SEQ ID NO 5552) and one of its variants (SEQ ID 5084) both contain the target region SEQ ID 2977, said target region being recognized by polynucleotide probes SEQ ID NO 969, 972 and 981, PTN (SEQ ID NO 5486) and one of its variants (SEQ ID 4666) both contain the target region SEQ ID 2983, said target region being recognized by polynucleotide probes SEQ ID NO 2026, 2027 and 2028, SFRP1 (SEQ ID NO 5491) and one of its variants (SEQ ID 5161) both contain the target region SEQ ID 2968, said target region being recognized by polynucleotide probes SEQ ID NO 2179, 2180 and 2181, TSHZ2 (SEQ ID NO 5652) and one of its variants (SEQ ID 4962) both contain the target region SEQ ID 2987, said target region being recognized by polynucleotide probes SEQ ID NO 136, 137 and 138, KIT (SEQ ID NO 5423) and one of its variants (SEQ ID 5107) both contain the target region SEQ ID 2984, said target region being recognized by polynucleotide probes SEQ ID NO 1081, 1082 and 1083, KRT16 (SEQ ID NO 5525) and two of its variants (SEQ ID 4826 and 4881) are such as KRT5 and SEQ ID 4826 both contain the target region SEQ ID 2972, said target region being recognized by polynucleotide probes SEQ ID NO 1267, 1268 and 1269, and KRT5 and SEQ ID 4881 both contain the target region SEQ ID 2966, said target region being recognized by polynucleotide probes SEQ ID NO 1262, 1263 and 1264, KRT5 (SEQ ID NO 5432) and one of its variants (SEQ ID 5279) both contain the target region SEQ ID 2985, said target region being recognized by polynucleotide probes SEQ ID NO 1129, 1140 and 1141, KRT14 (SEQ ID NO 5434) and six of its variants (SEQ ID 4819, 4825, 4845, 4877, 4891 and 4969) are such as:

KRT14 and SEQ ID 4819 both contain the target regions SEQ ID 2954, 2960 and 2969, said target regions being recognized respectively by polynucleotide probes SEQ ID NO 116 and 1166, SEQ ID NO 1158 and SEQ ID NO 1159, 1160 and 1161

KRT14 and SEQ ID 4825 both contain the target regions SEQ ID 2975 and 2978, said target regions being recognized respectively by polynucleotide probes SEQ ID NO 1167, 1168 and 1169 and SEQ ID NO 1162, 1170 and 1171, KRT14 and SEQ ID 4845 both contain the target region SEQ ID 2965, said target region being recognized by polynucleotide probes SEQ ID NO 1203, KRT14 and SEQ ID 4877 both contain the target region SEQ ID 2946, said target region being recognized by polynucleotide probes SEQ ID NO 1198, 1199 and 1200, KRT14 and SEQ ID 4891 both contain the target region SEQ ID 2958, said target region being recognized by polynucleotide probes SEQ ID NO 1185, 1186 and 1194, and KRT14 and SEQ ID 4969 both contain the target region SEQ ID 2951, said target region being recognized by polynucleotide probes SEQ ID NO 1185, 1186 and 1194, MYH11 (SEQ ID NO 5599) and four of its variants (SEQ ID 4697, 4870, 5361 and 5365) are such as:

MYH11 and SEQ ID 4697 both contain the target regions SEQ ID NO 2948 and 2986, said target regions being recognized respectively by polynucleotide probes SEQ ID NO 1522; 1523 and 1524, and SEQ ID NO 1519; 1520 and 1521

MYH11 and SEQ ID 4870 both contain the target regions SEQ ID NO 2956, 2959, 2981 and 2982, said target regions being recognized respectively by polynucleotide probes SEQ ID 1551, 1552 and 1553, SEQ ID NO 1523, 1524 and 1557, SEQ ID NO 1551, 1552 and 1553 and SEQ ID NO 1554, 1555 and 1556, MYH11 and SEQ ID 5361 both contain the target region SEQ ID 2967, said target region being recognized by polynucleotide probes SEQ ID NO 1534, 1535 and 1536, MYH11 and SEQ ID 5365 both contain the target region SEQ ID 2976, said target region being recognized by polynucleotide probes SEQ ID NO 1544, 1545 and 1546, AK5 (SEQ ID NO 5654) and one of its variants (SEQ ID 4654) both contain the target regions SEQ ID 2979 and 2988, said target regions being respectively recognized by polynucleotide probes SEQ ID NO 790, 791 and 792, and SEQ ID NO 793, 794 and 795, COL17A1 (SEQ ID NO 5599) and four of its variants (SEQ ID 4739, 4784, 5242 and 5384) are such as:

COL17A1 and SEQ ID 4739 both contain the target regions SEQ ID NO 2944 and 2955, said target regions being recognized respectively by polynucleotide probes SEQ ID NO 171; 172 and 173, and SEQ ID NO 177, COL17A1 and SEQ ID 4784 both contain the target region SEQ ID NO 2973, said target region being recognized by polynucleotide probes SEQ ID NO 167, 168 and 169, COL17A1 and SEQ ID 5242 both contain the target region SEQ ID 2974, said target region being recognized by polynucleotide probes SEQ ID NO 167, 168 and 177, COL17A1 and SEQ ID 5384 both contain the target region SEQ ID 2971, said target region being recognized by polynucleotide probes SEQ ID NO 157, 158 and 159, DMD (SEQ ID NO 5421) and seven of its variants (SEQ ID NO 4664, 4860, 5058, 5095, 5150, 5381 and 5410) are such as:

DMD and SEQ ID 4664 both contain the target regions SEQ ID NO 294 and 2947, said target regions being recognized respectively by polynucleotide probes SEQ ID NO 312, 313 and 314, and SEQ ID NO 315, 316 and 317

DMD and SEQ ID 4860 both contain the target region SEQ ID 2940, said target region being recognized by polynucleotide probes SEQ ID NO 364, 365 and 366, DMD and SEQ ID 5058 both contain the target region SEQ ID 2950, said target region being recognized by polynucleotide probes SEQ ID NO 353, 360 and 361, DMD and SEQ ID 5095 both contain the target regions SEQ ID 2939, 2942, 2945, 2949, 2953, 2961, 2963, 2964 and 2970, said target region being respectively recognized by polynucleotide probes
SEQ ID NO 333, 334 and 335,
SEQ ID NO 312, 313 and 348,
SEQ ID NO 315, 331 and 336,
SEQ ID NO 339, 340 and 341,
SEQ ID NO 324, 325 and 326,
SEQ ID NO 345, 346 and 347,
SEQ ID NO 315, 330 and 331,
SEQ ID NO 327, 328 and 329, and
SEQ ID NO 327, 328 and 329, DMD and SEQ ID 5150 both contain the target region SEQ ID 2980, said target region being recognized by polynucleotide probes SEQ ID NO 368, 374 and 375, DMD and SEQ ID 5381 both contain the target regions SEQ ID 2941, 2952 and 2962, said target regions being respectively recognized by polynucleotide probes SEQ ID NO 364, 365 and 366, SEQ ID NO 315, 316 and 370, and SEQ ID NO 367, 368 and 369, DMD and SEQ ID 5410 both contain the target region SEQ ID 2957, said target region being recognized by polynucleotide probes SEQ ID NO 315, 316 and 370.

Using Table 6, and knowing genes and variants, it is easy to identify the sequence of the corresponding target region and probes.

The invention also relates to the use of a multiplicity of at least 50 polynucleotide probe sets chosen among 1640 polynucleotide probe sets, the nucleic acid sequences of the polynucleotide probes contained in said 50 polynucleotide probe sets being the following nucleic acid sequences: SEQ ID NOs 136; 137; 138; 157; 158; 159; 167; 168; 169; 171; 172; 173; 177; 312; 313; 313; 314; 315; 316; 317; 324; 325; 326; 327; 328; 329; 330; 331; 333; 334; 335; 336; 339; 340; 341; 345; 346; 347; 348; 353; 360; 361; 364; 365; 366; 367; 368; 369; 370; 374; 375; 790; 791; 792; 793; 794; 795; 969; 972; 981; 1081; 1082; 1083; 1129; 1140; 1141; 1158; 1159; 1160; 1161; 1162; 1165; 1166; 1167; 1168; 1169; 1170; 1171; 1185; 1186; 1194; 1198; 1199; 1200; 1203; 1262; 1263; 1264; 1267; 1268; 1269; 1519; 1520; 1521; 1522; 1523; 1524; 1534; 1535; 1536; 1544; 1545; 1546; 1551; 1552; 1553; 1554; 1555; 1556; 1557; 2026; 2027; 2028; 2179; 2180 and 2181, each polynucleotide probe set containing from 1 to 4 of said polynucleotide probes, for the determination of the variation of expression of:
at least 12 determined genes belonging to a group of genes represented by the nucleotidic sequences SEQ ID NO: 5419 to SEQ ID NO: 5693 and
at least one variant of said genes of at least 12 determined genes, when they exist,
said 12 determined genes being represented by the following nucleotidic sequences:
SEQ ID NOs 5421; 5423; 5432; 5434; 5486; 5491; 5525; 5552; 5599; 5652; 5654 and 5683 and the corresponding variants being represented in table 1A in order to diagnose in vitro or ex vivo the benign or malignant state of a breast tumor.

In one preferred embodiment, the invention relates to the use as defined above, wherein the polynucleotide probes contained in said at least 50 polynucleotide probe sets are as mentioned above and wherein SEQ ID NOs 167; 168; 177; 312; 313; 327; 328; 329; 331; 364; 365; 366; 368; 370; 1185; 1186; 1194; 1523; 1524; 1551; 1552 and 1553 are present twice, SEQ ID NO 316 is present in three copies and SEQ ID NO 315 is present in 5 copies.

Thus, in all the 50 polynucleotide probe sets mentioned above, 143 polynucleotide probes are present, the above mentioned polynucleotide probes being present at least once, and in particular SEQ ID NOs 167; 168; 177; 312; 313; 327; 328; 329; 331; 364; 365; 366; 368; 370; 1185; 1186; 1194; 1523; 1524; 1551; 1552 and 1553 are present twice, SEQ ID NO 316 is present in three copies and SEQ ID NO 315 is present in 5 copies.

The above mentioned polynucleotide probes contained in the 50 nucleotides probe sets specifically recognized the above mentioned gene and their variant when present via target region, the correspondence being deduced from Table 6.

In one preferred embodiment, the invention relates to the use of a multiplicity of at least 100 polynucleotide probe sets as defined above, the nucleic acid sequence of the polynucleotides probes contained in said 100 polynucleotide probe sets being the following nucleic acid sequences: SEQ ID NO 120; 136; 137; 138; 154; 155; 156; 157; 158; 159; 167; 168; 169; 171; 172; 173; 174; 175; 176; 177; 312; 313; 314; 315; 316; 316; 317; 324; 325; 326; 327; 328; 329; 330; 331; 332; 333; 334; 335; 336; 337; 338; 339; 340; 341; 345; 346; 347; 348; 349; 350; 351; 352; 353; 354; 355; 356; 360; 361; 363; 364; 365; 366; 367; 368; 369; 370; 371; 374; 375; 376; 378; 379; 380; 381; 555; 556; 557; 558; 560; 561; 562; 566; 567; 788; 789; 790; 791; 792; 793; 794; 795; 800; 801; 802; 821; 822; 823; 969; 971; 972; 981; 1056; 1057; 1058; 1075; 1076; 1077; 1081; 1082; 1083; 1087; 1088; 1089; 1103; 1104; 1105; 1114; 1115; 1116; 1123; 1124; 1125; 1129; 1130; 1131; 1140; 1141; 1158; 1159; 1160; 1161; 1162; 1163; 1164; 1165; 1166; 1167; 1168; 1169; 1170; 1171; 1172; 1180; 1181; 1185; 1186; 1187; 1188; 1189; 1190; 1191; 1192; 1193; 1194; 1195; 1196; 1198; 1199; 1200; 1201; 1202; 1203; 1207; 1262; 1263; 1264; 1267; 1268; 1269; 1509; 1510; 1511; 1519; 1520; 1521; 1522; 1523; 1524; 1528; 1529; 1534; 1535; 1536; 1544; 1545; 1546; 1551;

1552; 1553; 1554; 1555; 1556; 1557; 1561; 1562; 1682; 1683; 1684; 1776; 1777; 1778; 2023; 2024; 2025; 2026; 2027; 2028; 2173; 2174; 2175; 2176; 2177; 2178; 2179; 2180; 2181; 2762; 2763; 2764; 2860; 2861; 2862; 2883; 2884 and 2885, each polynucleotide probe set containing from 1 to 4 of said polynucleotide probes, for the determination of the variation of expression of
  at least 20 determined genes belonging to a group of determined genes represented by the nucleotidic sequences SEQ ID NO: 5419 to SEQ ID NO: 5693 and
  at least one variant of said genes at least 20 determined genes, when they exist,
  said 20 determined genes being represented by the following nucleotidic sequences:
    SEQ ID Nos 5421; 5423; 5432; 5434; 5457; 5486; 5491; 5513; 5516; 5525; 5532; 5552; 5599; 5616; 5624; 5643; 5652; 5654; 5673 and 5683 and the corresponding variants being represented in table 1B
in order to diagnose in vitro or ex vivo the benign or malignant state of a breast tumor.

In one preferred embodiment, the invention relates to the use as defined above, wherein the polynucleotide probes contained in said at least 100 polynucleotide probe sets are as mentioned above and wherein SEQ ID NOs 167; 168; 177; 312; 313; 316; 317; 327; 329; 330; 353; 361; 364; 365; 366; 367; 368; 369; 370; 821; 822; 823; 1129; 1164; 1185; 1186; 1187; 1188; 1189; 1203; 1523; 1551; 1552 and 1553 are present twice, SEQ ID NOs 328; 331; 1162; 1194; 1519; 1520; 1521 and 1524 are present in three copies and SEQ ID NO 315 is present in 6 copies.

Thus, in all the 100 polynucleotide probe sets mentioned above, 282 polynucleotide probes are present, the above mentioned polynucleotide probes being present at least once, and in particular SEQ ID NOs 167; 168; 177; 312; 313; 316; 317; 327; 329; 330; 353; 361; 364; 365; 366; 367; 368; 369; 370; 821; 822; 823; 1129; 1164; 1185; 1186; 1187; 1188; 1189; 1203; 1523; 1551; 1552 and 1553 are present twice, SEQ ID NOs 328; 331; 1162; 1194; 1519; 1520; 1521 and 1524 are present in three copies and SEQ ID NO 315 is present in 6 copies.

The above mentioned polynucleotide probes contained in the 100 nucleotides probe sets specifically recognized the above mentioned gene and their variant when present via target region, the correspondence being deduced from Table 6.

In another preferred embodiment, the invention relates to the use of a multiplicity of at least 150 polynucleotide probe sets as previously defined, the nucleic acid sequence of the polynucleotides probes contained in said 150 polynucleotide probe sets being the following nucleic acid sequences: SEQ ID NOs 4; 5; 6; 120; 136; 137; 138; 154; 155; 156; 157; 158; 159; 167; 168; 169; 171; 172; 173; 174; 175; 176; 177; 197; 248; 254; 255; 305; 306; 307; 312; 313; 314; 315; 316; 317; 324; 325; 326; 327; 328; 329; 330; 331; 332; 333; 334; 335; 336; 337; 338; 339; 340; 341; 345; 346; 347; 348; 349; 350; 351; 352; 353; 354; 355; 356; 360; 361; 362; 363; 364; 365; 366; 367; 367; 368; 369; 370; 371; 374; 375; 376; 377; 378; 379; 380; 381; 513; 514; 515; 552; 553; 554; 555; 556; 557; 558; 559; 560; 561; 562; 566; 567; 783; 784; 785; 788; 789; 790; 791; 792; 793; 794; 795; 796; 797; 798; 799; 800; 801; 802; 803; 804; 805; 806; 807; 808; 812; 813; 814; 818; 821; 822; 823; 968; 969; 970; 971; 972; 981; 1056; 1057; 1058; 1061; 1062; 1063; 1064; 1065; 1066; 1067; 1068; 1069; 1070; 1071; 1075; 1076; 1077; 1080; 1081; 1082; 1083; 1087; 1088; 1089; 1103; 1104; 1105; 1114; 1115; 1116; 1123; 1124; 1125; 1129; 1130; 1131; 1139; 1140; 1141; 1158; 1159; 1160; 1161; 1162; 1163; 1164; 1165; 1166; 1167; 1168; 1169; 1170; 1171; 1172; 1174; 1175; 1176; 1180; 1181; 1185; 1186; 1187; 1188; 1189; 1190; 1191; 1192; 1193; 1194; 1195; 1196; 1197; 1198; 1199; 1200; 1201; 1202; 1203; 1204; 1205; 1206; 1207; 1262; 1263; 1264; 1267; 1268; 1269; 1284; 1285; 1315; 1469; 1470; 1471; 1509; 1510; 1511; 1515; 1516; 1517; 1519; 1520; 1521; 1522; 1523; 1524; 1528; 1529; 1534; 1535; 1536; 1537; 1538; 1539; 1544; 1545; 1546; 1550; 1551; 1552; 1553; 1554; 1555; 1556; 1557; 1558; 1559; 1560; 1561; 1562; 1580; 1581; 1582; 1671; 1682; 1683; 1684; 1685; 1686; 1690; 1691; 1692; 1776; 1777; 1778; 1788; 1789; 1790; 1890; 1891; 1892; 1952; 1953; 1954; 1963; 2023; 2024; 2025; 2026; 2027; 2028; 2065; 2067; 2088; 2089; 2090; 2091; 2173; 2174; 2175; 2176; 2177; 2178; 2179; 2180; 2181; 2196; 2201; 2229; 2230; 2231; 2536; 2537; 2538; 2576; 2577; 2578; 2599; 2600; 2762; 2763; 2764; 2774; 2775; 2776; 2860; 2861; 2862; 2883; 2884 and 2885, each polynucleotide probe set containing from 1 to 4 of said polynucleotide probes, for the determination of the variation of expression of
  at least 35 determined genes belonging to a group of determined genes represented by the nucleotidic sequences SEQ ID NO: 5419 to SEQ ID NO: 5693 and
  at least one variant of said genes at least 35 determined genes, when they exist,
  said 35 determined genes being represented by the following nucleotidic sequences:
    SEQ ID Nos 5421; 5423; 5431; 5432; 5434; 5440; 5457; 5462; 5470; 5486; 5491; 5505; 5513; 5516; 5525; 5532; 5546; 5552; 5594; 5599; 5601; 5603; 5616; 5618; 5624; 5627; 5630; 5643; 5645; 5652; 5654; 5660; 5669; 5673 and 5683, and the corresponding variants being represented in table 1C
in order to diagnose in vitro or ex vivo the benign or malignant state of a breast tumor.

In one preferred embodiment, the invention relates to the use as defined above, wherein the polynucleotide probes contained in said at least 150 polynucleotide probe sets are as mentioned above and wherein SEQ ID NOs 167; 168; 177; 312; 313; 317; 327; 329; 330; 353; 361; 363; 364; 365; 366; 369; 370; 371; 558; 567; 796; 797; 801; 806; 807; 808; 813; 814; 821; 822; 823; 969; 1056; 1057; 1058; 1129; 1141; 1163; 1164; 1185; 1186; 1187; 1188; 1189; 1199; 1203; 1469; 1470; 1471; 1523; 1551; 1552 and 1553 are present twice, SEQ ID NOs 316; 328; 331; 368; 788; 1194; 1519; 1520; 1521; 1524 are present in three copies, SEQ ID NO 1162 is present in 4 copies and SEQ ID NO 315 is present in 6 copies.

Thus, in all the 150 polynucleotide probe sets mentioned above, 422 polynucleotide probes are present, the above mentioned polynucleotide probes being present at least once, and in particular SEQ ID NOs 167; 168; 177; 312; 313; 317; 327; 329; 330; 353; 361; 363; 364; 365; 366; 369; 370; 371; 558; 567; 796; 797; 801; 806; 807; 808; 813; 814; 821; 822; 823; 969; 1056; 1057; 1058; 1129; 1141; 1163; 1164; 1185; 1186; 1187; 1188; 1189; 1199; 1203; 1469; 1470; 1471; 1523; 1551; 1552 and 1553 are present twice, SEQ ID NOs 316; 328; 331; 368; 788; 1194; 1519; 1520; 1521; 1524 are present in three copies, SEQ ID NO 1162 is present in 4 copies and SEQ ID NO 315 is present in 6 copies.

The above mentioned polynucleotide probes contained in the 150 nucleotides probe sets specifically recognized the above mentioned gene and their variant when present via target region, the correspondence being deduced from Table 6.

A preferred embodiment of the invention relates to the use of a multiplicity of at least 200 polynucleotide probe sets as defined above, the nucleic acid sequence of the polynucleotide probes contained in said 200 polynucleotide probe sets being the following nucleic acid sequences: SEQ ID NOs 4; 5; 6; 120; 121; 122; 123; 130; 131; 132; 136; 137; 138; 154; 155; 156; 157; 158; 159; 167; 168; 169; 171; 172; 173; 174; 175; 176; 177; 195; 196; 197; 198; 199; 200; 248; 254; 255; 305; 306; 307; 312; 313; 314; 315; 316; 317; 324; 325; 326; 327; 328; 329; 330; 331; 332; 333; 334; 335; 336; 337; 338; 339; 340; 341; 345; 346; 347; 348; 349; 350; 351; 352; 353; 354; 355; 356; 360; 361; 362; 363; 364; 365; 366; 367; 368; 369; 370; 371; 374; 375; 376; 377; 378; 379; 380; 381; 513; 514; 515; 552; 553; 554; 555; 556; 557; 558; 559; 560; 561; 562; 563; 564; 565; 566; 567; 783; 784; 785; 788; 789; 790; 791; 792; 793; 794; 795; 796; 797; 798; 799; 800; 801; 802; 803; 804; 805; 806; 807; 808; 809; 810; 811; 812; 813; 814; 815; 816; 817; 818; 821; 822; 823; 824; 825; 826; 840; 841; 845; 846; 847; 868; 968; 969; 970; 971; 972; 973; 974; 975; 976; 977; 981; 1056; 1057; 1058; 1059; 1060; 1061; 1062; 1063; 1064; 1065; 1066; 1067; 1068; 1069; 1070; 1071; 1075; 1076; 1077; 1080; 1081; 1082; 1083; 1084; 1085; 1086; 1087; 1088; 1089; 1094; 1095; 1096; 1103; 1104; 1105; 1110; 1111; 1112; 1114; 1115; 1116; 1123; 1124; 1125; 1126; 1127; 1128; 1129; 1130; 1131; 1139; 1140; 1141; 1158; 1159; 1160; 1161; 1162; 1163; 1164; 1165; 1166; 1167; 1168; 1169; 1170; 1171; 1172; 1174; 1175; 1176; 1180; 1181; 1185; 1186; 1187; 1188; 1189; 1190; 1191; 1192; 1193; 1194; 1195; 1196; 1197; 1198; 1199; 1200; 1201; 1202; 1203; 1204; 1205; 1206; 1207; 1229; 1230; 1242; 1243; 1244; 1245; 1250; 1251; 1252; 1262; 1263; 1264; 1265; 1266; 1267; 1268; 1269; 1270; 1271; 1272; 1284; 1285; 1315; 1335; 1407; 1408; 1469; 1470; 1471; 1509; 1510; 1511; 1512; 1513; 1514; 1515; 1516; 1517; 1519; 1520; 1521; 1522; 1523; 1524; 1528; 1529; 1534; 1535; 1536; 1537; 1538; 1539; 1544; 1545; 1546; 1550; 1551; 1552; 1553; 1554; 1555; 1556; 1557; 1558; 1559; 1560; 1561; 1562; 1563; 1564; 1580; 1581; 1582; 1586; 1587; 1588; 1671; 1682; 1683; 1684; 1685; 1686; 1687; 1688; 1689; 1690; 1691; 1692; 1743; 1744; 1745; 1776; 1777; 1778; 1788; 1789; 1790; 1890; 1891; 1892; 1896; 1897; 1898; 1952; 1953; 1954; 1963; 1974; 2023; 2024; 2025; 2026; 2027; 2028; 2061; 2062; 2063; 2065; 2067; 2068; 2072; 2083; 2084; 2085; 2088; 2089; 2090; 2091; 2092; 2173; 2174; 2175; 2176; 2177; 2178; 2179; 2180; 2181; 2196; 2201; 2229; 2230; 2231; 2381; 2382; 2383; 2536; 2537; 2538; 2576; 2577; 2578; 2599; 2600; 2601; 2602; 2603; 2762; 2763; 2764; 2774; 2775; 2776; 2778; 2779; 2783; 2794; 2860; 2861; 2862; 2883; 2884 and 2885,
for the determination of the variation of expression of
    at least 43 determined genes belonging to a group of determined genes represented by the nucleotidic sequences SEQ ID NO: 5419 to SEQ ID NO: 5693 and
    at least one variant of said determined genes at least 43 genes, when they exist,
    said 43 determined genes being represented by the following nucleotidic sequences:
    SEQ ID Nos 5421; 5423; 5431; 5432; 5434; 5440; 5455; 5457; 5462; 5470; 5475; 5486; 5491; 5499; 5505; 5513; 5516; 5520; 5525; 5532; 5546; 5549; 5552; 5594; 5599; 5601; 5603; 5616; 5618; 5623; 5624; 5627; 5630; 5643; 5645; 5651; 5652; 5654; 5660; 5669; 5673; 5683 and 5686, and the corresponding variants being represented in table 1D,
in order to diagnose in vitro or ex vivo the benign or malignant state of a breast tumor.

In one preferred embodiment, the invention relates to the use as defined above, wherein the polynucleotide probes contained in said at least 200 polynucleotide probe sets are as mentioned above and wherein SEQ ID NOs 167; 168; 177; 312; 313; 317; 327; 329; 330; 353; 361; 363; 364; 365; 366; 367; 369; 370; 371; 558; 567; 796; 797; 801; 806; 807; 808; 813; 814; 821; 822; 823; 845; 968; 970; 972; 1056; 1057; 1058; 1085; 1114; 1115; 1116; 1123; 1124; 1125; 1129; 1141; 1163; 1164; 1185; 1186; 1187; 1188; 1189; 1199; 1203; 1523; 1551; 1552; 1553; 1557; 1586; 1587; 1588; 1952; 1953; 1954; 2088; 2090; 2091; 2762; 2763 and 2764 are present twice, SEQ ID NOs 316; 328; 331; 368; 788; 1284; 1285; 1469; 1470; 1471; 1519; 1520; 1521; 1524; 2065; 2067 and 2089 are present in three copies, SEQ ID NO 1194 is present in 4 copies and SEQ ID NOs 315 and 1162 are present in 6 copies.

Thus, in all the 200 polynucleotide probe sets mentioned above, 565 polynucleotide probes are present, the above mentioned polynucleotide probes being present at least once, and in particular SEQ ID NOs 167; 168; 177; 312; 313; 317; 327; 329; 330; 353; 361; 363; 364; 365; 366; 367; 369; 370; 371; 558; 567; 796; 797; 801; 806; 807; 808; 813; 814; 821; 822; 823; 845; 968; 970; 972; 1056; 1057; 1058; 1085; 1114; 1115; 1116; 1123; 1124; 1125; 1129; 1141; 1163; 1164; 1185; 1186; 1187; 1188; 1189; 1199; 1203; 1523; 1551; 1552; 1553; 1557; 1586; 1587; 1588; 1952; 1953; 1954; 2088; 2090; 2091; 2762; 2763 and 2764 are present twice, SEQ ID NOs 316; 328; 331; 368; 788; 1284; 1285; 1469; 1470; 1471; 1519; 1520; 1521; 1524; 2065; 2067 and 2089 are present in three copies, SEQ ID NO 1194 is present in 4 copies and SEQ ID NOs 315 and 1162 are present in 6 copies.

The above mentioned polynucleotide probes contained in the 200 nucleotides probe sets specifically recognized the above mentioned gene and their variant when present via target region, the correspondence being deduced from Table 6.

The multiplicities mentioned above are considered as the "Top Polynucleotide Probe Sets".

In another preferred embodiment, the invention relates to the use of a multiplicity of at least 1228 polynucleotide probe sets as defined above, containing 3985 polynucleotide probes, the nucleic acid sequence of the polynucleotide probes contained in said 1228 polynucleotide probe sets being represented in the first 1228 lines of the Table 7, for the determination of the variation of expression of for determining the variation of the expression of
    at least 206 determined genes belonging to a group of determined genes represented by the nucleotidic sequences SEQ ID NO: 5419 to SEQ ID NO: 5693 and
    at least one variant of said genes at least 206 genes, when they exist,
    said 206 genes being represented by the following nucleotidic sequences:
    SEQ ID Nos 5420; 5421; 5422; 5423; 5425; 5426; 5427; 5428; 5429; 5430; 5431; 5432; 5434; 5435; 5436; 5437; 5438; 5439; 5440; 5441; 5442; 5443; 5444; 5445; 5446; 5447; 5449; 5450; 5451; 5452; 5453; 5454; 5455; 5456; 5457; 5459; 5460; 5461; 5462; 5463; 5465; 5467; 5468; 5470; 5473; 5475; 5476; 5479; 5480; 5482; 5484; 5485; 5486; 5487; 5488; 5489; 5490; 5491; 5492; 5493; 5495; 5496; 5497; 5498; 5499; 5502; 5503; 5505; 5506; 5507; 5508; 5509; 5511; 5512; 5513; 5515; 5516; 5517; 5518; 5519; 5520; 5523; 5524; 5525; 5526; 5528; 5529; 5530; 5531; 5532; 5533; 5534; 5536; 5538; 5539; 5540; 5543; 5544; 5545; 5546; 5547; 5549; 5550; 5552; 5553; 5554; 5556; 5558; 5559; 5560; 5562; 5563; 5564; 5565; 5566; 5567; 5568; 5569; 5570; 5571; 5573; 5574; 5575; 5576;

5577; 5578; 5581; 5582; 5585; 5587; 5588; 5590; 5591; 5593; 5594; 5595; 5597; 5598; 5599; 5600; 5601; 5602; 5603; 5604; 5605; 5606; 5608; 5609; 5610; 5611; 5612; 5613; 5615; 5616; 5617; 5618; 5622; 5623; 5624; 5625; 5627; 5629; 5630; 5631; 5632; 5633; 5634; 5635; 5637; 5638; 5639; 5640; 5641; 5642; 5643; 5644; 5645; 5647; 5648; 5649; 5651; 5652; 5653; 5654; 5656; 5657; 5658; 5660; 5661; 5665; 5667; 5669; 5672; 5673; 5675; 5676; 5677; 5678; 5680; 5681; 5683; 5684; 5686; 5687; 5689 and 5692, and the corresponding variants being represented in table 1E, in order to diagnose in vitro or ex vivo the benign or malignant state of a breast tumor.

Thus, in all the 1228 polynucleotide probe sets mentioned above, 3427 polynucleotide probes are present.

Also, a preferred embodiment of the invention discloses the use of a multiplicity of 1640 polynucleotide probe sets as defined above, the nucleic acid sequence of the polynucleotide probes contained in said 1640 polynucleotide probe sets being represented in Table 7, for the determination of the variation of expression of
  275 determined genes represented by the nucleotidic sequences SEQ ID NO: 5419 to SEQ ID NO: 5693 and
  at least one variant of said genes 275 determined genes, when they exist, the correspondence being mentioned in table 6,
  in order to diagnose in vitro or ex vivo the benign or malignant state of a breast tumor.

Thus, in all the 1640 polynucleotide probe sets mentioned above, 4586 polynucleotide probes are present.

In another embodiment, the invention discloses the use of a multiplicity of polynucleotide probe sets, wherein the sub-group of genes is constituted by 12 to 259 genes chosen among the group of genes consisting in SEQ ID NO 5419 to SEQ ID NO 5677.

The sub-groups of genes contain at least 12 genes, as described above. The sub-group of genes can also contain advantageously 19 genes, or advantageously 32 genes, or advantageously 40 genes, or advantageously 214 genes or more advantageously 259 genes.

According to the invention, each gene of the sub-groups of genes, and/or its variants when they exist, are specifically recognized by at least one polynucleotide probe belonging to a polynucleotide probe set of a pool of polynucleotide probe sets.

In a more particular embodiment, the invention relates to the use of a multiplicity of polynucleotide probe sets, wherein the sub-group of genes is constituted by the 259 genes of the group consisting in SEQ ID NO 5419 to SEQ ID NO 5693.

The inventors have unexpectedly demonstrated that a group of 259 genes, and/or their variants when they exist, give some powerful information to precisely determine the benign or malignant status of a breast tumor.

In the group of 259 genes, each gene, and its variants when they exist is specifically recognized by at least one polynucleotide probe belonging to a polynucleotide probe set of a pool of polynucleotide probe sets.

In another advantageous embodiment, the invention discloses the use of a multiplicity of polynucleotide probe sets, wherein the polynucleotide probe sets are chosen among at least 50 polynucleotide probe sets, particularly at least 100 polynucleotide probe sets, more particularly at least 150 polynucleotide probe sets, more particularly at least 200 polynucleotide probe sets, more particularly at least 1228 polynucleotide probe sets, and more particularly 1640 polynucleotide probe sets of the library of nucleic acid sequences consisting in SEQ ID NO 1 to SEQ ID NO 2938.

The multiplicity of polynucleotide probe sets is of at least 50 polynucleotide probe sets, and particularly at least 100 polynucleotide probe sets, more particularly at least 150 polynucleotide probe sets, and more advantageously at least 200 polynucleotide probe sets.

These multiplicities are considered as the "Top Polynucleotide Probe Sets".

The Top 50 polynucleotide probe sets contains a combination of polynucleotide probes characterized by SEQ ID NO 138, SEQ ID NO 140, SEQ ID NO 157, SEQ ID NO 159, SEQ ID NO 167, SEQ ID NO 168, SEQ ID NO 169, SEQ ID NO 171, SEQ ID NO 173, SEQ ID NO 177, SEQ ID NO 312, SEQ ID NO 314, SEQ ID NO 315, SEQ ID NO 317, SEQ ID NO 324, SEQ ID NO 326, SEQ ID NO 327, SEQ ID NO 329, SEQ ID NO 330, SEQ ID NO 331 SEQ ID NO 333, SEQ ID NO 335, SEQ ID NO 336, SEQ ID NO 339, SEQ ID NO 341, SEQ ID NO 345, SEQ ID NO 347, SEQ ID NO 353, SEQ ID NO 360, SEQ ID NO 361, SEQ ID NO 364, SEQ ID NO 366, SEQ ID NO 367, SEQ ID NO 369, SEQ ID NO 790, SEQ ID NO 792, SEQ ID NO 793, SEQ ID NO 795, SEQ ID NO 969, SEQ ID NO 972, SEQ ID NO 981, SEQ ID NO 1081, SEQ ID NO 1083, SEQ ID NO 1129, SEQ ID NO 1140, SEQ ID NO 1141, SEQ ID NO 1151, SEQ ID NO 1158, SEQ ID NO 1159, SEQ ID NO 1162, SEQ ID NO 1165, SEQ ID NO 1166, SEQ ID NO 1167, SEQ ID NO 1169, SEQ ID NO 1170, SEQ ID NO 1171, SEQ ID NO 1185, SEQ ID NO 1186, SEQ ID NO 1194, SEQ ID NO 1198, SEQ ID NO 1200, SEQ ID NO 1203, SEQ ID NO 1262, SEQ ID NO 1264, SEQ ID NO 1267, SEQ ID NO 1269, SEQ ID NO 1520, SEQ ID NO 1522, SEQ ID NO 1523, SEQ ID NO 1524, SEQ ID NO 1534, SEQ ID NO 1536, SEQ ID NO 1544, SEQ ID NO 1546, SEQ ID NO 1551, SEQ ID NO 1553, SEQ ID NO 1554, SEQ ID NO 1556, SEQ ID NO 1557, SEQ ID NO 2026, SEQ ID NO 2028, SEQ ID NO 2179 and SEQ ID NO 2181.

The Top 100 polynucleotide probe set contains a combination of polynucleotide probes characterized by SEQ ID NO 120, SEQ ID NO 138, SEQ ID NO 140, SEQ ID NO 154, SEQ ID NO 155, SEQ ID NO 156, SEQ ID NO 157, SEQ ID NO 159, SEQ ID NO 166, SEQ ID NO 167, SEQ ID NO 168, SEQ ID NO 169, SEQ ID NO 171, SEQ ID NO 173, SEQ ID NO 174, SEQ ID NO 175, SEQ ID NO 176, SEQ ID NO 177, SEQ ID NO 312, SEQ ID NO 314, SEQ ID NO 315, SEQ ID NO 317, SEQ ID NO 324, SEQ ID NO 326, SEQ ID NO 327, SEQ ID NO 328, SEQ ID NO 329, SEQ ID NO 330, SEQ ID NO 331, SEQ ID NO 331, SEQ ID NO 332, SEQ ID NO 333, SEQ ID NO 335, SEQ ID NO 336, SEQ ID NO 337, SEQ ID NO 338, SEQ ID NO 339, SEQ ID NO 341, SEQ ID NO 345, SEQ ID NO 347, SEQ ID NO 349, SEQ ID NO 350, SEQ ID NO 351, SEQ ID NO 352, SEQ ID NO 353, SEQ ID NO 354, SEQ ID NO 355, SEQ ID NO 356, SEQ ID NO 360, SEQ ID NO 361, SEQ ID NO 363, SEQ ID NO 364, SEQ ID NO 364, SEQ ID NO 366, SEQ ID NO 367, SEQ ID NO 369, SEQ ID NO 369, SEQ ID NO 371, SEQ ID NO 376, SEQ ID NO 378, SEQ ID NO 379, SEQ ID NO 380, SEQ ID NO 381, SEQ ID NO 555, SEQ ID NO 556, SEQ ID NO 557, SEQ ID NO 558, SEQ ID NO 560, SEQ ID NO 561, SEQ ID NO 562, SEQ ID NO 566, SEQ ID NO 567, SEQ ID NO 788, SEQ ID NO 789, SEQ ID NO 790, SEQ ID NO 792, SEQ ID NO 793, SEQ ID NO 795, SEQ ID NO 800, SEQ ID NO 801, SEQ ID NO 802, SEQ ID NO 821, SEQ ID NO 822, SEQ ID NO 823, SEQ ID NO 969, SEQ ID NO 971, SEQ ID NO 972, SEQ ID NO 981, SEQ ID NO 1056, SEQ ID NO 1057, SEQ ID NO 1058, SEQ ID NO 1075, SEQ ID NO 1076, SEQ ID NO 1077, SEQ ID NO 1081, SEQ ID NO 1083, SEQ ID NO 1087, SEQ ID NO 1088, SEQ ID NO 1089, SEQ ID NO 1103, SEQ ID NO 1104, SEQ ID NO 1105, SEQ ID NO 1114, SEQ ID NO 1115, SEQ ID NO 1116, SEQ ID NO 1123, SEQ ID NO 1124, SEQ ID NO 1125, SEQ ID NO 1129, SEQ ID NO 1130, SEQ ID NO 1131, SEQ ID NO 1140, SEQ ID NO 1141, SEQ ID NO 1142, SEQ ID NO 1143, SEQ ID NO 1151, SEQ ID NO 1158, SEQ ID NO 1159, SEQ ID NO 1162, SEQ ID NO 1163, SEQ ID NO 1163, SEQ ID NO 1164, SEQ ID NO 1165, SEQ ID NO 1166, SEQ ID NO 1167, SEQ ID NO 1169, SEQ ID NO 1170, SEQ ID NO 1171, SEQ ID NO 1172, SEQ ID NO 1172, SEQ ID NO 1180, SEQ ID NO 1181, SEQ ID NO 1185, SEQ ID NO 1186, SEQ ID NO 1187, SEQ ID NO 1188, SEQ ID NO 1189, SEQ ID NO 1189, SEQ ID NO 1190, SEQ ID NO 1191, SEQ ID NO 1192, SEQ ID NO 1193, SEQ ID NO 1194, SEQ ID NO 1195, SEQ ID NO 1196, SEQ ID NO 1198, SEQ ID NO 1200, SEQ ID NO 1201, SEQ ID NO 1202, SEQ ID NO 1203, SEQ ID NO 1207, SEQ ID NO 1262, SEQ ID NO 1264, SEQ ID NO 1267, SEQ ID NO 1269, SEQ ID NO 1509, SEQ ID NO 1510, SEQ ID NO 1511, SEQ ID NO 1519, SEQ ID NO 1520, SEQ ID NO 1520, SEQ ID NO 1521, SEQ ID NO 1522, SEQ ID NO 1523, SEQ ID NO 1524, SEQ ID NO 1524, SEQ ID NO 1528, SEQ ID NO 1529, SEQ ID NO 1534, SEQ ID NO 1536, SEQ ID NO 1544, SEQ ID NO 1546, SEQ ID NO 1551, SEQ ID NO 1553, SEQ ID NO 1554, SEQ ID NO 1556, SEQ ID NO 1557, SEQ ID NO 1561, SEQ ID NO 1562, SEQ ID NO 1682, SEQ ID NO 1683, SEQ ID NO 1684, SEQ ID NO 1776, SEQ ID NO 1777, SEQ ID NO 1778, SEQ ID NO 2023, SEQ ID NO 2024, SEQ ID NO 2025, SEQ ID NO 2026, SEQ ID NO 2028, SEQ ID NO 2173, SEQ ID NO 2174, SEQ ID NO 2175, SEQ ID NO 2176, SEQ ID NO 2177, SEQ ID NO 2178, SEQ ID NO 2179, SEQ ID NO 2181, SEQ ID NO 2762, SEQ ID NO 2763, SEQ ID NO 2764, SEQ ID NO 2860, SEQ ID NO 2861, SEQ ID NO 2862, SEQ ID NO 2883, SEQ ID NO 2884 and SEQ ID NO 2885.

The Top 150 polynucleotide probe set contains a combination of polynucleotide probes characterized by polynucleotide probes chosen among SEQ ID NO 1 to SEQ ID NO 2938.

The Top 200 polynucleotide probe set contains a combination of polynucleotide probes characterized by polynucleotide probes chosen among SEQ ID NO 1 to SEQ ID NO 2938.

According to the invention, the multiplicities used can also be represented by a number of at least 300 polynucleotide probe sets, more particularly at least 400 polynucleotide probe sets, more particularly at least 500 polynucleotide probe sets, more particularly at least 600 polynucleotide probe sets, more particularly at least 700 polynucleotide probe sets, more particularly at least 800 polynucleotide probe sets, more particularly at least 900 polynucleotide probe sets, more particularly at least 1000 polynucleotide probe sets, more particularly at least 1100 polynucleotide probe sets, more particularly at least 1228 polynucleotide probe sets, more particularly at least 1400 polynucleotide probe sets, and more particularly 1640 polynucleotide probe sets.

All the above-mentioned multiplicities of polynucleotide probe sets contain polynucleotides probes chosen among the library of nucleic acid sequences consisting in SEQ ID NO 1 to SEQ ID NO 2938.

According to the invention, the 1228 polynucleotide probe sets are an advantageous multiplicity of probe sets defined to diagnose the benign versus malignant status of a breast tumor.

In another embodiment, the invention also relates to the use of a multiplicity of polynucleotide probe sets, wherein polynucleotide probe sets are chosen among at least 50 polynucleotide probe sets, particularly at least 100 polynucleotide probe sets, more particularly at least 150 polynucleotide probe sets, more particularly at least 200 polynucleotide probe sets, more particularly at least 1228 polynucleotide probe sets, and more particularly 1640 polynucleotide probe sets of the library of nucleic acid sequences consisting in SEQ ID NO 1 to SEQ ID NO 2938, and wherein the sub-group of genes is constituted by the 259 genes of the group consisting in SEQ ID NO 5419 to SEQ ID NO 5677.

According to the invention, the benign versus malignant status of a breast tumor can be determined by the use of 2938 polynucleotide probes.

In an advantageous embodiment, the invention describes the use of a multiplicity of polynucleotide probe sets, wherein a variant of a given gene is chosen among the group of variants consisting in SEQ ID NO 4579 to SEQ ID NO 5418.

According to the invention, each gene can have:
no variant
at least one variant, as defined above.

In an advantageous embodiment, the invention discloses the use of a multiplicity of polynucleotide probe sets, each polynucleotide probe set containing at least one polynucleotide probe, each probe being able to specifically hybridize with at least one gene, and/or its variants when they exist, to determine the benign or malignant status of a breast tumor.

More particularly, the invention discloses the use of 2938 polynucleotides probes, assembled in polynucleotide probe sets, said polynucleotides probes being able to detect the variation of expression of at least one gene chosen among 259 genes, and/or its variants when present. According to the invention, the variation of expression of at least 839 variants and the variation of expression 259 genes can be detected by the use of the multiplicities of polynucleotide probe sets described above.

The invention also discloses a library of nucleic acid sequences consisting in SEQ ID NO 1 to SEQ ID NO 2938.

This library consists in all the polynucleotide probes that can be regrouped in 1640 representative probe sets of the invention. Then, the library consists in a group that contains 2938 polynucleotide probes.

The invention advantageously discloses a multiplicity of polynucleotide probes sets chosen among the nucleic acid sequences of the library described above, wherein the multiplicity of polynucleotide probe sets represents a combination of pool of polynucleotide probe sets able to specifically hybridize with 214 genes, and/or their variants when they exist, chosen among SEQ ID NO 5419 to SEQ ID NO 5677.

The group of polynucleotide probes represents a combination of 1228 polynucleotide probe sets. The group allows to detect the variation of expression of 214 genes and/or their variants when they exist.

The invention advantageously discloses a multiplicity of polynucleotide probe sets chosen among the nucleic acid sequences of the library according to claim 8, wherein the multiplicity of polynucleotide probe sets represents a combination of pool of polynucleotide probe sets able to specifically hybridize with 40 genes, and/or their variants when they exist, chosen among SEQ ID NO 5419 to SEQ ID NO 5677.

The group of polynucleotide probes represents a combination of 200 polynucleotide probe sets. The group allows to detect the variation of expression of 40 genes and/or their variants when they exist.

The invention more advantageously discloses a multiplicity of polynucleotide probe sets chosen among the nucleic acid sequences of the library according to claim 8, wherein the multiplicity of polynucleotide probe sets represents a combination of pool of polynucleotide probe sets able to specifically hybridize with 32 genes, and/or their variants when they exist, chosen among SEQ ID NO 5419 to SEQ ID NO 5677.

The group of polynucleotide probes represents a combination of 150 polynucleotide probe sets. The group allows to detect the variation of expression of 32 genes and/or their variants when they exist.

The invention more advantageously discloses multiplicity of polynucleotide probe sets chosen among the nucleic acid sequences of the library according to claim 8, wherein the multiplicity of polynucleotide probe sets represents a combination of pool of polynucleotide probe sets able to specifically hybridize with 19 genes, and/or their variants when they exist, chosen among SEQ ID NO 5419 to SEQ ID NO 5677.

According to the invention, the set of polynucleotide probe being able to specifically hybridize with 19 genes, and/or their variants when they exist, comprises the polynucleotide probes consisting in SEQ ID NO 120, SEQ ID NO 138, SEQ ID NO 140, SEQ ID NO 154, SEQ ID NO 155, SEQ ID NO 156, SEQ ID NO 157, SEQ ID NO 159, SEQ ID NO 166, SEQ ID NO 167, SEQ ID NO 168, SEQ ID NO 169, SEQ ID NO 171, SEQ ID NO 173, SEQ ID NO 174, SEQ ID NO 175, SEQ ID NO 176, SEQ ID NO 177, SEQ ID NO 312, SEQ ID NO 314, SEQ ID NO 315, SEQ ID NO 317, SEQ ID NO 324, SEQ ID NO 326, SEQ ID NO 327, SEQ ID NO 328, SEQ ID NO 329, SEQ ID NO 330, SEQ ID NO 331, SEQ ID NO 331, SEQ ID NO 332, SEQ ID NO 333, SEQ ID NO 335, SEQ ID NO 336, SEQ ID NO 337, SEQ ID NO 338, SEQ ID NO 339, SEQ ID NO 341, SEQ ID NO 345, SEQ ID NO 347, SEQ ID NO 349, SEQ ID NO 350, SEQ ID NO 351, SEQ ID NO 352, SEQ ID NO 353, SEQ ID NO 354, SEQ ID NO 355, SEQ ID NO 356, SEQ ID NO 360, SEQ ID NO 361, SEQ ID NO 363, SEQ ID NO 364, SEQ ID NO 364, SEQ ID NO 366, SEQ ID NO 367, SEQ ID NO 369, SEQ ID NO 369, SEQ ID NO 371, SEQ ID NO 376, SEQ ID NO 378, SEQ ID NO 379, SEQ ID NO 380, SEQ ID NO 381, SEQ ID NO 555, SEQ ID NO 556, SEQ ID NO 557, SEQ ID NO 558, SEQ ID NO 560, SEQ ID NO 561, SEQ ID NO 562, SEQ ID NO 566, SEQ ID NO 567, SEQ ID NO 788, SEQ ID NO 789, SEQ ID NO 790, SEQ ID NO 792, SEQ ID NO 793, SEQ ID NO 795, SEQ ID NO 800, SEQ ID NO 801, SEQ ID NO 802, SEQ ID NO 821, SEQ ID NO 822, SEQ ID NO 823, SEQ ID NO 969, SEQ ID NO 971, SEQ ID NO 972, SEQ ID NO 981, SEQ ID NO 1056, SEQ ID NO 1057, SEQ ID NO 1058, SEQ ID NO 1075, SEQ ID NO 1076, SEQ ID NO 1077, SEQ ID NO 1081, SEQ ID NO 1083, SEQ ID NO 1087, SEQ ID NO 1088, SEQ ID NO 1089, SEQ ID NO 1103, SEQ ID NO 1104, SEQ ID NO 1105, SEQ ID NO 1114, SEQ ID NO 1115, SEQ ID NO 1116, SEQ ID NO 1123, SEQ ID NO 1124, SEQ ID NO 1125, SEQ ID NO 1129, SEQ ID NO 1130, SEQ ID NO 1131, SEQ ID NO 1140, SEQ ID NO 1141, SEQ ID NO 1142, SEQ ID NO 1143, SEQ ID NO 1151, SEQ ID NO 1158, SEQ ID NO 1159, SEQ ID NO 1162, SEQ ID NO 1163, SEQ ID NO 1163, SEQ ID NO 1164, SEQ ID NO 1165, SEQ ID NO 1166, SEQ ID NO 1167, SEQ ID NO 1169, SEQ ID NO 1170, SEQ ID NO 1171, SEQ ID NO 1172, SEQ ID NO 1172, SEQ ID NO 1180, SEQ ID NO 1181, SEQ ID NO 1185, SEQ ID NO 1186, SEQ ID NO 1187, SEQ ID NO 1188, SEQ ID NO 1189, SEQ ID NO 1189, SEQ ID NO 1190, SEQ ID NO 1191, SEQ ID NO 1192, SEQ ID NO 1193, SEQ ID NO 1194, SEQ ID NO 1195, SEQ ID NO 1196, SEQ ID NO 1198, SEQ ID NO 1200, SEQ ID NO 1201, SEQ ID NO 1202, SEQ ID NO 1203, SEQ ID NO 1207, SEQ ID NO 1262, SEQ ID NO 1264, SEQ ID NO 1267, SEQ ID NO 1269, SEQ ID NO 1509, SEQ ID NO 1510, SEQ ID NO 1511, SEQ ID NO 1519, SEQ ID NO 1520, SEQ ID NO 1520, SEQ ID NO 1521, SEQ ID NO 1522, SEQ ID NO 1523, SEQ ID NO 1524, SEQ ID NO 1528, SEQ ID NO 1529, SEQ ID NO 1534, SEQ ID NO 1536, SEQ ID NO 1544, SEQ ID NO 1546, SEQ ID NO 1551, SEQ ID NO 1553, SEQ ID NO 1554, SEQ ID NO 1556, SEQ ID NO 1557, SEQ ID NO 1561, SEQ ID NO 1562, SEQ ID NO 1682, SEQ ID NO 1683, SEQ ID NO 1684, SEQ ID NO 1776, SEQ ID NO 1777, SEQ ID NO 1778, SEQ ID NO 2023, SEQ ID NO 2024, SEQ ID NO 2025, SEQ ID NO 2026, SEQ ID NO 2028, SEQ ID NO 2173, SEQ ID NO 2174, SEQ ID NO 2175, SEQ ID NO 2176, SEQ ID NO 2177, SEQ ID NO 2178, SEQ ID NO 2179, SEQ ID NO 2181, SEQ ID NO 2762, SEQ ID NO 2763, SEQ ID NO 2764, SEQ ID NO 2860, SEQ ID NO 2861, SEQ ID NO 2862, SEQ ID NO 2883, SEQ ID NO 2884 and SEQ ID NO 2885

The group of polynucleotide probes represents a combination of 100 polynucleotide probe sets. The group allows to detect the variation of expression of 19 genes and/or their variants when they exist.

The invention advantageously discloses a multiplicity of polynucleotide probe sets chosen among the nucleic acid sequences of the library according to claim 8, wherein the multiplicity of polynucleotide probe sets represents a combination of pool of polynucleotide probe sets able to specifically hybridize with 12 genes, and/or their variants when they exist, chosen among SEQ ID NO 5419 to SEQ ID NO 5677.

According to the invention, the set of polynucleotide probe being able to specifically hybridize with 12 genes, and/or their variants when they exist, comprises the polynucleotide probes consisting in SEQ ID NO 138, SEQ ID NO 140, SEQ ID NO 157, SEQ ID NO 159, SEQ ID NO 167, SEQ ID NO 168, SEQ ID NO 169, SEQ ID NO 171, SEQ ID NO 173, SEQ ID NO 177, SEQ ID NO 312, SEQ ID NO 314, SEQ ID NO 315, SEQ ID NO 317, SEQ ID NO 324, SEQ ID NO 326, SEQ ID NO 327, SEQ ID NO 329, SEQ ID NO 330, SEQ ID NO 331 SEQ ID NO 333, SEQ ID NO 335, SEQ ID NO 336, SEQ ID NO 339, SEQ ID NO 341, SEQ ID NO 345, SEQ ID NO 347, SEQ ID NO 353, SEQ ID NO 360, SEQ ID NO 361, SEQ ID NO 364, SEQ ID NO 366, SEQ ID NO 367, SEQ ID NO 369, SEQ ID NO 790, SEQ ID NO 792, SEQ ID NO 793, SEQ ID NO 795, SEQ ID NO 969, SEQ ID NO 972, SEQ ID NO 981, SEQ ID NO 1081, SEQ ID NO 1083, SEQ ID NO 1129, SEQ ID NO 1140, SEQ ID NO 1141, SEQ ID NO 1151, SEQ ID NO 1158, SEQ ID NO 1159, SEQ ID NO 1162, SEQ ID NO 1165, SEQ ID NO 1166, SEQ ID NO 1167, SEQ ID NO 1169, SEQ ID NO 1170, SEQ ID NO 1171, SEQ ID NO 1185, SEQ ID NO 1186, SEQ ID NO 1194, SEQ ID NO 1198, SEQ ID NO 1200, SEQ ID NO 1203, SEQ ID NO 1262, SEQ ID NO 1264, SEQ ID NO 1267, SEQ ID NO 1269, SEQ ID NO 1520, SEQ ID NO 1522, SEQ ID NO 1523, SEQ ID NO 1524, SEQ ID NO 1534, SEQ ID NO 1536, SEQ ID NO 1544, SEQ ID NO 1546, SEQ ID NO 1551, SEQ ID NO 1553, SEQ ID NO 1554, SEQ ID NO 1556, SEQ ID NO 1557, SEQ ID NO 2026, SEQ ID NO 2028, SEQ ID NO 2179 and SEQ ID NO 2181.

The group of polynucleotide probes represents a combination of 50 polynucleotide probe sets. The group allows to detect the variation of expression of 12 genes and/or their variants when they exist.

The invention also discloses a multiplicity of 50 polynucleotide probe sets chosen among 1640 polynucleotide probe sets as defined above.

Also, the invention relates to a multiplicity of at least 50 polynucleotide probe sets chosen among 1640 polynucleotide probe sets, the nucleic acid sequences of the polynucleotide probes contained in said 50 polynucleotide probe sets being the following nucleic acid sequences: SEQ ID NOs 136; 137; 138; 157; 158; 159; 167; 168; 169; 171; 172; 173; 177; 312; 313; 313; 314; 315; 316; 317; 324; 325; 326; 327; 328; 329; 330; 331; 333; 334; 335; 336; 339; 340; 341; 345; 346; 347; 348; 353; 360; 361; 364; 365; 366; 367; 368; 369; 370; 374; 375; 790; 791; 792; 793; 794; 795; 969; 972; 981;

1081; 1082; 1083; 1129; 1140; 1141; 1158; 1159; 1160; 1161; 1162; 1165; 1166; 1167; 1168; 1169; 1170; 1171; 1185; 1186; 1194; 1198; 1199; 1200; 1203; 1262; 1263; 1264; 1267; 1268; 1269; 1519; 1520; 1521; 1522; 1523; 1524; 1534; 1535; 1536; 1544; 1545; 1546; 1551; 1552; 1553; 1554; 1555; 1556; 1557; 2026; 2027; 2028; 2179; 2180 and 2181, each polynucleotide probe set containing from 1 to 4 of said polynucleotide probes, preferably, wherein SEQ ID NOs 167; 168; 177; 312; 313; 327; 328; 329; 331; 364; 365; 366; 368; 370; 1185; 1186; 1194; 1523; 1524; 1551; 1552 and 1553 are present twice, SEQ ID NO 316 is present in three copies and SEQ ID NO 315 is present in 5 copies.

In one preferred embodiment, the invention also discloses a multiplicity of 100 polynucleotide probe sets chosen among 1640 polynucleotide probe sets as defined above.

Also, the invention relates to a multiplicity of at least 100 polynucleotide probe sets as above defined, the nucleic acid sequences of the polynucleotides probes contained in said 100 polynucleotide probe sets being the following nucleic acid sequences: SEQ ID NO 120; 136; 137; 138; 154; 155; 156; 157; 158; 159; 167; 168; 169; 171; 172; 173; 174; 175; 176; 177; 312; 313; 314; 315; 316; 317; 324; 325; 326; 327; 328; 329; 330; 331; 332; 333; 334; 335; 336; 337; 338; 339; 340; 341; 345; 346; 347; 348; 349; 350; 351; 352; 353; 354; 355; 356; 360; 361; 363; 364; 365; 366; 367; 368; 369; 370; 371; 374; 375; 376; 378; 379; 380; 381; 555; 556; 557; 558; 560; 561; 562; 566; 567; 788; 789; 790; 791; 792; 793; 794; 795; 800; 801; 802; 821; 822; 823; 969; 971; 972; 981; 1056; 1057; 1058; 1075; 1076; 1077; 1081; 1082; 1083; 1087; 1088; 1089; 1103; 1104; 1105; 1114; 1115; 1116; 1123; 1124; 1125; 1129; 1130; 1131; 1140; 1141; 1158; 1159; 1160; 1161; 1162; 1163; 1164; 1165; 1166; 1167; 1168; 1169; 1170; 1171; 1172; 1180; 1181; 1185; 1186; 1187; 1188; 1189; 1190; 1191; 1192; 1193; 1194; 1195; 1196; 1198; 1199; 1200; 1201; 1202; 1203; 1207; 1262; 1263; 1264; 1267; 1268; 1269; 1509; 1510; 1511; 1519; 1520; 1521; 1522; 1523; 1524; 1528; 1529; 1534; 1535; 1536; 1544; 1545; 1546; 1551; 1552; 1553; 1554; 1555; 1556; 1557; 1561; 1562; 1682; 1683; 1684; 1776; 1777; 1778; 2023; 2024; 2025; 2026; 2027; 2028; 2173; 2174; 2175; 2176; 2177; 2178; 2179; 2180; 2181; 2762; 2763; 2764; 2860; 2861; 2862; 2883; 2884 and 2885, each polynucleotide probe set containing from 1 to 4 of said polynucleotide probes, preferably, wherein SEQ ID NOs 167; 168; 177; 312; 313; 316; 317; 327; 329; 330; 353; 361; 364; 365; 366; 367; 368; 369; 370; 821; 822; 823; 1129; 1164; 1185; 1186; 1187; 1188; 1189; 1203; 1523; 1551; 1552 and 1553 are present twice, SEQ ID NOs 328; 331; 1162; 1194; 1519; 1520; 1521 and 1524 are present in three copies and SEQ ID NO 315 is present in 6 copies.

In another preferred embodiment, the invention also discloses a multiplicity of 150 polynucleotide probe sets chosen among 1640 polynucleotide probe sets as defined above.

In other word, the invention relates to a multiplicity of at least 150 polynucleotide probe sets previously defined, the nucleic acid sequences of the polynucleotides probes contained in said 150 polynucleotide probe sets being the following nucleic acid sequences: SEQ ID NOs 4; 5; 6; 120; 136; 137; 138; 154; 155; 156; 157; 158; 159; 167; 168; 169; 171; 172; 173; 174; 175; 176; 177; 197; 248; 254; 255; 305; 306; 307; 312; 313; 314; 315; 316; 317; 324; 325; 326; 327; 328; 329; 330; 331; 332; 333; 334; 335; 336; 337; 338; 339; 340; 341; 345; 346; 347; 348; 349; 350; 351; 352; 353; 354; 355; 356; 360; 361; 362; 363; 364; 365; 366; 367; 367; 368; 369; 370; 371; 374; 375; 376; 377; 378; 379; 380; 381; 513; 514; 515; 552; 553; 554; 555; 556; 557; 558; 559; 560; 561; 562; 566; 567; 783; 784; 785; 788; 789; 790; 791; 792; 793; 794; 795; 796; 797; 798; 799; 800; 801; 802; 803; 804; 805; 806; 807; 808; 812; 813; 814; 818; 821; 822; 823; 968; 969; 970; 971; 972; 981; 1056; 1057; 1058; 1061; 1062; 1063; 1064; 1065; 1066; 1067; 1068; 1069; 1070; 1071; 1075; 1076; 1077; 1080; 1081; 1082; 1083; 1087; 1088; 1089; 1103; 1104; 1105; 1114; 1115; 1116; 1123; 1124; 1125; 1129; 1130; 1131; 1139; 1140; 1141; 1158; 1159; 1160; 1161; 1162; 1163; 1164; 1165; 1166; 1167; 1168; 1169; 1170; 1171; 1172; 1174; 1175; 1176; 1180; 1181; 1185; 1186; 1187; 1188; 1189; 1190; 1191; 1192; 1193; 1194; 1195; 1196; 1197; 1198; 1199; 1200; 1201; 1202; 1203; 1204; 1205; 1206; 1207; 1262; 1263; 1264; 1267; 1268; 1269; 1284; 1285; 1315; 1469; 1470; 1471; 1509; 1510; 1511; 1515; 1516; 1517; 1519; 1520; 1521; 1522; 1523; 1524; 1528; 1529; 1534; 1535; 1536; 1537; 1538; 1539; 1544; 1545; 1546; 1550; 1551; 1552; 1553; 1554; 1555; 1556; 1557; 1558; 1559; 1560; 1561; 1562; 1580; 1581; 1582; 1671; 1682; 1683; 1684; 1685; 1686; 1690; 1691; 1692; 1776; 1777; 1778; 1788; 1789; 1790; 1890; 1891; 1892; 1952; 1953; 1954; 1963; 2023; 2024; 2025; 2026; 2027; 2028; 2065; 2067; 2088; 2089; 2090; 2091; 2173; 2174; 2175; 2176; 2177; 2178; 2179; 2180; 2181; 2196; 2201; 2229; 2230; 2231; 2536; 2537; 2538; 2576; 2577; 2578; 2599; 2600; 2762; 2763; 2764; 2774; 2775; 2776; 2860; 2861; 2862; 2883; 2884 and 2885, each polynucleotide probe set containing from 1 to 4 of said polynucleotide probes, preferably, wherein SEQ ID NOs 167; 168; 177; 312; 313; 317; 327; 329; 330; 353; 361; 363; 364; 365; 366; 369; 370; 371; 558; 567; 796; 797; 801; 806; 807; 808; 813; 814; 821; 822; 823; 969; 1056; 1057; 1058; 1129; 1141; 1163; 1164; 1185; 1186; 1187; 1188; 1189; 1199; 1203; 1469; 1470; 1471; 1523; 1551; 1552 and 1553 are present twice, SEQ ID NOs 316; 328; 331; 368; 788; 1194; 1519; 1520; 1521; 1524 are present in three copies, SEQ ID NO 1162 is present in 4 copies and SEQ ID NO 315 is present in 6 copies.

Another preferred embodiment of the invention relates to a multiplicity of 200 polynucleotide probe sets chosen among 1640 polynucleotide probe sets as defined above.

Indeed, a preferred embodiment of the invention discloses a multiplicity of at least 200 polynucleotide probe sets defined above, the nucleic acid sequences of the polynucleotide probes contained in said 200 polynucleotide probe sets being the following nucleic acid sequences: SEQ ID NOs 4; 5; 6; 120; 121; 122; 123; 130; 131; 132; 136; 137; 138; 154; 155; 156; 157; 158; 159; 167; 168; 169; 171; 172; 173; 174; 175; 176; 177; 195; 196; 197; 198; 199; 200; 248; 254; 255; 305; 306; 307; 312; 313; 314; 315; 316; 317; 324; 325; 326; 327; 328; 329; 330; 331; 332; 333; 334; 335; 336; 337; 338; 339; 340; 341; 345; 346; 347; 348; 349; 350; 351; 352; 353; 354; 355; 356; 360; 361; 362; 363; 364; 365; 366; 367; 368; 369; 370; 371; 374; 375; 376; 377; 378; 379; 380; 381; 513; 514; 515; 552; 553; 554; 555; 556; 557; 558; 559; 560; 561; 562; 563; 564; 565; 566; 567; 783; 784; 785; 788; 789; 790; 791; 792; 793; 794; 795; 796; 797; 798; 799; 800; 801; 802; 803; 804; 805; 806; 807; 808; 809; 810; 811; 812; 813; 814; 815; 816; 817; 818; 821; 822; 823; 824; 825; 826; 840; 841; 845; 846; 847; 868; 968; 969; 970; 971; 972; 973; 974; 975; 976; 977; 981; 1056; 1057; 1058; 1059; 1060; 1061; 1062; 1063; 1064; 1065; 1066; 1067; 1068; 1069; 1070; 1071; 1075; 1076; 1077; 1080; 1081; 1082; 1083; 1084; 1085; 1086; 1087; 1088; 1089; 1094; 1095; 1096; 1103; 1104; 1105; 1110; 1111; 1112; 1114; 1115; 1116; 1123; 1124; 1125; 1126; 1127; 1128; 1129; 1130; 1131; 1139; 1140;

1141; 1158; 1159; 1160; 1161; 1162; 1163; 1164; 1165; 1166; 1167; 1168; 1169; 1170; 1171; 1172; 1174; 1175; 1176; 1180; 1181; 1185; 1186; 1187; 1188; 1189; 1190; 1191; 1192; 1193; 1194; 1195; 1196; 1197; 1198; 1199; 1200; 1201; 1202; 1203; 1204; 1205; 1206; 1207; 1229; 1230; 1242; 1243; 1244; 1245; 1250; 1251; 1252; 1262; 1263; 1264; 1265; 1266; 1267; 1268; 1269; 1270; 1271; 1272; 1284; 1285; 1315; 1335; 1407; 1408; 1469; 1470; 1471; 1509; 1510; 1511; 1512; 1513; 1514; 1515; 1516; 1517; 1519; 1520; 1521; 1522; 1523; 1524; 1528; 1529; 1534; 1535; 1536; 1537; 1538; 1539; 1544; 1545; 1546; 1550; 1551; 1552; 1553; 1554; 1555; 1556; 1557; 1558; 1559; 1560; 1561; 1562; 1563; 1564; 1580; 1581; 1582; 1586; 1587; 1588; 1671; 1682; 1683; 1684; 1685; 1686; 1687; 1688; 1689; 1690; 1691; 1692; 1743; 1744; 1745; 1776; 1777; 1778; 1788; 1789; 1790; 1890; 1891; 1892; 1896; 1897; 1898; 1952; 1953; 1954; 1963; 1974; 2023; 2024; 2025; 2026; 2027; 2028; 2061; 2062; 2063; 2065; 2067; 2068; 2072; 2083; 2084; 2085; 2088; 2089; 2090; 2091; 2092; 2173; 2174; 2175; 2176; 2177; 2178; 2179; 2180; 2181; 2196; 2201; 2229; 2230; 2231; 2381; 2382; 2383; 2536; 2537; 2538; 2576; 2577; 2578; 2599; 2600; 2601; 2602; 2603; 2762; 2763; 2764; 2774; 2775; 2776; 2778; 2779; 2783; 2794; 2860; 2861; 2862; 2883; 2884 and 2885, each polynucleotide probe set containing from 1 to 4 of said polynucleotide probes, preferably, wherein SEQ ID NOs 167; 168; 177; 312; 313; 317; 327; 329; 330; 353; 361; 363; 364; 365; 366; 367; 369; 370; 371; 558; 567; 796; 797; 801; 806; 807; 808; 813; 814; 821; 822; 823; 845; 968; 970; 972; 1056; 1057; 1058; 1085; 1114; 1115; 1116; 1123; 1124; 1125; 1129; 1141; 1163; 1164; 1185; 1186; 1187; 1188; 1189; 1199; 1203; 1523; 1551; 1552; 1553; 1557; 1586; 1587; 1588; 1952; 1953; 1954; 2088; 2090; 2091; 2762; 2763 and 2764 are present twice, SEQ ID NOs 316; 328; 331; 368; 788; 1284; 1285; 1469; 1470; 1471; 1519; 1520; 1521; 1524; 2065; 2067 and 2089 are present in three copies, SEQ ID NO 1194 is present in 4 copies and SEQ ID NOs 315 and 1162 are present in 6 copies.

Another particular embodiment of the invention relates to a multiplicity of 1228 polynucleotide probe sets chosen among 1640 polynucleotide probe sets as defined above.

The invention, in a particular embodiment, relates to a multiplicity of at least 1228 polynucleotide probe sets as defined above, containing 3985 polynucleotide probes, the nucleic acid sequences of the polynucleotide probes contained in said 1228 polynucleotide probe sets being represented in the first 1228 lines of the Table 7.

The invention discloses, in another preferred embodiment, a multiplicity 1640 polynucleotide probe sets as defined above.

The invention related to a multiplicity of 1640 polynucleotide probe sets as previously defined, the nucleic acid sequences of the polynucleotide probes contained in said 1640 polynucleotide probe sets being represented in Table 7.

The invention also discloses a micro-array comprising or consisting in a multiplicity of polynucleotide probe sets as defined above.

Thus, the invention discloses a micro-array comprising the library of nucleic acid sequences consisting in SEQ ID NO 1 to SEQ ID NO 2938, or a multiplicity of polynucleotide probe sets:

corresponding to a multiplicity of 1228 polynucleotide probe sets comprising nucleic acid sequences chosen among the group consisting in SEQ ID NO 1 to SEQ ID NO 2938, or corresponding to a multiplicity of 200 polynucleotide probe sets comprising nucleic acid sequences consisting in SEQ ID NO 1 to SEQ ID NO 2938, or corresponding to a multiplicity of 150 polynucleotide probe sets comprising nucleic acid sequences consisting in SEQ ID NO 1 to SEQ ID NO 2938, or corresponding to a multiplicity of 100 polynucleotide probe sets comprising nucleic acid sequences consisting in SEQ ID NO 1 to SEQ ID NO 2938, and in particular consisting in SEQ ID NO 120, SEQ ID NO 138, SEQ ID NO 140, SEQ ID NO 154, SEQ ID NO 155, SEQ ID NO 156, SEQ ID NO 157, SEQ ID NO 159, SEQ ID NO 166, SEQ ID NO 167, SEQ ID NO 168, SEQ ID NO 169, SEQ ID NO 171, SEQ ID NO 173, SEQ ID NO 174, SEQ ID NO 175, SEQ ID NO 176, SEQ ID NO 177, SEQ ID NO 312, SEQ ID NO 314, SEQ ID NO 315, SEQ ID NO 317, SEQ ID NO 324, SEQ ID NO 326, SEQ ID NO 327, SEQ ID NO 328, SEQ ID NO 329, SEQ ID NO 330, SEQ ID NO 331, SEQ ID NO 331, SEQ ID NO 332, SEQ ID NO 333, SEQ ID NO 335, SEQ ID NO 336, SEQ ID NO 337, SEQ ID NO 338, SEQ ID NO 339, SEQ ID NO 341, SEQ ID NO 345, SEQ ID NO 347, SEQ ID NO 349, SEQ ID NO 350, SEQ ID NO 351, SEQ ID NO 352, SEQ ID NO 353, SEQ ID NO 354, SEQ ID NO 355, SEQ ID NO 356, SEQ ID NO 360, SEQ ID NO 361, SEQ ID NO 363, SEQ ID NO 364, SEQ ID NO 364, SEQ ID NO 366, SEQ ID NO 367, SEQ ID NO 369, SEQ ID NO 369, SEQ ID NO 371, SEQ ID NO 376, SEQ ID NO 378, SEQ ID NO 379, SEQ ID NO 380, SEQ ID NO 381, SEQ ID NO 555, SEQ ID NO 556, SEQ ID NO 557, SEQ ID NO 558, SEQ ID NO 560, SEQ ID NO 561, SEQ ID NO 562, SEQ ID NO 566, SEQ ID NO 567, SEQ ID NO 788, SEQ ID NO 789, SEQ ID NO 790, SEQ ID NO 792, SEQ ID NO 793, SEQ ID NO 795, SEQ ID NO 800, SEQ ID NO 801, SEQ ID NO 802, SEQ ID NO 821, SEQ ID NO 822, SEQ ID NO 823, SEQ ID NO 969, SEQ ID NO 971, SEQ ID NO 972, SEQ ID NO 981, SEQ ID NO 1056, SEQ ID NO 1057, SEQ ID NO 1058, SEQ ID NO 1075, SEQ ID NO 1076, SEQ ID NO 1077, SEQ ID NO 1081, SEQ ID NO 1083, SEQ ID NO 1087, SEQ ID NO 1088, SEQ ID NO 1089, SEQ ID NO 1103, SEQ ID NO 1104, SEQ ID NO 1105, SEQ ID NO 1114, SEQ ID NO 1115, SEQ ID NO 1116, SEQ ID NO 1123, SEQ ID NO 1124, SEQ ID NO 1125, SEQ ID NO 1129, SEQ ID NO 1130, SEQ ID NO 1131, SEQ ID NO 1140, SEQ ID NO 1141, SEQ ID NO 1142, SEQ ID NO 1143, SEQ ID NO 1151, SEQ ID NO 1158, SEQ ID NO 1159, SEQ ID NO 1162, SEQ ID NO 1163, SEQ ID NO 1163, SEQ ID NO 1164, SEQ ID NO 1165, SEQ ID NO 1166, SEQ ID NO 1167, SEQ ID NO 1169, SEQ ID NO 1170, SEQ ID NO 1171, SEQ ID NO 1172, SEQ ID NO 1172, SEQ ID NO 1180, SEQ ID NO 1181, SEQ ID NO 1185, SEQ ID NO 1186, SEQ ID NO 1187, SEQ ID NO 1188, SEQ ID NO 1189, SEQ ID NO 1189, SEQ ID NO 1190, SEQ ID NO 1191, SEQ ID NO 1192, SEQ ID NO 1193, SEQ ID NO 1194, SEQ ID NO 1195, SEQ ID NO 1196, SEQ ID NO 1198, SEQ ID NO 1200, SEQ ID NO 1201, SEQ ID NO 1202, SEQ ID NO 1203, SEQ ID NO 1207, SEQ ID NO 1262, SEQ ID NO 1264, SEQ ID NO 1267, SEQ ID NO 1269, SEQ ID NO 1509, SEQ ID NO 1510, SEQ ID NO 1511, SEQ ID NO 1519, SEQ ID NO 1520, SEQ ID NO 1520, SEQ ID NO 1521, SEQ ID NO 1522, SEQ ID NO 1523, SEQ ID NO 1524, SEQ ID NO 1524, SEQ ID NO 1528, SEQ ID NO 1529, SEQ ID NO 1534, SEQ ID NO 1536, SEQ ID NO 1544, SEQ ID NO 1546, SEQ ID NO 1551, SEQ ID NO 1553, SEQ ID NO 1554, SEQ ID NO 1556, SEQ ID NO 1557, SEQ ID NO 1561, SEQ ID NO 1562, SEQ ID NO 1682, SEQ ID NO 1683, SEQ ID NO 1684, SEQ ID NO 1776, SEQ ID NO 1777, SEQ ID NO 1778, SEQ ID NO 2023, SEQ ID NO 2024, SEQ ID NO 2025, SEQ ID NO 2026, SEQ ID NO 2028, SEQ ID NO 2173, SEQ ID NO 2174, SEQ ID NO 2175, SEQ ID NO 2176, SEQ ID NO 2177, SEQ ID NO 2178, SEQ ID NO 2179, SEQ ID NO 2181, SEQ ID NO 2762, SEQ ID NO 2763, SEQ ID NO 2764, SEQ ID NO 2860, SEQ ID NO 2861, SEQ ID NO 2862, SEQ ID NO 2883, SEQ ID NO 2884 and SEQ ID NO 2885, or corresponding to a multiplicity of 50 polynucleotide probe sets comprising nucleic acid sequences consisting in SEQ ID NO 1 to SEQ ID NO 2938, and in particular consisting in SEQ ID NO 138, SEQ ID NO 140, SEQ ID NO 157, SEQ ID NO 159, SEQ ID NO 167, SEQ ID NO 168, SEQ ID NO 169, SEQ ID NO 171, SEQ ID NO 173, SEQ ID NO 177, SEQ ID NO 312, SEQ ID NO 314, SEQ ID NO 315, SEQ ID NO 317, SEQ ID NO 324, SEQ ID NO 326, SEQ ID NO 327, SEQ ID NO 329, SEQ ID NO 330, SEQ ID NO 331 SEQ ID NO 333, SEQ ID NO 335, SEQ ID NO 336, SEQ ID NO 339, SEQ ID NO 341, SEQ ID NO 345, SEQ ID NO 347, SEQ ID NO 353, SEQ ID NO 360, SEQ ID NO 361, SEQ ID NO 364, SEQ ID NO 366, SEQ ID NO 367, SEQ ID NO 369, SEQ ID NO 790, SEQ ID NO 792, SEQ ID NO 793, SEQ ID NO 795, SEQ ID NO 969, SEQ ID NO 972, SEQ ID NO 981, SEQ ID NO 1081, SEQ ID NO 1083, SEQ ID NO 1129, SEQ ID NO 1140, SEQ ID NO 1141, SEQ ID NO 1151, SEQ ID NO 1158, SEQ ID NO 1159, SEQ ID NO 1162, SEQ ID NO 1165, SEQ ID NO 1166, SEQ ID NO 1167, SEQ ID NO 1169, SEQ ID NO 1170, SEQ ID NO 1171, SEQ ID NO 1185, SEQ ID NO 1186, SEQ ID NO 1194, SEQ ID NO 1198, SEQ ID NO 1200, SEQ ID NO 1203, SEQ ID NO 1262, SEQ ID NO 1264, SEQ ID NO 1267, SEQ ID NO 1269, SEQ ID NO 1520, SEQ ID NO 1522, SEQ ID NO 1523, SEQ ID NO 1524, SEQ ID NO 1534, SEQ ID NO 1536, SEQ ID NO 1544, SEQ ID NO 1546, SEQ ID NO 1551, SEQ ID NO 1553, SEQ ID NO 1554, SEQ ID NO 1556, SEQ ID NO 1557, SEQ ID NO 2026, SEQ ID NO 2028, SEQ ID NO 2179 and SEQ ID NO 2181.

The microarray refers to nucleic acid molecule covalently attached to an inert chemical surface, such as coated glass slides or gene chips, and to which a mobile DNA target is hybridized. All the commonly used surfaces can also serve as a support.

The invention discloses a method for the in vitro and/or ex vivo determination of the benign or malignant state of a breast tumor in a biological sample from a subject, by determining the variation of the expression of a gene, and/or at least one of its variants when present, of a sub-group comprising at least 12 genes among the genes of the group consisting in SEQ ID NO 5419 to SEQ ID NO 5677, comprising:

a) contacting nucleic acid molecules from said biological sample a multiplicity of polynucleotide probe sets, said multiplicity of polynucleotide probe sets consisting in a combination of pools of polynucleotide probe sets, each polynucleotide probe set containing at least one polynucleotide probe chosen among a library of nucleic acid sequences, each nucleic acid sequence specifically hybridizing with a gene, and/or at least one of its variants when present, said gene being chosen among the group of genes consisting in SEQ ID NO 5419 to SEQ ID NO 5677, each given gene, when it presents no variant, comprising at least one target region, the nucleic acid sequence of which is chosen among SEQ ID NO 2939 to SEQ ID NO 4578, said target region characterizing said gene, each given gene, when it presents at least one variant, comprising at least two target regions such that:
at least one of the respective nucleic acid sequences of said target region chosen among SEQ ID NO 2939 to SEQ ID NO 4578 is present in a given variant of said gene,
at least one of the respective nucleic acid sequences of said target region chosen among SEQ ID NO 2939 to SEQ ID NO 4578 is either absent in a given variant or is present in a configuration that differs from the one of said gene, said two target regions characterizing said gene,
each variant of a given gene presenting at least one target region, said target region being such that its respective nucleic acid sequence is chosen among SEQ ID NO 2939 to SEQ ID NO 4578, each variant is characterized by:
either the combination of the presence of at least one target region also present in the gene, the respective nucleic acid sequence of which being chosen among SEQ ID NO 2939 to SEQ ID NO 4578, and the absence of at least one target region present in the gene the respective nucleic acid sequence of which being chosen among SEQ ID NO 2939 to SEQ ID NO 4578,
or the presence of a target region, the respective nucleic acid sequence of which being chosen among SEQ ID NO 2939 to SEQ ID NO 4578, said target region presenting a configuration that does not naturally exist in the gene, each polynucleotide probe of a polynucleotide probe set hybridizes with a specific nucleic acid sequence contained in a given target region of the target regions which characterize a given gene, and/or at least one of its variants when present, each given gene, and its variants when present, is specifically recognized by at least a given polynucleotide probe set, each polynucleotide probe of a given pool of polynucleotide probe set being such that it hybridizes with a given gene, and/or at least one of its variants when present, and cannot hybridize with any other gene different from said given gene, and cannot hybridize with any other variants of a gene different from said given gene, b) determining a profile of expression variants of said genes from the detection of the nucleic acid complexes formed in the previous step, c) comparing said profile with a reference gene expression variant profile of a control subject, d) concluding, from the previous comparison, the benign or malignant state of the breast cancer in the subject.

Also, the invention relates to a method for the determination, preferably in vitro and/or ex vivo, of the benign or malignant state of a breast tumor in a biological sample from a subject, by determining the variation of the expression of
at least 12 determined genes belonging to a group of determined genes represented by the nucleotidic sequences SEQ ID NO: 5419 to SEQ ID NO: 5693 and
at least one variant of said genes at least 12 determined genes, when they exist, said 12 determined genes being represented by the following nucleotidic sequences:
SEQ ID NOs 5421; 5423; 5432; 5434; 5486; 5491; 5525; 5552; 5599; 5652; 5654 and 5683,
comprising:
(1) contacting nucleic acid molecules from said biological sample to a multiplicity of polynucleotide probe sets, said multiplicity of polynucleotide probe sets consisting in a combination of pools of polynucleotide probe sets, to allow the formation of a nucleic acid complex,
each polynucleotide probe set containing at least one polynucleotide probe chosen among a library of nucleic acid sequences, said library comprising or consisting of at least one copy each of the nucleic acids consisting of SEQ ID NO 1 to SEQ ID NO 2938,
said polynucleotide probes being such that the nucleic acid sequence of each polynucleotide probe specifically hybridizes with the nucleotidic sequence of one target region of one gene, and/or of at least one of its variants when present,
wherein
a) each given gene,
   a. when it presents no variant, comprises at least one target region, said target region characterizing said gene,
   b. when it presents one variant, comprises at least one target region, said target region characterizing said gene and its variant, and said variant being characterized by the fact that its nucleic acid sequence is shorter than the nucleic acid sequence of said gene,
   c. when it presents at least two variants, comprises at least two target regions, said two target regions characterizing said gene, such that:
      iii. at least one of the respective polynucleotidic sequences of said target region is present in a given variant of said gene, and
      iv. at least one of the respective polynucleotidic sequences of said target region is either
         absent in a given variant, or
         present in a given variant in a configuration that differs from the one of said gene,
         said variant being characterized by the fact that its nucleic acid sequence is shorter than the nucleic acid sequence of said gene,
b) each variant of a given gene presents at least one target region,
and
   if said variant is the unique variant of a gene, said variant has the same target than said gene, and
   if said variant is one of the variants of a gene that has at least two variants, each variant of said gene is characterized by either:
      a. the combination of the presence of at least one target region also present in the gene, and the absence of at least one target region present in the gene, or
      b. the combination of the presence of at least one target region also present in the gene, and the presence of a target region, said target region presenting a configuration that does not naturally exist in the gene,
c) the nucleotidic sequence of each given gene, and its variants when present, is specifically recognized by the nucleic acid sequences of polynucleotide probes contained in at least one given polynucleotide probe set,
d) the nucleic acid sequence of each polynucleotide probe of a polynucleotide probe set hybridizes with a specific polynucleotidic sequence contained in a given target region of the target regions which characterize a given gene, and/or at least one of its variants when present,
e) the nucleic acid sequence of each polynucleotide probe of a given pool of polynucleotide probe set being such that
   a. it hybridizes with the nucleotidic sequence of a given gene, and/or of at least one of its variants when present, and
   b. cannot hybridize with
      i. the nucleotidic sequence of any other gene different from said given gene, and
      ii. the nucleotidic sequence of any other variants of a gene different from said given gene,
(2) determining a profile of expression of said genes and of variants of said genes from the detection of the nucleic acid complexes formed in the previous step,
(3) comparing said profile with a reference expression profile of a control benign breast tumor, and/or a reference expression profile of a control malignant tumor, and
(4) concluding, from the previous comparison, that:
   if said profile of expression is similar to the reference expression profile of a control benign breast tumor, then the breast cancer is benign, and
   if said profile of expression is similar to the reference expression profile of a control malignant breast tumor, then the breast cancer is malignant,
   with the proviso that said gene, and its variants when present, is not KRT17, LOC440421, KRT6C and KRT6A, said genes being respectively represented by SEQ ID NO 5431; 5689; 5651 and 5682.

The invention also describes a method that allows the determination of the status, benign or malignant, of a breast tumor.

In the method of the invention, a biological sample corresponding to a breast tumor is used as a source of nucleic acid molecule. Said biological sample refers to a sample obtained from an organism or from components (e.g., cells) of an organism. The sample may be one of any biological tissue. Frequently the sample could be a "clinical sample" which is a sample derived from a patient. Such samples include, but are not limited to, FNA sample, CNB sample, ductal lavage and blood sample. Biological samples may also include sections of tissues such as frozen sections taken for histological purposes.

The subject from which biological sample is provided is commonly a woman, afflicted, or suspected to be afflicted by a breast tumor. The subject can also be a man, with, or suspected to have, a breast cancer. By extension, all the mammals can be diagnosed by the method provides by the invention, with the proviso that they could develop a breast tumor.

The extraction of the nucleic acid molecules of the samples is managed by a routine protocol used in the art. Advantageously, nucleic acid molecules extracted from the biological sample are RNA.

Then, the method of the invention consists in contacting nucleic acid molecules extracted from the biological sample of a subject, with a multiplicity of polynucleotide probe sets. Each polynucleotide probe set contains at least one polynucleotide probe.

The contact between the polynucleotide probe set, and more particularly the polynucleotide probes contained in each polynucleotide probe set, allows to form a nucleic acid complex between the nucleic acid molecule corresponding to a gene, and/or its variants when they exist, and a polynucleotide probe.

Preferably, before contacting the polynucleotide probes with the nucleic acid molecules, nucleic acid molecules are labeled with any know labeling agents (radioisotopes, enzymes, fluorescent molecule . . . ). The hybridization is made according a standard procedure, by modulating if necessary saline concentration and temperature. The protocol used for hybridization is well known by the skilled man in the art.

The presence and amount of the formed nucleic acid complex is detected, by the detection of hybridized nucleic acid molecules which have been labeled with labeling agent, with a specific detection method fitting to the used labeled agent.

According to the invention, each probe set that have hybridized with labeled nucleic acid molecules allows to attribute a value of hybridization. The given value is dependant of the labeling agent.

The compilation of all the values of hybridization allows to establish a profile that corresponds to the specific feature of the tumor assayed. This result is considered as a hallmark of the tumor assayed.

The tumor profile is compared to a reference profile, in particular profile of tumors deriving from biological sample of non afflicted by breast cancer subjects, or derived from biological sample of a subject afflicted by a benign or a malignant breast tumor. Alternatively, the tumor profile assayed can be compared with tumor profile of patients afflicted by benign breast tumor or malignant breast tumor. Typically, the comparison is made by using software commonly used in this type of comparison, and well known and described in the art.

From the comparison between tumor profile and reference profile, it is possible to determine if the breast tumor derived from the biological sample of a patient is a benign tumor or a malignant tumor.

In an advantageous embodiment, the invention discloses a method for the in vitro and/or ex vivo determination of the benign or malignant state of a breast tumor in a biological sample from a subject, wherein the determination of the variation of the expression of a gene, and/or at least one of its variants when present, of a sub-group comprising at least 12 genes among the genes of the group consisting in SEQ ID NO 5419 to SEQ ID NO 5677, comprises:

a) contacting nucleic acid molecules from said biological sample with a multiplicity of polynucleotide probe sets consisting in a combination of pools of polynucleotide probe sets chosen among 1640 probe sets of polynucleotides, each polynucleotide probe set containing at least one polynucleotide probe chosen among a library of nucleic acid sequences consisting in SEQ ID NO 1 to SEQ ID NO 2938, each nucleic acid sequence hybridizing with a gene, and/or at least one of its variants when present, said gene being chosen among the group of genes consisting in SEQ ID NO 5419 to SEQ ID NO 5677, each given gene, when it presents NO variant, comprising at least one target region, the nucleic acid sequence of which is chosen among SEQ ID NO 2939 TO SEQ ID NO 4578, said target region characterizing said gene, each given gene, when it presents at least one variant, comprising at least two target regions such that:

at least one of the respective nucleic acid sequences of said target region chosen among SEQ ID NO 2939 to SEQ ID NO 4578 is present in a given variant of said gene, at least one of the respective nucleic acid sequences of said target region chosen among SEQ ID NO 2939 to SEQ ID NO 4578 is either absent in a given variant or is present in a configuration that differs from the one of said gene, said two target regions characterizing said gene, each variant of a given gene presenting at least one target region, said target region being such that its respective nucleic acid sequence is chosen among SEQ ID NO 2939 to SEQ ID NO 4578, each variant is characterized by:

either the combination of the presence of at least one target region also present in the gene, the respective nucleic acid sequence of which being chosen among SEQ ID NO 2939 to SEQ ID NO 4578, and the absence of at least one target region present in the gene the respective nucleic acid sequence of which being chosen among SEQ ID NO 2939 to SEQ ID NO 4578, or the presence of a target region, the respective nucleic acid sequence of which being chosen among SEQ ID NO 2939 to SEQ ID NO 4578, said target region presenting a configuration that does not naturally exist in the gene, each polynucleotide probe of a polynucleotide probe set hybridizes with a specific nucleic acid sequence contained in a given target region of the target regions which characterize a given gene, and/or at least one of its variants when present, each given gene, and its variants when present, is specifically recognized by at least a given polynucleotide probe set, each polynucleotide probe of a given pool of polynucleotide probe set being such that it hybridizes with a given gene, and/or at least one of its variants when present, and cannot hybridize with any other gene different from said given gene, and cannot hybridize with any other variants of a gene different from said given gene, b) determining a profile of expression variants of said genes from the detection of the nucleic acid complexes formed in the previous step, c) comparing said profile with a reference gene expression variant profile of a control subject, d) concluding, from the previous comparison, the benign or malignant state of the breast cancer in the subject.

In one preferred embodiment, the invention relates to a method for the in vitro and/or ex vivo determination of the benign or malignant state of a breast tumor in a biological sample from a subject as defined above, by determining the variation of the expression of at least 20 determined genes of a group of determined genes represented by the nucleotidic sequences SEQ ID NO: 5419 to SEQ ID NO: 5693
said 20 determined genes being represented by the following nucleotidic sequences: SEQ ID Nos 5421; 5423; 5432; 5434; 5457; 5486; 5491; 5513; 5516; 5525; 5532; 5552; 5599; 5616; 5624; 5643; 5652; 5654; 5673 and 5683.

In one other preferred embodiment, the invention relates to a method for the in vitro and/or ex vivo determination of the benign or malignant state of a breast tumor in a biological sample from a subject such as defined above, by 35 determined genes of a group of determined genes represented by the nucleotidic sequences SEQ ID NO: 5419 to SEQ ID NO: 5693
  said 35 determined genes being represented by the following nucleotidic sequences:
  SEQ ID Nos 5421; 5423; 5431; 5432; 5434; 5440; 5457; 5462; 5470; 5486; 5491; 5505; 5513; 5516; 5525; 5532; 5546; 5552; 5594; 5599; 5601; 5603; 5616; 5618; 5624; 5627; 5630; 5643; 5645; 5652; 5654; 5660; 5669; 5673 and 5683.

Another preferred embodiment of the invention relates to a method for the in vitro and/or ex vivo determination of the benign or malignant state of a breast tumor in a biological sample from a subject as previously defined, by determining the variation of the expression of at least 43 determined genes of a group of determined genes represented by the nucleotidic sequences SEQ ID NO: 5419 to SEQ ID NO: 5693
  said 43 determined genes being represented by the following nucleotidic sequences:
  5486; 5491; 5499; 5505; 5513; 5516; 5520; 5525; 5532; 5546; 5549; 5552; 5594; 5599; 5601; 5603; 5616; 5618; 5623; 5624; 5627; 5630; 5643; 5645; 5651; 5652; 5654; 5660; 5669; 5673; 5683 and 5686.

Another particular embodiment of the invention relates to a method for the in vitro and/or ex vivo determination of the benign or malignant state of a breast tumor in a biological sample from a subject as defined above, by determining the variation of the expression of at least 206 determined genes of a group of determined genes represented by the nucleotidic sequences SEQ ID NO: 5419 to SEQ ID NO: 5693
  said 206 determined genes being represented by the following nucleotidic sequences:
  SEQ ID Nos 5420; 5421; 5422; 5423; 5425; 5426; 5427; 5428; 5429; 5430; 5431; 5432; 5434; 5435; 5436; 5437; 5438; 5439; 5440; 5441; 5442; 5443; 5444; 5445; 5446; 5447; 5449; 5450; 5451; 5452; 5453; 5454; 5455; 5456; 5457; 5459; 5460; 5461; 5462; 5463; 5465; 5467; 5468; 5470; 5473; 5475; 5476; 5479; 5480; 5482; 5484; 5485; 5486; 5487; 5488; 5489; 5490; 5491; 5492; 5493; 5495; 5496; 5497; 5498; 5499; 5502; 5503; 5505; 5506; 5507; 5508; 5509; 5511; 5512; 5513; 5515; 5516; 5517; 5518; 5519; 5520; 5523; 5524; 5525; 5526; 5528; 5529; 5530; 5531; 5532; 5533; 5534; 5536; 5538; 5539; 5540; 5543; 5544; 5545; 5546; 5547; 5549; 5550; 5552; 5553; 5554; 5556; 5558; 5559; 5560; 5562; 5563; 5564; 5565; 5566; 5567; 5568; 5569; 5570; 5571; 5573; 5574; 5575; 5576; 5577; 5578; 5581; 5582; 5585; 5587; 5588; 5590; 5591; 5593; 5594; 5595; 5597; 5598; 5599; 5600; 5601; 5602; 5603; 5604; 5605; 5606; 5608; 5609; 5610; 5611; 5612; 5613; 5615; 5616; 5617; 5618; 5622; 5623; 5624; 5625; 5627; 5629; 5630; 5631; 5632; 5633; 5634; 5635; 5637; 5638; 5639; 5640; 5641; 5642; 5643; 5644; 5645; 5647; 5648; 5649; 5651; 5652; 5653; 5654; 5656; 5657; 5658; 5660; 5661; 5665; 5667; 5669; 5672; 5673; 5675; 5676; 5677; 5678; 5680; 5681; 5683; 5684; 5686; 5687; 5689 and 5692.

In another preferred embodiment, the invention discloses a method for the in vitro and/or ex vivo determination of the benign or malignant state of a breast tumor in a biological sample from a subject such as defined above, by determining the variation of the expression of 275 determined genes represented by the nucleotidic sequences SEQ ID NO: 5419 to SEQ ID NO: 5693.

Another particular embodiment of the invention relates to a method for the in vitro and/or ex vivo determination of the benign or malignant state of a breast tumor in a biological sample from a subject such as defined above, wherein said variant being represented by the nucleic acid sequences SEQ ID NO 4579 to SEQ ID NO 5418 and SEQ ID NO 5694, the correspondence between each variant and its corresponding gene being represented in Table 1A-E and Table 6.

In still another embodiment, the invention relates to a method for the in vitro and/or ex vivo determination of the benign or malignant state of a breast tumor in a biological sample from a subject as defined above, wherein target regions are characterized by the polynucleotide sequences SEQ ID NO 2939 to 4578, the each target region of each gene, and of each variant when they exist, being represented in Table 6.

In one other preferred embodiment, the invention relates to a method for the in vitro and/or ex vivo determination of the benign or malignant state of a breast tumor in a biological sample from a subject such as previously defined, wherein each polynucleotide probe contained in a polynucleotide probe set is represented by the nucleic acid sequence of the library consisting in SEQ ID NO 1 to SEQ ID NO 2938,
the correspondence between each polynucleotide probe and its corresponding target region, said target region corresponding to a gene and its variants when present, being represented in Table 6.

In another advantageous embodiment, the invention relates to a method for the in vitro and/or ex vivo determination of the benign or malignant state of a breast tumor in a biological sample from a subject, wherein the sub-group of genes is constituted by 12 to 259 genes chosen among the group consisting in SEQ ID NO 5419 to SEQ ID NO 5677.

In another embodiment, the invention discloses a method for the in vitro and/or ex vivo determination of the benign or malignant state of a breast tumor described above, wherein the sub-group of genes is constituted by the 259 genes of the group consisting in SEQ ID NO 5419 to SEQ ID NO 5677.

In a more particular embodiment, the invention relates to a method for the in vitro and/or ex vivo determination of the benign or malignant state of a breast tumor in a biological sample from a subject, wherein said set of polynucleotide probes are chosen among the group consisting in:

at least 50 polynucleotide probe sets, particularly at least 100 polynucleotide probe sets, more particularly at least 150 polynucleotide probes sets, more particularly at least 200 polynucleotide probe sets, more particularly at least 1228 polynucleotide probe sets and more particularly 1640 polynucleotide probe sets of the library of nucleic acid sequences consisting in SEQ ID NO 1 to SEQ ID NO 2938.

The sub-groups of 50, 100, 150, 200 polynucleotide probe sets are defined as the Top sub-groups allowing to determine the benign or malignant status of the tumor.

It is also disclosed in the invention that the multiplicity of probe sets can be constituted by at least 300 polynucleotide probe sets, more particularly at least 400 polynucleotide probe sets, more particularly at least 500 polynucleotide probe sets, more particularly at least 600 polynucleotide probe sets, more particularly at least 700 polynucleotide probe sets, more particularly at least 800 polynucleotide probe sets, more particularly at least 900 polynucleotide probe sets, more particularly at least 1000 polynucleotide probe sets, more particularly at least 1100 polynucleotide probe sets, more particularly at least 1228 polynucleotide probe sets, more particularly at least 1400 polynucleotide probe sets, and more particularly 1640 polynucleotide probe sets.

All the polynucleotide probes contained in the polynucleotide probe sets used in the method of the invention are chosen among a library of nucleic acid sequences consisting SEQ ID NO 1 to SEQ ID NO 2938.

In one embodiment, the invention discloses a method described above, wherein a variant of a given gene is chosen among the group of variants consisting in SEQ ID NO 4579 to SEQ ID NO 5418.

The method of the invention allows to detect the variation of expression genes, and their variants when they exist, said genes being characterized in that they consist in the nucleic acid sequences chosen among the group consisting in SEQ ID NO 5419 to SEQ ID NO 5677 and said variants being characterized in that they consist in the nucleic acid sequence chosen among the group consisting in SEQ ID NO 4579 to SEQ ID NO 5418.

In the invention, it is also disclosed a method for the in vitro and/or ex vivo determination of the benign or malignant state of a breast tumor, wherein the variation of expression of a gene, and/or at least one of its variants when present, said gene being chosen in the group consisting in SEQ ID NO 5419 to SEQ ID NO 5693, is Over represented (Up-regulated), or Under represented (Down-regulated).

Each gene expression, and expression of its variants if they exist, revealed by the method of the invention corresponds to an expression product of a gene of the group consisting in SEQ ID NO 5419 to SEQ ID NO 5693.

These variants are normally expressed in a subject non afflicted by breast cancer. These variants are also expressed in the biological of subject afflicted by benign breast cancer or malignant breast cancer. Each variant have a specific expression level corresponding to the state of the breast cancer. Each variant can then be overexpressed compare to the same variant expressed in a normal subject, or under expressed comparing to the same variant expressed in a normal subject.

The genes, and/or their variants are up-regulated, preferably when their expression levels are more than 1.7 fold higher than the expression levels of said genes in a patient non afflicted by a breast tumor, and significantly different (preferably with a significant coefficient value of less than 0.05). The genes, and/or their variants are down-regulated, preferably when their expression levels are less than 1.7 fold lower than the expression levels of said genes in a patient non afflicted by a breast tumor, and significantly different (preferably with a significant coefficient value of less than 0.05).

In a particular embodiment, the invention discloses a method described above, wherein the nucleic acid molecules from the biological sample of the subject are mRNA/or cDNA, said mRNA resulting from the expression of the genes consisting in SEQ ID NO 5419 to SEQ ID NO 5693, and/or at least one of their variants when present, represented by the nucleotidic sequences SEQ ID NO 4579 to SEQ ID NO 5418 and SEQ ID NO 5694.

In the invention, nucleic acid molecules are extracted from the biological sample of the subject, prior to be contacted with the set of polynucleotide probes, immobilized in a support.

The extraction and preparation of said nucleic acid molecules from the biological sample of the subject is made with a routine protocol commonly used by a skilled man in the art.

More particularly, the RNA are extracted from the biological sample, eventually, mRNA are isolated from the total RNA. In the case of the use of cDNA, mRNA are reverse-transcripted with a standard procedure.

The invention relates to a kit for the in vitro and/or ex vivo determination of benign or malignant status of a breast tumor, comprising:

a multiplicity as defined above, or a microarray as defined above.

The invention relates to a kit for the in vitro and/or ex vivo determination of benign or malignant status of a breast tumor, comprising the following group of polynucleotide probes:

SEQ ID NOs 136; 137; 138; 157; 158; 159; 167; 168; 169; 171; 172; 173; 177; 312; 313; 313; 314; 315; 316; 317; 324; 325; 326; 327; 328; 329; 330; 331; 333; 334; 335; 336; 339; 340; 341; 345; 346; 347; 348; 353; 360; 361; 364; 365; 366; 367; 368; 369; 370; 374; 375; 790; 791; 792; 793; 794; 795; 969; 972; 981; 1081; 1082; 1083; 1129; 1140; 1141; 1158; 1159; 1160; 1161; 1162; 1165; 1166; 1167; 1168; 1169; 1170; 1171; 1185; 1186; 1194; 1198; 1199; 1200; 1203; 1262; 1263; 1264; 1267; 1268; 1269; 1519; 1520; 1521; 1522; 1523; 1524; 1534; 1535; 1536; 1544; 1545; 1546; 1551; 1552; 1553; 1554; 1555; 1556; 1557; 2026; 2027; 2028; 2179; 2180 and 2181, preferably, wherein SEQ ID NOs 167; 168; 177; 312; 313; 327; 328; 329; 331; 364; 365; 366; 368; 370; 1185; 1186; 1194; 1523; 1524; 1551; 1552 and 1553 are present twice, SEQ ID NO 316 is present in three copies and SEQ ID NO 315 is present in 5 copies, or SEQ ID NO 120; 136; 137; 138; 154; 155; 156; 157; 158; 159; 167; 168; 169; 171; 172; 173; 174; 175; 176; 177; 312; 313; 314; 315; 316; 316; 317; 324; 325; 326; 327; 328; 329; 330; 331; 332; 333; 334; 335; 336; 337; 338; 339; 340; 341; 345; 346; 347; 348; 349; 350; 351; 352; 353; 354; 355; 356; 360; 361; 363; 364; 365; 366; 367;

368; 369; 370; 371; 374; 375; 376; 378; 379; 380; 381; 555; 556; 557; 558; 560; 561; 562; 566; 567; 788; 789; 790; 791; 792; 793; 794; 795; 800; 801; 802; 821; 822; 823; 969; 971; 972; 981; 1056; 1057; 1058; 1075; 1076; 1077; 1081; 1082; 1083; 1087; 1088; 1089; 1103; 1104; 1105; 1114; 1115; 1116; 1123; 1124; 1125; 1129; 1130; 1131; 1140; 1141; 1158; 1159; 1160; 1161; 1162; 1163; 1164; 1165; 1166; 1167; 1168; 1169; 1170; 1171; 1172; 1180; 1181; 1185; 1186; 1187; 1188; 1189; 1190; 1191; 1192; 1193; 1194; 1195; 1196; 1198; 1199; 1200; 1201; 1202; 1203; 1207; 1262; 1263; 1264; 1267; 1268; 1269; 1509; 1510; 1511; 1519; 1520; 1521; 1522; 1523; 1524; 1528; 1529; 1534; 1535; 1536; 1544; 1545; 1546; 1551; 1552; 1553; 1554; 1555; 1556; 1557; 1561; 1562; 1682; 1683; 1684; 1776; 1777; 1778; 2023; 2024; 2025; 2026; 2027; 2028; 2173; 2174; 2175; 2176; 2177; 2178; 2179; 2180; 2181; 2762; 2763; 2764; 2860; 2861; 2862; 2883; 2884 and 2885, preferably, wherein SEQ ID NOs 167; 168; 177; 312; 313; 316; 317; 327; 329; 330; 353; 361; 364; 365; 366; 367; 368; 369; 370; 821; 822; 823; 1129; 1164; 1185; 1186; 1187; 1188; 1189; 1203; 1523; 1551; 1552 and 1553 are present twice, SEQ ID NOs 328; 331; 1162; 1194; 1519; 1520; 1521 and 1524 are present in three copies and SEQ ID NO 315 is present in 6 copies, or SEQ ID NOs 4; 5; 6; 120; 136; 137; 138; 154; 155; 156; 157; 158; 159; 167; 168; 169; 171; 172; 173; 174; 175; 176; 177; 197; 248; 254; 255; 305; 306; 307; 312; 313; 314; 315; 316; 317; 324; 325; 326; 327; 328; 329; 330; 331; 332; 333; 334; 335; 336; 337; 338; 339; 340; 341; 345; 346; 347; 348; 349; 350; 351; 352; 353; 354; 355; 356; 360; 361; 362; 363; 364; 365; 366; 367; 367; 368; 369; 370; 371; 374; 375; 376; 377; 378; 379; 380; 381; 513; 514; 515; 552; 553; 554; 555; 556; 557; 558; 559; 560; 561; 562; 566; 567; 783; 784; 785; 788; 789; 790; 791; 792; 793; 794; 795; 796; 797; 798; 799; 800; 801; 802; 803; 804; 805; 806; 807; 808; 812; 813; 814; 818; 821; 822; 823; 968; 969; 970; 971; 972; 981; 1056; 1057; 1058; 1061; 1062; 1063; 1064; 1065; 1066; 1067; 1068; 1069; 1070; 1071; 1075; 1076; 1077; 1080; 1081; 1082; 1083; 1087; 1088; 1089; 1103; 1104; 1105; 1114; 1115; 1116; 1123; 1124; 1125; 1129; 1130; 1131; 1139; 1140; 1141; 1158; 1159; 1160; 1161; 1162; 1163; 1164; 1165; 1166; 1167; 1168; 1169; 1170; 1171; 1172; 1174; 1175; 1176; 1180; 1181; 1185; 1186; 1187; 1188; 1189; 1190; 1191; 1192; 1193; 1194; 1195; 1196; 1197; 1198; 1199; 1200; 1201; 1202; 1203; 1204; 1205; 1206; 1207; 1262; 1263; 1264; 1267; 1268; 1269; 1284; 1285; 1315; 1469; 1470; 1471; 1509; 1510; 1511; 1515; 1516; 1517; 1519; 1520; 1521; 1522; 1523; 1524; 1528; 1529; 1534; 1535; 1536; 1537; 1538; 1539; 1544; 1545; 1546; 1550; 1551; 1552; 1553; 1554; 1555; 1556; 1557; 1558; 1559; 1560; 1561; 1562; 1580; 1581; 1582; 1671; 1682; 1683; 1684; 1685; 1686; 1690; 1691; 1692; 1776; 1777; 1778; 1788; 1789; 1790; 1890; 1891; 1892; 1952; 1953; 1954; 1963; 2023; 2024; 2025; 2026; 2027; 2028; 2065; 2067; 2088; 2089; 2090; 2091; 2173; 2174; 2175; 2176; 2177; 2178; 2179; 2180; 2181; 2196; 2201; 2229; 2230; 2231; 2536; 2537; 2538; 2576; 2577; 2578; 2599; 2600; 2762; 2763; 2764; 2774; 2775; 2776; 2860; 2861; 2862; 2883; 2884 and 2885, preferably, wherein SEQ ID NOs 167; 168; 177; 312; 313; 317; 327; 329; 330; 353; 361; 363; 364; 365; 366; 369; 370; 371; 558; 567; 796; 797; 801; 806; 807; 808; 813; 814; 821; 822; 823; 969; 1056; 1057; 1058; 1129; 1141; 1163; 1164; 1185; 1186; 1187; 1188; 1189; 1199; 1203; 1469; 1470; 1471; 1523; 1551; 1552 and 1553 are present twice, SEQ ID NOs 316; 328; 331; 368; 788; 1194; 1519; 1520; 1521; 1524 are present in three copies, SEQ ID NO 1162 is present in 4 copies and SEQ ID NO 315 is present in 6 copies, or SEQ ID NOs 4; 5; 6; 120; 121; 122; 123; 130; 131; 132; 136; 137; 138; 154; 155; 156; 157; 158; 159; 167; 168; 169; 171; 172; 173; 174; 175; 176; 177; 195; 196; 197; 198; 199; 200; 248; 254; 255; 305; 306; 307; 312; 313; 314; 315; 316; 317; 324; 325; 326; 327; 328; 329; 330; 331; 332; 333; 334; 335; 336; 337; 338; 339; 340; 341; 345; 346; 347; 348; 349; 350; 351; 352; 353; 354; 355; 356; 360; 361; 362; 363; 364; 365; 366; 367; 368; 369; 370; 371; 374; 375; 376; 377; 378; 379; 380; 381; 513; 514; 515; 552; 553; 554; 555; 556; 557; 558; 559; 560; 561; 562; 563; 564; 565; 566; 567; 783; 784; 785; 788; 789; 790; 791; 792; 793; 794; 795; 796; 797; 798; 799; 800; 801; 802; 803; 804; 805; 806; 807; 808; 809; 810; 811; 812; 813; 814; 815; 816; 817; 818; 821; 822; 823; 824; 825; 826; 840; 841; 845; 846; 847; 868; 968; 969; 970; 971; 972; 973; 974; 975; 976; 977; 981; 1056; 1057; 1058; 1059; 1060; 1061; 1062; 1063; 1064; 1065; 1066; 1067; 1068; 1069; 1070; 1071; 1075; 1076; 1077; 1080; 1081; 1082; 1083; 1084; 1085; 1086; 1087; 1088; 1089; 1094; 1095; 1096; 1103; 1104; 1105; 1110; 1111; 1112; 1114; 1115; 1116; 1123; 1124; 1125; 1126; 1127; 1128; 1129; 1130; 1131; 1139; 1140; 1141; 1158; 1159; 1160; 1161; 1162; 1163; 1164; 1165; 1166; 1167; 1168; 1169; 1170; 1171; 1172; 1174; 1175; 1176; 1180; 1181; 1185; 1186; 1187; 1188; 1189; 1190; 1191; 1192; 1193; 1194; 1195; 1196; 1197; 1198; 1199; 1200; 1201; 1202; 1203; 1204; 1205; 1206; 1207; 1229; 1230; 1242; 1243; 1244; 1245; 1250; 1251; 1252; 1262; 1263; 1264; 1265; 1266; 1267; 1268; 1269; 1270; 1271; 1272; 1284; 1285; 1315; 1335; 1407; 1408; 1469; 1470; 1471; 1509; 1510; 1511; 1512; 1513; 1514; 1515; 1516; 1517; 1519; 1520; 1521; 1522; 1523; 1524; 1528; 1529; 1534; 1535; 1536; 1537; 1538; 1539; 1544; 1545; 1546; 1550; 1551; 1552; 1553; 1554; 1555; 1556; 1557; 1558; 1559; 1560; 1561; 1562; 1563; 1564; 1580; 1581; 1582; 1586; 1587; 1588; 1671; 1682; 1683; 1684; 1685; 1686; 1687; 1688; 1689; 1690; 1691; 1692; 1743; 1744; 1745; 1776; 1777; 1778; 1788; 1789; 1790; 1890; 1891; 1892; 1896; 1897; 1898; 1952; 1953; 1954; 1963; 1974; 2023; 2024; 2025; 2026; 2027; 2028; 2061; 2062; 2063; 2065; 2067; 2068; 2072; 2083; 2084; 2085; 2088; 2089; 2090; 2091; 2092; 2173; 2174; 2175; 2176; 2177; 2178; 2179; 2180; 2181; 2196; 2201; 2229; 2230; 2231; 2381; 2382; 2383; 2536; 2537; 2538; 2576; 2577; 2578; 2599; 2600; 2601; 2602; 2603; 2762; 2763; 2764; 2774; 2775; 2776; 2778; 2779; 2783; 2794; 2860; 2861; 2862; 2883; 2884 and 2885, preferably, wherein SEQ ID NOs 167; 168; 177; 312; 313; 317; 327; 329; 330; 353; 361; 363; 364; 365; 366; 367; 369; 370; 371; 558; 567; 796; 797; 801; 806; 807; 808; 813; 814; 821; 822; 823; 845; 968; 970; 972; 1056; 1057; 1058; 1085; 1114; 1115; 1116; 1123; 1124; 1125; 1129; 1141; 1163; 1164; 1185; 1186; 1187; 1188; 1189; 1199; 1203; 1523;

1551; 1552; 1553; 1557; 1586; 1587; 1588; 1952; 1953; 1954; 2088; 2090; 2091; 2762; 2763 and 2764 are present twice, SEQ ID NOs 316; 328; 331; 368; 788; 1284; 1285; 1469; 1470; 1471; 1519; 1520; 1521; 1524; 2065; 2067 and 2089 are present in three copies, SEQ ID NO 1194 is present in 4 copies and SEQ ID NOs 315 and 1162 are present in 6 copies, or
- the polynucleotide probes contained in said 1228 polynucleotide probe sets being represented in the first 1228 lines of the Table 7, or
- the nucleic acid sequence of the polynucleotide probes contained in said 1640 polynucleotide probe sets being represented in Table 7.

The invention also relates to
- a micro-array comprising the library of nucleic acid sequences consisting in SEQ ID NO 1 to SEQ ID NO 2938, or
- a multiplicity of polynucleotide probe sets chosen among the group consisting in:
  - a multiplicity of 1228 polynucleotide probe sets comprising nucleic acid sequences chosen among the group consisting in SEQ ID NO 1 to SEQ ID NO 2938, or
- a multiplicity of 200 polynucleotide probe sets comprising nucleic acid sequences consisting in SEQ ID NO 1 to SEQ ID NO 2938, or
- a multiplicity of 150 polynucleotide probe sets comprising nucleic acid sequences consisting in SEQ ID NO 1 to SEQ ID NO 2938, or
- a multiplicity of 100 polynucleotide probe sets comprising nucleic acid sequences consisting in SEQ ID NO 1 to SEQ ID NO 2938, and in particular consisting in SEQ ID NO 120, SEQ ID NO 138, SEQ ID NO 140, SEQ ID NO 154, SEQ ID NO 155, SEQ ID NO 156, SEQ ID NO 157, SEQ ID NO 159, SEQ ID NO 166, SEQ ID NO 167, SEQ ID NO 168, SEQ ID NO 169, SEQ ID NO 171, SEQ ID NO 173, SEQ ID NO 174, SEQ ID NO 175, SEQ ID NO 176, SEQ ID NO 177, SEQ ID NO 312, SEQ ID NO 314, SEQ ID NO 315, SEQ ID NO 317, SEQ ID NO 324, SEQ ID NO 326, SEQ ID NO 327, SEQ ID NO 328, SEQ ID NO 329, SEQ ID NO 330, SEQ ID NO 331, SEQ ID NO 331, SEQ ID NO 332, SEQ ID NO 333, SEQ ID NO 335, SEQ ID NO 336, SEQ ID NO 337, SEQ ID NO 338, SEQ ID NO 339, SEQ ID NO 341, SEQ ID NO 345, SEQ ID NO 347, SEQ ID NO 349, SEQ ID NO 350, SEQ ID NO 351, SEQ ID NO 352, SEQ ID NO 353, SEQ ID NO 354, SEQ ID NO 355, SEQ ID NO 356, SEQ ID NO 360, SEQ ID NO 361, SEQ ID NO 363, SEQ ID NO 364, SEQ ID NO 364, SEQ ID NO 366, SEQ ID NO 367, SEQ ID NO 369, SEQ ID NO 369, SEQ ID NO 371, SEQ ID NO 376, SEQ ID NO 378, SEQ ID NO 379, SEQ ID NO 380, SEQ ID NO 381, SEQ ID NO 555, SEQ ID NO 556, SEQ ID NO 557, SEQ ID NO 558, SEQ ID NO 560, SEQ ID NO 561, SEQ ID NO 562, SEQ ID NO 566, SEQ ID NO 567, SEQ ID NO 788, SEQ ID NO 789, SEQ ID NO 790, SEQ ID NO 792, SEQ ID NO 793, SEQ ID NO 795, SEQ ID NO 800, SEQ ID NO 801, SEQ ID NO 802, SEQ ID NO 821, SEQ ID NO 822, SEQ ID NO 823, SEQ ID NO 969, SEQ ID NO 971, SEQ ID NO 972, SEQ ID NO 981, SEQ ID NO 1056, SEQ ID NO 1057, SEQ ID NO 1058, SEQ ID NO 1075, SEQ ID NO 1076, SEQ ID NO 1077, SEQ ID NO 1081, SEQ ID NO 1083, SEQ ID NO 1087, SEQ ID NO 1088, SEQ ID NO 1089, SEQ ID NO 1103, SEQ ID NO 1104, SEQ ID NO 1105, SEQ ID NO 1114, SEQ ID NO 1115, SEQ ID NO 1116, SEQ ID NO 1123, SEQ ID NO 1124, SEQ ID NO 1125, SEQ ID NO 1129, SEQ ID NO 1130, SEQ ID NO 1131, SEQ ID NO 1140, SEQ ID NO 1141, SEQ ID NO 1142, SEQ ID NO 1143, SEQ ID NO 1151, SEQ ID NO 1158, SEQ ID NO 1159, SEQ ID NO 1162, SEQ ID NO 1163, SEQ ID NO 1163, SEQ ID NO 1164, SEQ ID NO 1165, SEQ ID NO 1166, SEQ ID NO 1167, SEQ ID NO 1169, SEQ ID NO 1170, SEQ ID NO 1171, SEQ ID NO 1172, SEQ ID NO 1172, SEQ ID NO 1180, SEQ ID NO 1181, SEQ ID NO 1185, SEQ ID NO 1186, SEQ ID NO 1187, SEQ ID NO 1188, SEQ ID NO 1189, SEQ ID NO 1189, SEQ ID NO 1190, SEQ ID NO 1191, SEQ ID NO 1192, SEQ ID NO 1193, SEQ ID NO 1194, SEQ ID NO 1195, SEQ ID NO 1196, SEQ ID NO 1198, SEQ ID NO 1200, SEQ ID NO 1201, SEQ ID NO 1202, SEQ ID NO 1203, SEQ ID NO 1207, SEQ ID NO 1262, SEQ ID NO 1264, SEQ ID NO 1267, SEQ ID NO 1269, SEQ ID NO 1509, SEQ ID NO 1510, SEQ ID NO 1511, SEQ ID NO 1519, SEQ ID NO 1520, SEQ ID NO 1520, SEQ ID NO 1521, SEQ ID NO 1522, SEQ ID NO 1523, SEQ ID NO 1524, SEQ ID NO 1524, SEQ ID NO 1528, SEQ ID NO 1529, SEQ ID NO 1534, SEQ ID NO 1536, SEQ ID NO 1544, SEQ ID NO 1546, SEQ ID NO 1551, SEQ ID NO 1553, SEQ ID NO 1554, SEQ ID NO 1556, SEQ ID NO 1557, SEQ ID NO 1561, SEQ ID NO 1562, SEQ ID NO 1682, SEQ ID NO 1683, SEQ ID NO 1684, SEQ ID NO 1776, SEQ ID NO 1777, SEQ ID NO 1778, SEQ ID NO 2023, SEQ ID NO 2024, SEQ ID NO 2025, SEQ ID NO 2026, SEQ ID NO 2028, SEQ ID NO 2173, SEQ ID NO 2174, SEQ ID NO 2175, SEQ ID NO 2176, SEQ ID NO 2177, SEQ ID NO 2178, SEQ ID NO 2179, SEQ ID NO 2181, SEQ ID NO 2762, SEQ ID NO 2763, SEQ ID NO 2764, SEQ ID NO 2860, SEQ ID NO 2861, SEQ ID NO 2862, SEQ ID NO 2883, SEQ ID NO 2884 and SEQ ID NO 2885, or
- a multiplicity of 50 polynucleotide probe sets comprising nucleic acid sequences consisting in SEQ ID NO 1 to SEQ ID NO 2938, and in particular consisting in SEQ ID NO 138, SEQ ID NO 140, SEQ ID NO 157, SEQ ID NO 159, SEQ ID NO 167, SEQ ID NO 168, SEQ ID NO 169, SEQ ID NO 171, SEQ ID NO 173, SEQ ID NO 177, SEQ ID NO 312, SEQ ID NO 314, SEQ ID NO 315, SEQ ID NO 317, SEQ ID NO 324, SEQ ID NO 326, SEQ ID NO 327, SEQ ID NO 329, SEQ ID NO 330, SEQ ID NO 331 SEQ ID NO 333, SEQ ID NO 335, SEQ ID NO 336, SEQ ID NO 339, SEQ ID NO 341, SEQ ID NO 345, SEQ ID NO 347, SEQ ID NO 353, SEQ ID NO 360, SEQ ID NO 361, SEQ ID NO 364, SEQ ID NO 366, SEQ ID NO 367, SEQ ID NO 369, SEQ ID NO 790, SEQ ID NO 792, SEQ ID NO 793, SEQ ID NO 795, SEQ ID NO 969, SEQ ID NO 972, SEQ ID NO 981, SEQ ID NO 1081, SEQ ID NO 1083, SEQ ID NO 1129, SEQ ID NO 1140, SEQ ID NO 1141, SEQ ID NO 1151, SEQ ID NO 1158, SEQ ID NO 1159, SEQ ID NO 1162, SEQ ID NO 1165, SEQ ID NO 1166, SEQ ID NO 1167, SEQ ID NO 1169, SEQ ID NO 1170, SEQ ID NO 1171, SEQ ID NO 1185, SEQ ID NO 1186, SEQ ID NO 1194, SEQ ID NO 1198, SEQ ID NO 1200, SEQ ID NO 1203, SEQ ID NO 1262, SEQ ID NO 1264, SEQ ID NO 1267, SEQ ID NO 1269, SEQ ID NO 1520, SEQ ID NO 1522, SEQ ID NO 1523, SEQ ID NO 1524, SEQ ID NO 1534, SEQ ID NO 1536, SEQ ID NO 1544, SEQ ID NO 1546, SEQ ID NO 1551, SEQ ID NO 1553, SEQ ID NO 1554, SEQ ID NO 1556, SEQ ID NO 1557, SEQ ID NO 2026, SEQ ID NO 2028, SEQ ID NO 2179 and SEQ ID NO 2181.

Preferably in the kit of the invention, the micro-array comprises 1228 polynucleotide probe sets that represent the best multiplicity of polynucleotide probe sets to characterize efficiently the benign or malignant status of the breast tumor of a subject.

Optionally, the kit of the invention may contain protocol and molecules to label nucleic acid molecules used to be contacted with the micro-array. Also, the kit of the invention may contain protocol and material for the extraction and purification of the nucleic acid molecules from the biological sample of a subject.

The contain of the kit is not limited to the described materials and protocols described above, and may contain any other material or procedures that can help a skilled man in the art to use the kit of the invention.

FIGS. 1 TO 6 ILLUSTRATE THE INVENTION

FIG. 1A represents a gene containing 3 exons, and its variants that lack at least one exon. T represents a Target region. The "bar code" associated to the presence or absence of a target region is indicated: 1=present; 0=absent.

FIG. 1B represents a gene containing 3 exons, and its variant that lacks one exon. T represents a Target region. The "bar code" associated to the presence or absence of a target region is indicated: 1=present; 0=absent.

FIG. 3A represents a gene having no variant and having one target region.

FIG. 3B represents a gene having no variant and having two target regions.

FIG. 3C represents a gene having one variant and having one target region.

FIG. 3D represents a gene having one variant and having two target regions.

FIG. 3E represents a gene having two variants and having two target regions.

FIG. 3F represents a gene having two variants and having three target regions.

FIG. 3G represents a gene having two variants and having three target regions, one of its target regions being in a configuration different in variant and gene.

Figure 4:
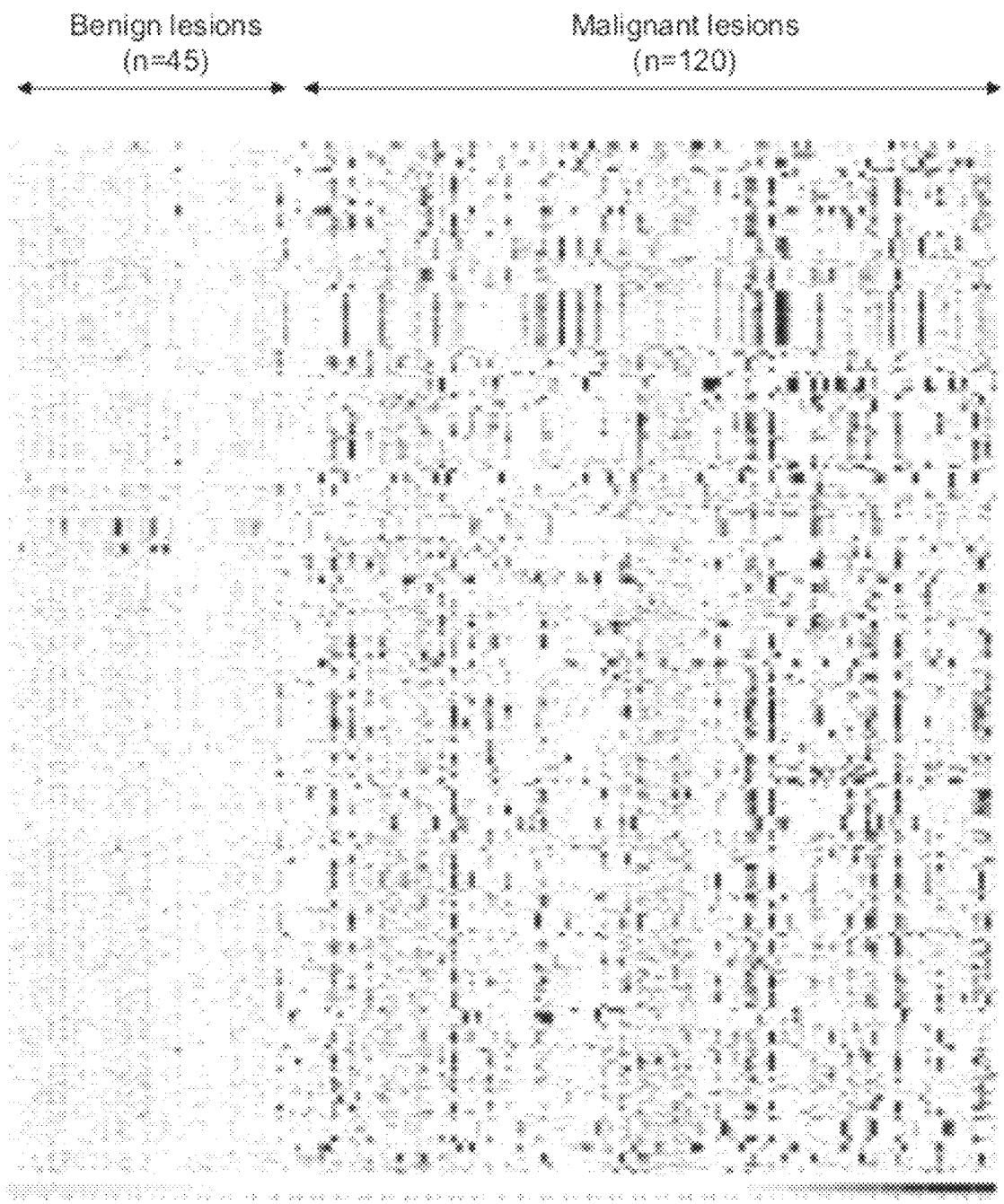

FIG. 4 represents Heatmap of the 1656 exon-probes that present a more than two fold higher intensity in malignant condition. The FIG. 4 reports the intensities of exon-probes that present more than a two-fold higher intensity in malignant tumors. Each column represents a sample, and each raw represent an exon-probe.

Figure 5:
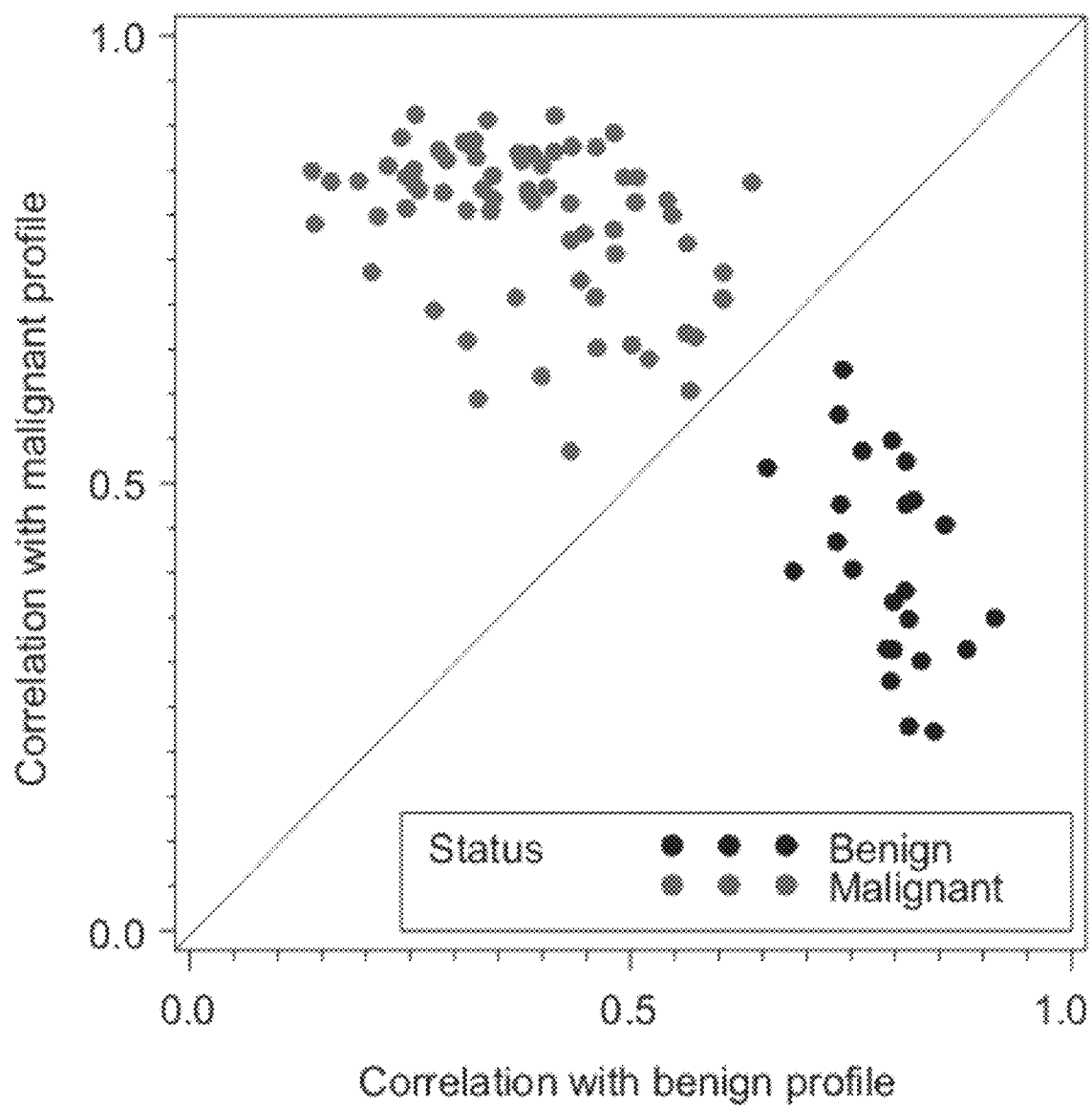

FIG. 5 represents the correlation of each specimen with the average benign and malignant profiles. Each tumor is classified according to its correlation with the average expressions of the probes in the benign and malignant group respectively during one leave-one-out-step. The bisecting line defines a region of benign prediction (bottom right triangle) and malignant prediction (upper left triangle). Tumors from the benign group are depicted in black, and those from the malignant group, in grey. Any misclassifications correspond to benign samples located in the malignant prediction area and vice versa. Training set included 94 samples (benign tumor, n=24, malignant tumor, n=70).

Figure 6:
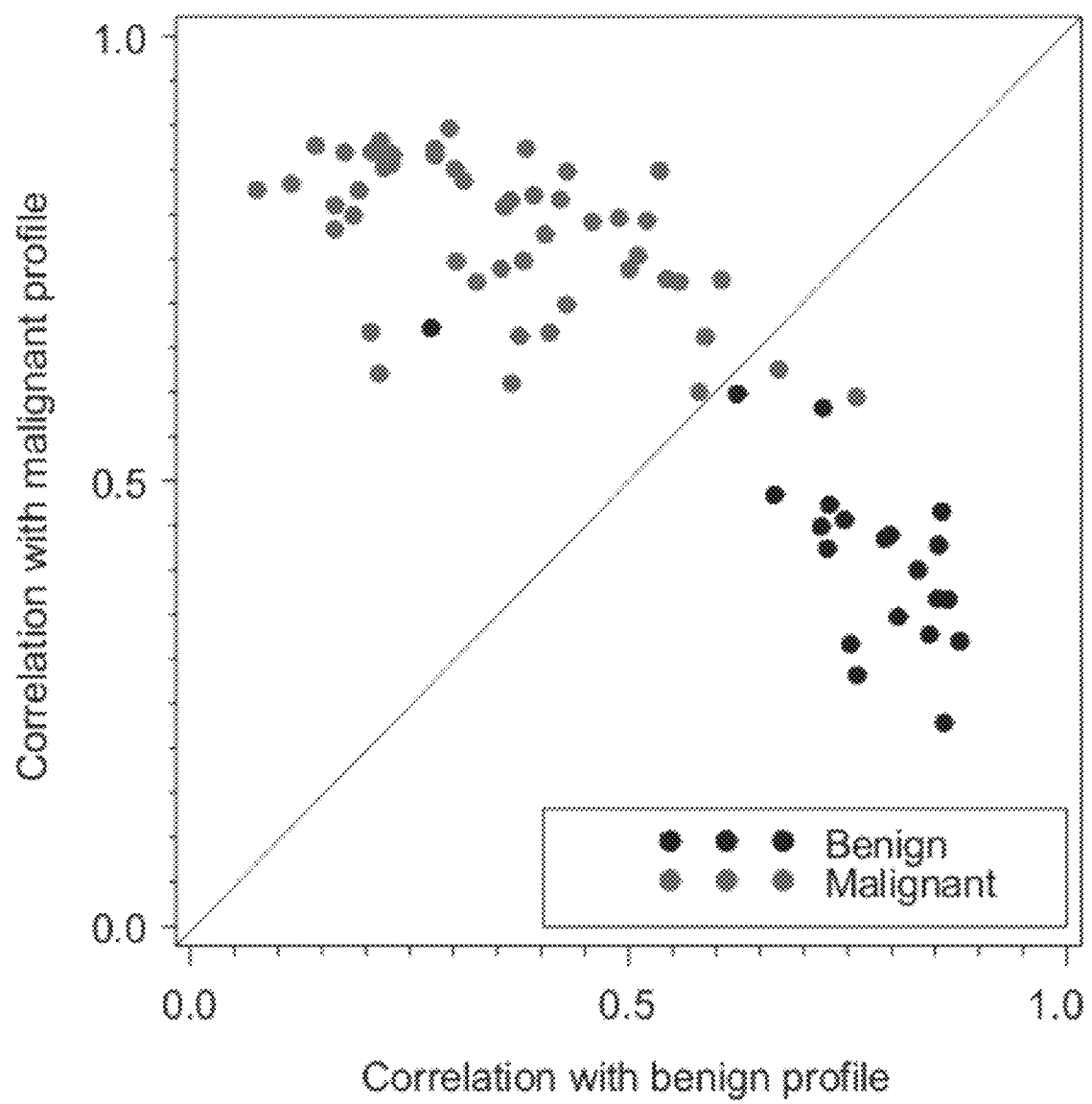

FIG. 6 represents the correlation of each specimen in the validation set with the average benign and malignant profiles of the preferred 1,228 signature polynucleotide probe sets obtained on the patients in the training set. Validation set included 71 samples (benign tumor, n=21, malignant tumor, n=50). Each tumor is classified according to its correlation with the average expressions of the probes in the benign and malignant profiles. The bisecting line defines a region of benign prediction (bottom right triangle) and malignant prediction (upper left triangle). Tumors from the benign group are depicted in black, and those from the malignant group, in grey. Any misclassifications correspond to benign samples located in the malignant prediction area and vice versa.

The following examples illustrate the invention, but the invention is not limited to these examples.

EXAMPLE I

Differentially Expressed Genes and Exons Between Malignant and Benign Breast Diseases 56652 probes (8%) presented a different intensity between malignant and benign conditions (adjusted p value<0.05). Of these, 37858 were exon-probes (B, T, and F) and 18794 were junction-probes (C, D, E). Of the 37858 exon-probes (B, T, F), 17441 were higher in malignant as opposed to benign diseases. The 17441 exon-probes (B, T, F) that were found higher in malignant condition referred to 12091 exons and 3391 genes. Of the 17441 exon-probes increased in malignant tumors, 1656 presented more than a two fold increased intensity in malignant conditions as compared to benign tumors. Heatmap of intensities for these 1656 probes is reported in FIG. 4. These 1656 probe sets referred to 1178 exons and 363 genes.

Figure 1:
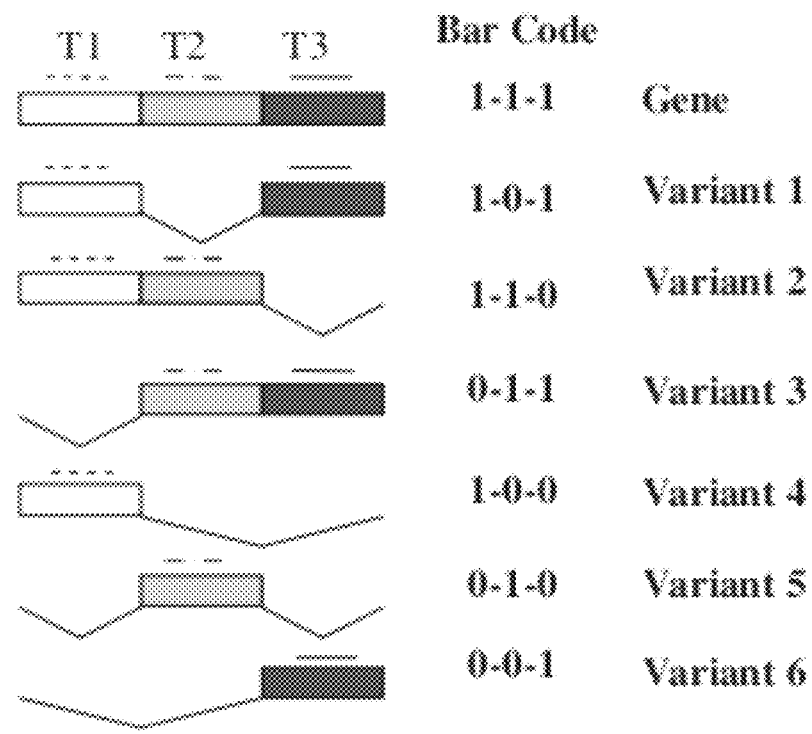
Figure 1:
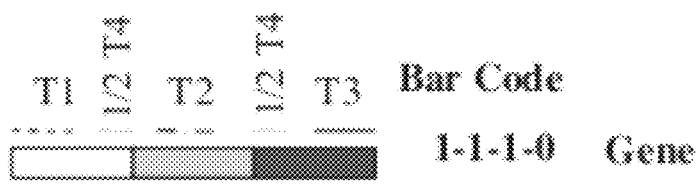
Figure 1:
Figure 2:
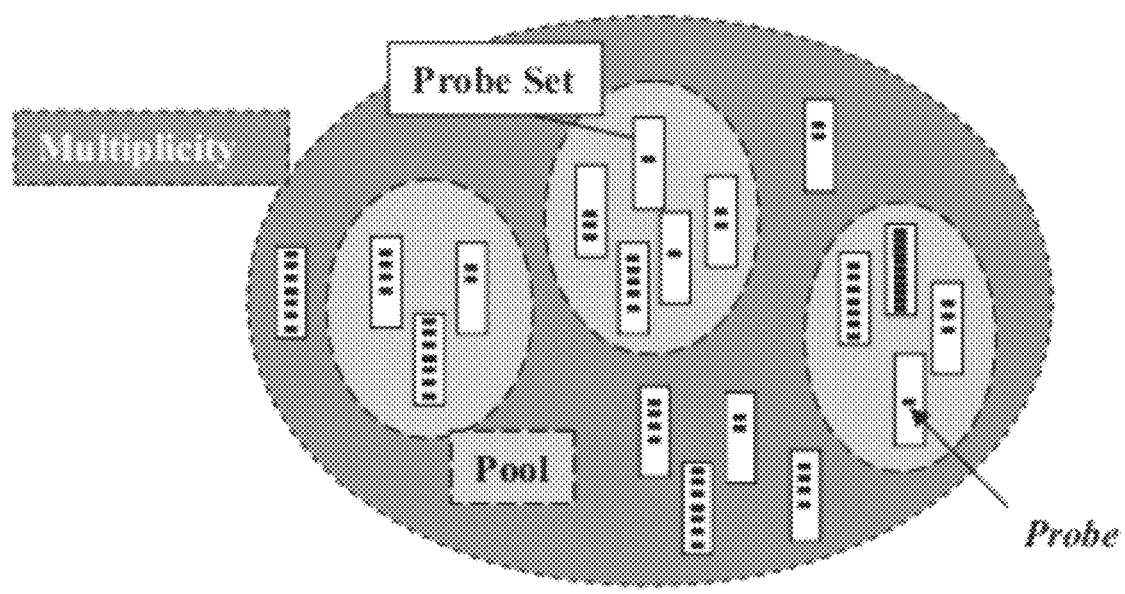
FIG. 2 represents the notions of multiplicity, pool, probe set and probes of the invention.
Figure 3:
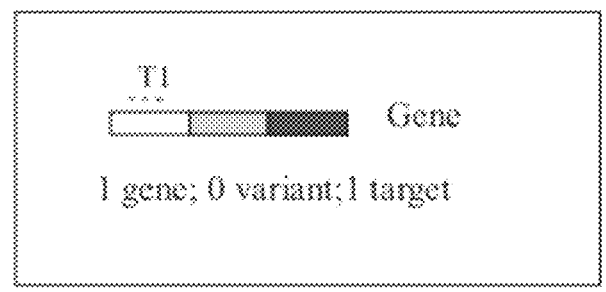
FIG. 3A to 3G represent the gene and its variant when they exist and the corresponding target region.
Figure 3:
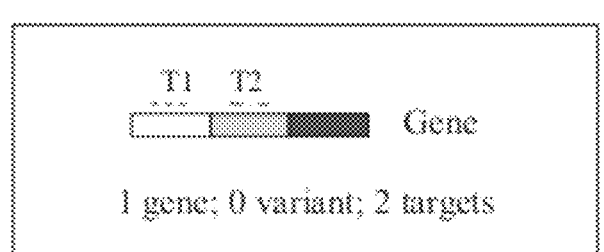
Figure 3:
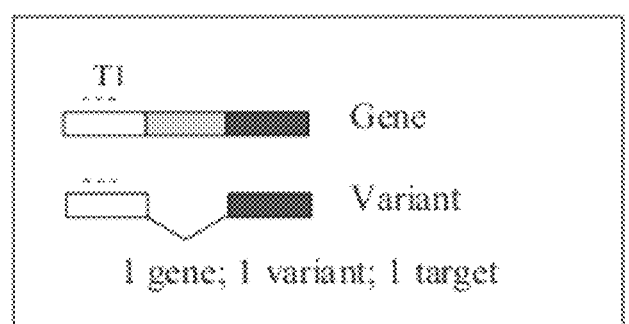
Figure 3:
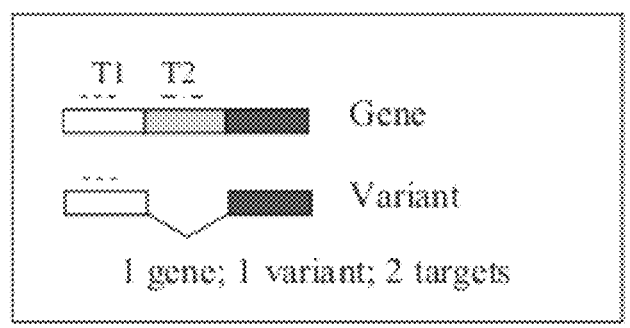
Figure 3:
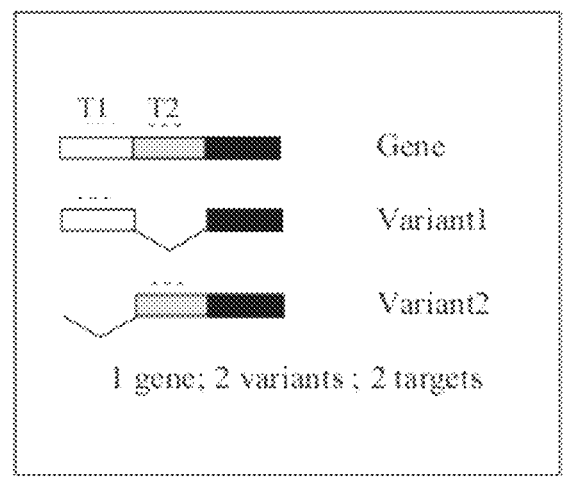
Figure 3:
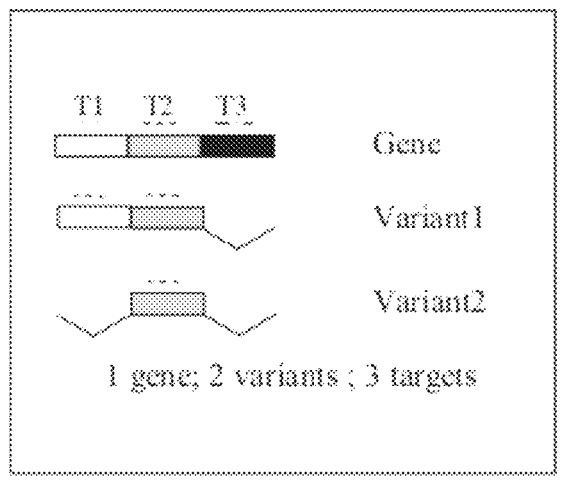
Figure 3:
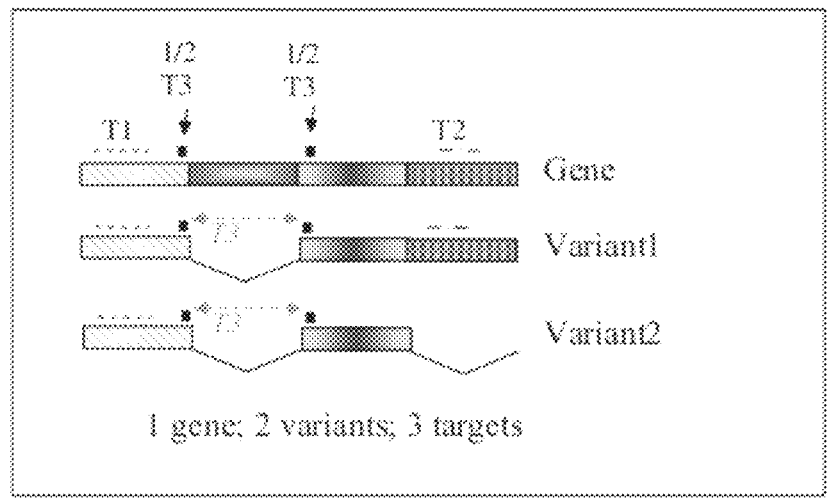

The level of gene expression was then determined as reported in patients and methods section. Among the 11921 filtered genes, 3733 were differentially expressed between cancer and benign conditions (adjusted p value <0.05). This accounts for 7% of the overall genes included in the array and 31% of the filtered genes. Of these, 1984 were overexpressed in malignant condition. Several of these genes are currently being targeted in therapeutics including TOP2A, VEGFA, AURKA, PARP1, RAS. Seventy-two genes presented more than a two fold increase of the mean value in breast cancer. As expected, a high proportion of these 72 highly overexpressed genes related to cell cycle activation and mitosis, including cyclins (CCNA2, CCNE2, CCNB2), cell division cycle family (CDC2, CKS1B, CKS2, NUF2), kinesin family members (KIF23, NDC80, KIF4A, KIF18A, MKLP2, KIF14) and centromere proteins (CENPF, CENPE). FIG. 3 reports the dotplots for gene expression of the top 10 overexpressed genes. Two (PTTG1, NET1) of the 10 most overexpressed genes were considered as potential new therapeutic targets given their oncogenic properties. Pathways analyses using Bio-Carta database identified 7 pathways that presented an enrichment of genes differentially expressed in one or the other condition. Interestingly, genes involved in spliceosome assembly were significantly enriched in malignant condition (LS permutations, p=0.001, KS permutations, p=0.002), suggesting an activation of this phenomenon in breast cancer.

Finally, the inventors identified 2675 exons (adjusted p value <0.05) overexpressed in malignant condition who were not located within the 1984 filtered genes whose geometric mean values differ between cancer and benign lesions. These 2675 exon-probes were located in 1559 genes. The splice index for the 2675 exon is reported in supplementary table 4. Numbers of these over-expressed exons located within unchanged genes have potential oncogenic properties. As illustration, probe sets for exon 9 casein kinase 1 delta (CSNK1D), exon 5-6 retinoblastoma binding protein 9 (RBBP9) and exon 21-22 Erbb2 interacting protein (ERBB2IP/LAP2) presented a 1.67 (adjusted p=0.005), 1.45 (adjusted p=0.006) and 1.6 (adjusted p=0.0005) fold increased intensity in malignant as compared to benign tumors. At the opposite, the geo mean ratio between cancer and benign tumors for gene expression levels were 1.09 (p=0.95), 1.04 (p=0.61) and 1.00 (p=0.96) for CSNK1D, RBBP9, ERBB2IP/LAP2 respectively. These findings suggest that a significant proportion of genes identified as unchanged may actually contain differentially expressed exons. These considerations suggest that analyses at exon level provide additional information to analyses at gene level, to decipher the transcriptional program of breast malignancy.

Based on the finding that breast cancer and benign tumors present widely different exonic profiles, the inventors developed a molecular classifier for breast cancer diagnosis on FNA samples.

EXAMPLE II

Development of a Molecular Classifier for Breast Cancer Diagnosis

Patients et Methods.

Patients.

94 patients have been included in the present study. These patients referred at the Institut Gustave Roussy for a clinical or radiological breast lesion in 2006. FNA was performed in all of these patients to assess the diagnosis of the breast lesion. A breast adenocarcinoma was diagnosed in 70 patients, and a benign lesion was diagnosed in 24 patients. Breast cancer diagnosis was based on the identification of cancer cells on the CNB or surgical specimen. The diagnosis of benign lesion was based on the identification of non-malignant epithelial cells on CNB and the identification of non-malignant epithelial cells in FNA sample together with lack of radiological change after 3 or 6 months follow-up. Patient characteristics are reported in Table 2.

TABLE 2

Table 2: patient characteristics

|  | Benign lesions (n = 24) | Malignant lesions (n = 70) |
|---|---|---|
| Median Age (range) | 41 (16-74) | 59 (30-92) |
| Median clinical size (range) | 17 mm (7-35) | 29 mm (7-110) |
| ACR classification | | |
| ACR3 | 14 (58%) | 0 |
| ACR4 | 9 (37%) | 13 (19%) |
| ACR5 | 1 (5%) | 56 (81%) |
| Not assessable | 1 | |
| Palpable lesion | | |
| Yes | 15 (65%) | 53 (78%) |
| NO | 8 (35%) | 15 (22%) |
| Not assessable | 1 | 2 |
| Pathological tumor size (range) | NA | 28 mm (6-60) |
| pTNM Stage | | |
| Node negative disease | | 27 (45%) |
| Node positive disease | NA | 20 (33%) |
| Stage IV disease | | 1 (2%) |
| Preoperative medical treatment | | 12 (20%) |
| Not assessable | | 10 |
| Tumor grade | | |
| Grade 1 | | 17 (27%) |
| Grade 2 | NA | 24 (37%) |
| Grade 3 | | 23 (36%) |
| Not Assessable | | 6 |
| Estogen receptor expression | | |
| ER negative | | 17 (25%) |
| ER positive | NA | 50 (75%) |
| Not assessable | | 3 |
| Progesteron receptor expression | | |
| PR negative | | 29 (43%) |
| PR positive | NA | 39 (57%) |
| Not assessable | | 3 |
| Her2 status | | |
| Overexpression | | 13 (20%) |
| Not overexpressed | NA | 53 (80%) |
| Not assessable | | 4 |

Sample Processing and Hybridization

RNA was extracted using RNEasy kit (Qiagen) from FNA specimen. Total RNA quality and quantity were evaluated using the RNA 6000 Nano LabChip kit with the Agilent 2100 Bioanalyzer.

Sample amplification and labeling was performed using the WT-Ovation Pico RNA Amplification System and the FL-Ovation cDNA Biotin Module v2 (NuGen, Inc., part #'s 3300-60 and 4200-60) according to manufacturer's instructions.

Standard methods following recommendations of the manufacturer were used to hybridize the samples. A pan-genomic array has been designed to detect 138,636 splicing events. 20,649 genes are analyzed using this array. The overall number of probes included in this array was 6,079,562. The present study was focused on 703,680 Evidenced probes. Once hybridized, the arrays were washed and stained using the FS450-0001 Fluidics protocol prior to scanning using the Affymetrix GeneChip® Scanner 3000 7G. .DAT and .CEL images were visually inspected for anomalies and accurate grid placement. The .CEL files were imported into Partek® Genomics Suite and the data were processed using the Robust Multichip Average (RMA) background correction method followed by GC content background correction. Quantile normalization was performed across all arrays, and then data was Log2 transformed and mean probe summarization was performed.

Normalization

Data were processed using the RMA background correction method followed by guanine-cytosine content background correction. Quantile normalization was performed across all arrays, and then data was log2 transformed and mean probe summarization was performed.

Pre-filtering

Starting from the 703,680 Evidenced probes, the inventors filtered out probes whose expression varied little across the 94 patient training set as follows: first the inventors floored the expression values at 10 (i.e. all expression values lower than 10 were replaced by 10), and secondly they deleted a probe from the data set if the ratio of the maximum by minimum intensity across the 94-patient set was higher or equal to 5 and if the difference between the maximum and minimum intensity was higher or equal to 100. In total 176,832 probes were retained for analysis after the pre-filtering step.

Statistical Analysis

The point biserial correlation coefficient was calculated for each probe between probe expression and a binary indicator which value was defined by the status of the patient (the indicator took the value 0 in patients who had benign tissue and the value 1 in tissues from patients with tumors) (Kraemer H C: Biserial correlation, in Encyclopedia of Statistical Science, Vol 1. Edited by Kotz S, Read C B. New York, Wiley, 1982, pp 276-280). The probes with the highest absolute correlation are those which are the most likely correlated with the occurrence of a tumor. The inventors used the t-test to test whether the point biserial correlation values were significantly different from 0 (Kraemer HC: Biserial correlation, in Encyclopedia of Statistical Science, Vol 1. Edited by Kotz S, Read C B. New York, Wiley, 1982, pp 276-280). In order to take the multiple testing issues into account they used a very stringent cut-off for statistical significance: 10e-8 (1 out of 100 million).

In order to develop a prediction rule to classify tissues from new patients with unknown status (benign vs. malignant), the inventors chose the nearest centroid prediction rule, which has been intensively studied on data from several microarray studies (S. Michiels, S. Koscielny, C. Hill. Prediction of cancer outcome with microarrays: a multiple random validation strategy. Lancet 2005; 365:488-92). This prediction rule classifies new patients according to the Pearson correlation between the expression of their signature probes and the average profiles in the two categories (the average benign and malignant profiles are defined as the vector of the average expression values of the signature probes in patients with benign and malignant tissues of the 94 patient training set), the predicted category being the one with the highest Pearson correlation. The signature probes were defined as those probes for which the p-value of test of significance of the point biserial correlation coefficient with the benign vs. malignant status was below a particular threshold.

Leave-one-out cross-validation was used to estimate the prediction accuracy of the prediction rule. One sample is left out, and the remaining samples are used to build the prediction rule, which is then used to classify the left-out sample. The entire model-building process was repeated for each leave-one-out training set to provide unbiased estimates of the prediction accuracy (Ntzani E E, Ioannidis J P. Predictive ability of DNA microarrays for cancer outcomes and correlates: an empirical assessment. Lancet 2003; 362: 1439-44; Simon R, Radmacher M D, Dobbin K, McShane L M. Pitfalls in the use of DNA microarray data for diagnostic and prognostic classification. J Natl Cancer Inst 2003; 95: 14-8): correlation coefficients were recalculated, ordered according to their absolute value, the signature probes defined and the nearest centroid prediction rule was constructed. Then, the inventors predicted the outcome of the one sample they left out in the first place based on the highest correlation coefficient it had with the average benign and the malignant profile from the 93 other samples. At the end of the leave-one-out cross-validation procedure, the inventors counted in how many cases the predictions were correct and in how many cases the predictions were incorrect.

The inventors repeated the above performance evaluation procedure based on leave-one-out cross-validation for different p-value thresholds for signature genes in order to find an optimal prediction rule yielding the lowest number of misclassified patients. They tried the following four p-values thresholds to define the signature genes: 10e-11, 10e-10, 10e-09 and 10e-8.

The inventors also provide subsets of 50, 100, 150 and 200 polynucleotide probe sets whose expression can be used to classify the benign and malignant status of tissues of new patients.

Results:

The inventors found 1,640 Evidenced polynucleotide probe sets that were significantly associated with malignancy at the stringent p-value cut-off of p<10e-8 (see Table 3). The polynucleotide probe sets with positive correlation are those which have increased expression in malignant tissues, those with negative correlation have increased expression in the benign tissues.

The inventors developed an optimal prediction rule based on the methodology explained above. The preferred p-value threshold for defining signature genes was p<10e-9. This p-value threshold corresponds to the first 1228 polynucleotide probe sets in Table 3 (with identifier no 1 to no 1228). When using leave-one-out cross-validation to estimated the prediction accuracy of the prediction rule with this particular threshold, they obtained 0 out of 24 patients (0%) with benign status that were misclassified and 0 out of 70 patients with malignant status that were misclassified (0%). This corresponds to a sensitivity of 100% and a specificity of 100%.

TABLE 3

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 1 | 1756.022.2-C_at | −0.91151 | 0.91150698 | 21.25746 | <1e-16 | 1756.022. | NM_000109.2 | CQ714747.1 | GENBANK_PATENT | 1 |
| 2 | 1756.029.1-D_at | −0.89254 | 0.89253605 | 18.98306 | <1e-16 | 1756.029. | NM_000109.2 | BI551231.1 | EST | 1 |
| 3 | 1756.026.1-C_at | −0.89221 | 0.8922081 | 18.94884 | <1e-16 | 1756.026. | NM_000109.2 | M63075.1 | mRNA | 1 |
| 4 | 1756.022.4-T_at | −0.87666 | 0.87666398 | 17.47788 | <1e-16 | 1756.022. | NM_000109.2 | CQ714747.1 | GENBANK_PATENT | 1 |
| 5 | 1756.011.1-B_at | −0.87581 | 0.87581182 | 17.40484 | <1e-16 | 1756.011. | NM_000109.2 | AX114289.1 | GENBANK_PATENT | 1 |
| 6 | 1308.008.1-C_at | −0.86492 | 0.86492412 | 16.52922 | <1e-16 | 1308.008. | NM_130778.1 | BE148646.1 | EST | 1 |
| 7 | 1756.022.3-F_at | −0.84937 | 0.84936983 | 15.43558 | <1e-16 | 1756.022. | NM_000109.2 | CQ714747.1 | GENBANK_PATENT | 1 |
| 8 | 3861.020.1-D_at | −0.84359 | 0.84358795 | 15.06806 | <1e-16 | 3861.020. | NM_000526.3 | BM018298.1 | EST | 1 |
| 9 | 1756.011.1-F_at | −0.83903 | 0.83903098 | 14.7913 | <1e-16 | 1756.011. | NM_000109.2 | AX114289.1 | GENBANK_PATENT | 1 |
| 10 | 4629.007.1-F_at | −0.83653 | 0.83653075 | 14.64397 | <1e-16 | 4629.007. | NM_022844.1 | AY520817.1 | mRNA | 16 |
| 11 | 1756.022.4-B_at | −0.83558 | 0.83557952 | 14.58872 | <1e-16 | 1756.022. | NM_000109.2 | CQ714747.1 | GENBANK_PATENT | 1 |
| 12 | 1756.024.1-F_at | −0.83305 | 0.83304555 | 14.44365 | <1e-16 | 1756.024. | NM_000109.2 | CD299688.1 | EST | 1 |
| 13 | 3861.019.1-T_at | −0.83092 | 0.83091678 | 14.32409 | <1e-16 | 3861.019. | NM_000526.3 | BQ359236.1 | EST | 1 |
| 14 | 1756.026.1-T_at | −0.83005 | 0.83004684 | 14.27581 | <1e-16 | 1756.026. | NM_000109.2 | M63075.1 | mRNA | 1 |
| 15 | 1756.022.1-B_at | −0.82986 | 0.8298586 | 14.26541 | <1e-16 | 1756.022. | NM_000109.2 | CQ714747.1 | GENBANK_PATENT | 1 |
| 16 | 3861.013.1-T_at | −0.82888 | 0.82888471 | 14.21185 | <1e-16 | 3861.013. | NM_000526.3 | BG677893.1 | EST | 1 |
| 17 | 3861.001.1-B_at | −0.82731 | 0.82731458 | 14.12635 | <1e-16 | 3861.001. | NM_130778.1 | BE148646.1 | EST | 1 |
| 18 | 4629.020.1-C_at | −0.82454 | 0.82453945 | 13.97781 | <1e-16 | 4629.020. | NM_022844.1 | BI819760.1 | EST | 1 |
| 19 | 1756.027.1-T_at | −0.82281 | 0.82280868 | 13.88676 | <1e-16 | 1756.027. | NM_000109.2 | S60971.1 | mRNA | 1 |
| 20 | 3861.013.1-T_at | −0.82153 | 0.82153279 | 13.82042 | <1e-16 | 3861.013. | NM_000526.3 | BM563823.1 | EST | 1 |
| 21 | 4629.020.1-D_at | −0.8194 | 0.81940128 | 13.71099 | <1e-16 | 4629.020. | NM_022844.1 | BI819760.1 | EST | 1 |
| 22 | 3861.001.1-B_at | −0.81782 | 0.8178189 | 13.63089 | <1e-16 | 3861.001. | NM_000526.3 | BG677893.1 | EST | 1 |
| 23 | 1756.022.4-F_at | −0.81687 | 0.81686612 | 13.5831 | <1e-16 | 1756.022. | NM_000109.2 | CQ714747.1 | GENBANK_PATENT | 1 |
| 24 | 1756.026.1-F_at | −0.81627 | 0.81626518 | 13.55314 | <1e-16 | 1756.026. | NM_000109.2 | M63075.1 | mRNA | 1 |
| 25 | 1756.022.2-T_at | −0.81571 | 0.815705 | 13.52532 | <1e-16 | 1756.022. | NM_000109.2 | CQ714747.1 | GENBANK_PATENT | 1 |
| 26 | 1756.022.2-F_at | −0.81498 | 0.8149825 | 13.48962 | <1e-16 | 1756.022. | NM_000109.2 | CQ714747.1 | GENBANK_PATENT | 1 |
| 27 | 3861.022.1-B_at | −0.81494 | 0.81494272 | 13.48766 | <1e-16 | 3861.022. | NM_000526.3 | BI085500.1 | EST | 1 |
| 28 | 3868.004.1-D_at | −0.81412 | 0.81412336 | 13.4474 | <1e-16 | 3868.004. | NM_055557.2 | BM045170.1 | EST | 1 |
| 29 | 4629.015.1-C_at | −0.81348 | 0.81347687 | 13.41581 | <1e-16 | 4629.015. | NM_022844.1 | DB284318.1 | EST | 1 |
| 30 | 6422.002.1-E_at | −0.81346 | 0.81346311 | 13.41514 | <1e-16 | 6422.002. | NM_003012.3 | AX565729.1 | GENBANK_PATENT | 3 |
| 31 | 3861.001.1-D_at | −0.81115 | 0.81115184 | 13.30339 | <1e-16 | 3861.001. | NM_000526.3 | BG677893.1 | EST | 1 |
| 32 | 1756.022.1-F_at | −0.81112 | 0.81111566 | 13.30165 | <1e-16 | 1756.022. | NM_000109.2 | CQ714747.1 | GENBANK_PATENT | 1 |
| 33 | 1308.003.1-T_at | −0.80635 | 0.80635142 | 13.07706 | <1e-16 | 1308.003. | NM_130778.1 | NM_000494.2 | REFSEQ | 19 |
| 34 | 3868.005.1-B_at | −0.8061 | 0.80610095 | 13.06545 | <1e-16 | 3868.005. | NM_055557.2 | BG682632.1 | EST | 1 |
| 35 | 1308.007.1-F_at | −0.8044 | 0.80440011 | 12.98719 | <1e-16 | 1308.007. | NM_130778.1 | BF916393.1 | EST | 1 |
| 36 | 1308.009.1-F_at | −0.8039 | 0.80390038 | 12.96437 | <1e-16 | 1308.009. | NM_130778.1 | DA425187.1 | EST | 1 |
| 37 | 3861.007.1-E_at | −0.8038 | 0.80380368 | 12.95997 | <1e-16 | 3861.007. | NM_000526.3 | BG682207.1 | EST | 11 |
| 38 | 4629.016.1-D_at | −0.80378 | 0.80377953 | 12.95887 | <1e-16 | 4629.016. | NM_022844.1 | DB289769.1 | EST | 1 |
| 39 | 3084.007.1-F_at | −0.80131 | 0.80130924 | 12.84728 | <1e-16 | 3084.007. | NM_013957.1 | CN603653.1 | EST | 3 |
| 40 | 3861.007.1-F_at | −0.79968 | 0.79968463 | 12.77489 | <1e-16 | 3861.007. | NM_000526.3 | BG682207.1 | EST | 11 |
| 41 | 26289.003.1-E_at | −0.79508 | 0.7950811 | 12.57397 | <1e-16 | 26289.003. | NM_174858.1 | AK090967.1 | mRNA | 3 |
| 42 | 1756.028.1-T_at | −0.79389 | 0.79388677 | 12.52282 | <1e-16 | 1756.028. | NM_000109.2 | CQ733377.1 | GENBANK_PATENT | 1 |
| 43 | 4629.021.1-E_at | −0.7935 | 0.79350334 | 12.50648 | <1e-16 | 4629.021. | NM_022844.1 | CQ717811.1 | GENBANK_PATENT | 1 |
| 44 | 4629.020.1-D_at | −0.78948 | 0.78947575 | 12.33726 | <1e-16 | 4629.020. | NM_022844.1 | BI819760.1 | EST | 1 |
| 45 | 5764.001.1-F_at | −0.78733 | 0.78733221 | 12.24894 | <1e-16 | 5764.001. | NM_002825.5 | AX135902.1 | GENBANK_PATENT | 3 |
| 46 | 3815.002.3-F_at | −0.78506 | 0.78505901 | 12.15655 | <1e-16 | 3815.002. | NM_000222.1 | CQ719901.1 | GENBANK_PATENT | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 47 | 3852.020.1-T_at | −0.78181 | 0.78181405 | 12.02688 | <1e-16 | 3852.020. | NM_000424.2 | DA764792.1 | EST | 1 |
| 48 | 4629.007.1-E_at | −0.78063 | 0.78063131 | 11.98024 | <1e-16 | 4629.007. | NM_022844.1 | AY520817.1 | mRNA | 16 |
| 49 | 128553.003.1-F | −0.78062 | 0.78061872 | 11.97975 | <1e-16 | 128553.00 | NM_173485.2 | BP394387.1 | EST | 1 |
| 50 | 26289.003.1-F_at | −0.78004 | 0.78004 | 11.95705 | <1e-16 | 26289.003 | NM_174858.1 | AK090967.1 | GENBANK_PATENT | 3 |
| 51 | 3815.002.2-F_at | −0.77826 | 0.77825678 | 11.88761 | <1e-16 | 3815.002. | NM_000222.1 | CQ719901.1 | EST | 1 |
| 52 | 1756.029.1-B_at | −0.77795 | 0.77795132 | 11.87578 | <1e-16 | 1756.029. | NM_000109.2 | BI551231.1 | EST | 1 |
| 53 | 4629.005.1-E_at | −0.7779 | 0.77790413 | 11.87396 | <1e-16 | 4629.005. | NM_022844.1 | CB963138.1 | EST | 3 |
| 54 | 4629.010.1-B_at | −0.77786 | 0.77786129 | 11.8723 | <1e-16 | 4629.010. | NM_022844.1 | AI285326.1 | EST | 1 |
| 55 | 6422.001.1-T_at | −0.77686 | 0.77685589 | 11.83356 | <1e-16 | 6422.001. | NM_003012.3 | CQ850220.1 | GENBANK_PATENT | 2 |
| 56 | 5764.001.1-E_at | −0.77561 | 0.77560627 | 11.78573 | <1e-16 | 5764.001. | NM_002825.5 | AX135902.1 | GENBANK_PATENT | 3 |
| 57 | 3861.008.1-F_at | −0.77548 | 0.77547795 | 11.78084 | <1e-16 | 3861.008. | NM_000526.3 | BE184532.1 | EST | 1 |
| 58 | 1756.030.2-T_at | −0.77479 | 0.77478755 | 11.75458 | <1e-16 | 1756.030. | NM_000109.2 | BM929495.1 | EST | 2 |
| 59 | 3084.009.1-B_at | −0.77277 | 0.77277347 | 11.67858 | <1e-16 | 3084.009. | NM_013957.1 | U02327.1 | mRNA | 2 |
| 60 | 26289.002.1-T_at | −0.7720 | 0.7720739 | 11.65239 | <1e-16 | 26289.002 | NM_174858.1 | BF966377.1 | EST | 1 |
| 61 | 1756.022.5-B_at | −0.77137 | 0.77136743 | 11.62604 | <1e-16 | 1756.022. | NM_000109.2 | CQ714747.1 | GENBANK_PATENT | 16 |
| 62 | 4629.007.1-D_at | −0.77091 | 0.77091122 | 11.60908 | <1e-16 | 4629.007. | NM_022844.1 | AY520817.1 | mRNA | 1 |
| 63 | 23336.001.1-C_at | −0.76979 | 0.76978838 | 11.56754 | <1e-16 | 23336.001 | NM_145728.1 | AJ697971.1 | mRNA | 19 |
| 64 | 1308.003.1-D_at | −0.76831 | 0.7683088 | 11.5132 | <1e-16 | 1308.003. | NM_130778.1 | NM_000494.2 | REFSEQ | 1 |
| 65 | 1756.022.3-T_at | −0.76731 | 0.76730759 | 11.47668 | <1e-16 | 1756.022. | NM_000109.2 | CQ714747.1 | GENBANK_PATENT | 1 |
| 66 | 3861.020.1-T_at | −0.76715 | 0.76714705 | 11.47084 | <1e-16 | 3861.020. | NM_000526.3 | BM018298.1 | EST | 1 |
| 67 | 3861.022.1-C_at | −0.76448 | 0.76448457 | 11.37481 | <1e-16 | 3861.022. | NM_000526.3 | BI085500.1 | EST | 1 |
| 68 | 3852.012.2-B_at | −0.76294 | 0.76294046 | 11.31975 | <1e-16 | 3861.012. | NM_000424.2 | CQ733668.1 | GENBANK_PATENT | 1 |
| 69 | 26289.012.1-E_at | −0.76192 | 0.76191947 | 11.28361 | <1e-16 | 26289.012 | NM_174858.1 | BG189938.1 | EST | 1 |
| 70 | 23336.003.1-T_at | −0.76122 | 0.76122392 | 11.2591 | <1e-16 | 23336.003 | NM_145728.1 | CQ723645.1 | GENBANK_PATENT | 1 |
| 71 | 26289.007.1-B_at | −0.76082 | 0.76081931 | 11.24888 | <1e-16 | 26289.007 | NM_174858.1 | DA259560.1 | EST | 1 |
| 72 | 84417.001.1-T_at | −0.76076 | 0.76075848 | 11.24275 | <1e-16 | 84417.001 | NM_032411.1 | BI561114.1 | EST | 1 |
| 73 | 3861.018.1-D_at | −0.7605 | 0.76050387 | 11.23382 | <1e-16 | 3861.018. | NM_000526.3 | BM019687.1 | EST | 1 |
| 74 | 3852.004.1-B_at | −0.76039 | 0.76038766 | 11.22975 | <1e-16 | 3852.004. | NM_000424.2 | BE715131.1 | EST | 1 |
| 75 | 90865.006.1-B_at | −0.76035 | 0.76035315 | 11.22855 | <1e-16 | 90865.006 | NM_033439.2 | AV707946.1 | EST | 1 |
| 76 | 4629.021.1-F_at | −0.76012 | 0.7601167 | 11.22027 | <1e-16 | 4629.021. | NM_022844.1 | CQ717811.1 | GENBANK_PATENT | 16 |
| 77 | 3861.018.1-T_at | −0.76002 | 0.76001693 | 11.21679 | <1e-16 | 3861.018. | NM_000526.3 | BM019687.1 | EST | 1 |
| 78 | 1756.022.1-T_at | −0.75998 | 0.75998388 | 11.21563 | <1e-16 | 1756.022. | NM_000109.2 | CQ714747.1 | GENBANK_PATENT | 1 |
| 79 | 1264.003.1-B_at | −0.75956 | 0.75955538 | 11.20068 | <1e-16 | 1264.003. | NM_001299.4 | CV811526.1 | EST | 1 |
| 80 | 26289.010.1-E_at | −0.7591 | 0.75909546 | 11.18467 | <1e-16 | 26289.010 | NM_174858.1 | AX988359.1 | GENBANK_PATENT | 1 |
| 81 | 3861.001.1-F_at | −0.75842 | 0.75842235 | 11.16131 | <1e-16 | 3861.001. | NM_000526.3 | BG677893.1 | EST | 1 |
| 82 | 1908.002.1-T_at | −0.75841 | 0.75841175 | 11.16094 | <1e-16 | 1908.002. | NM_207032.1 | NM_207033.1 | REFSEQ | 8 |
| 83 | 4629.007.1-C_at | −0.75757 | 0.75757437 | 11.132 | <1e-16 | 4629.007. | NM_022844.1 | AY520817.1 | mRNA | 16 |
| 84 | 1756.022.5-T_at | −0.75733 | 0.75732729 | 11.12348 | <1e-16 | 1756.022. | NM_000109.2 | CQ714747.1 | GENBANK_PATENT | 1 |
| 85 | 3815.002.4-B_at | −0.75611 | 0.75610941 | 11.08167 | <1e-16 | 3815.002. | NM_000222.1 | CQ719901.1 | GENBANK_PATENT | 1 |
| 86 | 1756.022.2-B_at | −0.75476 | 0.75476064 | 11.03568 | <1e-16 | 1756.022. | NM_000109.2 | CQ714747.1 | GENBANK_PATENT | 1 |
| 87 | 1756.027.1-B_at | −0.75441 | 0.75441365 | 11.0239 | <1e-16 | 1756.027. | NM_000109.2 | S60971.1 | mRNA | 1 |
| 88 | 3852.008.2-T_at | −0.75435 | 0.75434944 | 11.02172 | <1e-16 | 3852.008. | NM_000424.2 | BG675837.1 | EST | 1 |
| 89 | 6422.001.1-E_at | −0.75383 | 0.75383168 | 11.00419 | <1e-16 | 6422.001. | NM_003012.3 | CQ850220.1 | GENBANK_PATENT | 2 |
| 90 | 3861.022.1-F_at | −0.75247 | 0.75247162 | 10.95837 | <1e-16 | 3861.022. | NM_000526.3 | BI085500.1 | EST | 1 |
| 91 | 4915.011.1-D_at | −0.75125 | 0.75124983 | 10.91748 | <1e-16 | 4915.011. | NM_006180.3 | CQ723929.1 | GENBANK_PATENT | 1 |
| 92 | 5288.001.1-F_at | −0.75114 | 0.75113721 | 10.91373 | <1e-16 | 5288.001. | NM_004570.2 | CQ720591.1 | GENBANK_PATENT | 1 |
| 93 | 3861.007.1-T_at | −0.75024 | 0.75024416 | 10.88402 | <1e-16 | 3861.007. | NM_000526.3 | BG682207.1 | EST | 2 |
| 94 | 3852.006.1-C_at | −0.74966 | 0.74965968 | 10.86465 | <1e-16 | 3852.006. | NM_000424.2 | BG679014.1 | EST | 11 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 95 | 9413.003.1-T_at | −0.74954 | 0.74953975 | 10.86069 | <1e-16 | 9413.003. | NM_004816.2 | BX641153.1 | mRNA | 10 |
| 96 | 3861.020.1-C_at | −0.74922 | 0.74922185 | 10.85018 | <1e-16 | 3861.020. | NM_000526.3 | BM018298.1 | EST | 1 |
| 97 | 1308.008.1-D_at | −0.7468 | 0.746803 | 10.77082 | <1e-16 | 1308.008. | NM_130778.1 | BE148646.1 | EST | 1 |
| 98 | 23336.001.1-T_at | −0.74666 | 0.74665951 | 10.76614 | <1e-16 | 23336.001. | NM_145728.1 | AJ697971.1 | mRNA | 1 |
| 99 | 3815.001.1-F_at | −0.74657 | 0.74656536 | 10.76307 | <1e-16 | 3815.001. | NM_000222.1 | CS237377.1 | GENBANK_PATENT | 1 |
| 100 | 1756.022.5-F_at | −0.74654 | 0.74654247 | 10.76233 | <1e-16 | 1756.022. | NM_000109.2 | CQ714747.1 | GENBANK_PATENT | 1 |
| 101 | 79937.001.1-T_at | −0.74608 | 0.74607796 | 10.74722 | <1e-16 | 79937.001. | NM_033655.2 | AF333769.2 | mRNA | 1 |
| 102 | 4915.012.1-E_at | −0.74575 | 0.74575052 | 10.73659 | <1e-16 | 4915.012. | NM_006180.3 | CD103051.1 | EST | 1 |
| 103 | 3861.022.1-T_at | −0.74356 | 0.74356005 | 10.66593 | <1e-16 | 3861.022. | NM_000526.3 | BI085500.1 | EST | 1 |
| 104 | 26289.005.1-T_at | −0.74355 | 0.74354601 | 10.66548 | <1e-16 | 26289.005. | NM_174858.1 | BI546738.1 | EST | 1 |
| 105 | 3815.002.3-B_at | −0.74306 | 0.74306109 | 10.64994 | <1e-16 | 3815.002. | NM_000222.1 | CQ719901.1 | GENBANK_PATENT | 1 |
| 106 | 4311.009.1-F_at | −0.74287 | 0.74287019 | 10.64383 | <1e-16 | 4311.009. | NM_000902.2 | A30431.1 | GENBANK_PATENT | 1 |
| 107 | 26289.006.1-T_at | −0.74283 | 0.74282989 | 10.64255 | <1e-16 | 26289.006. | NM_174858.1 | CN356131.1 | EST | 1 |
| 108 | 5288.003.1-F_at | −0.74231 | 0.74231399 | 10.62608 | <1e-16 | 5288.003. | NM_004570.2 | CQ721655.1 | GENBANK_PATENT | 1 |
| 109 | 4629.020.1-B_at | −0.7423 | 0.74230371 | 10.62575 | <1e-16 | 4629.020. | NM_022844.1 | BI819760.1 | EST | 1 |
| 110 | 26289.007.1-D_at | −0.74169 | 0.74168883 | 10.60617 | <1e-16 | 26289.007. | NM_174858.1 | DA259560.1 | EST | 1 |
| 111 | 3815.002.1-B_at | −0.74167 | 0.74166962 | 10.60556 | <1e-16 | 3815.002. | NM_000222.1 | CQ719901.1 | GENBANK_PATENT | 1 |
| 112 | 26289.004.1-T_at | −0.74153 | 0.74153045 | 10.60114 | <1e-16 | 26289.004. | NM_174858.1 | NM_012093.2 | REFSEQ | 7 |
| 113 | 79192.002.2-T_at | −0.74131 | 0.74131399 | 10.59427 | <1e-16 | 79192.002. | NM_024337.3 | CQ731489.1 | GENBANK_PATENT | 1 |
| 114 | 4638.006.1-D_at | −0.74126 | 0.74125872 | 10.59252 | <1e-16 | 4638.006. | NM_053025.2 | DR005817.1 | EST | 2 |
| 115 | 3084.008.1-F_at | −0.74052 | 0.74051659 | 10.56902 | <1e-16 | 3084.008. | NM_013957.1 | CQ733299.1 | GENBANK_PATENT | 1 |
| 116 | 4311.001.1-T_at | −0.7346 | 0.73459701 | 10.38463 | <1e-16 | 4311.001. | NM_000902.2 | CB988534.1 | EST | 1 |
| 117 | 3815.002.1-D_at | −0.73458 | 0.73457702 | 10.38401 | <1e-16 | 3815.002. | NM_000222.1 | CQ719901.1 | GENBANK_PATENT | 1 |
| 118 | 4629.020.1-T_at | −0.73906 | 0.73905518 | 10.523 | <1e-16 | 4629.020. | NM_022844.1 | BI819760.1 | EST | 1 |
| 119 | 1756.026.1-B_at | −0.739 | 0.73899721 | 10.52119 | <1e-16 | 1756.026. | NM_000109.2 | M63075.1 | mRNA | 1 |
| 120 | 3852.022.1-E_at | −0.73857 | 0.73856714 | 10.50771 | <1e-16 | 3852.022. | NM_000424.2 | BP226135.1 | EST | 1 |
| 121 | 4629.015.1-D_at | −0.73849 | 0.73848689 | 10.5052 | <1e-16 | 4629.015. | NM_022844.1 | DB284318.1 | EST | 1 |
| 122 | 26289.007.1-C_at | −0.73826 | 0.73825579 | 10.49797 | <1e-16 | 26289.007. | NM_174858.1 | DA259560.1 | EST | 1 |
| 123 | 23194.003.1-C_at | −0.73638 | 0.73638084 | 10.43964 | <1e-16 | 23194.003. | NM_012304.3 | BP290286.1 | EST | 1 |
| 124 | 3815.002.1-B_at | −0.73534 | 0.73534271 | 10.40757 | <1e-16 | 3815.002. | NM_000222.1 | CQ719901.1 | GENBANK_PATENT | 1 |
| 125 | 26289.007.1-T_at | −0.7346 | 0.73459701 | 10.38463 | <1e-16 | 26289.007. | NM_174858.1 | DA259560.1 | EST | 1 |
| 126 | 65983.009.1-B_at | −0.73458 | 0.73457702 | 10.38401 | <1e-16 | 65983.009. | NM_023927.1 | CQ413222.1 | GENBANK_PATENT | 2 |
| 127 | 23336.001.1-F_at | −0.73393 | 0.73392505 | 10.36403 | <1e-16 | 23336.001. | NM_145728.1 | AJ697971.1 | mRNA | 1 |
| 128 | 1410.007.2-B_at | −0.73346 | 0.73346173 | 10.34986 | <1e-16 | 1410.007. | NM_001885.1 | BI548180.1 | EST | 1 |
| 129 | 1756.029.1-F_at | −0.73299 | 0.73298982 | 10.33546 | <1e-16 | 1756.029. | NM_000109.2 | BI551231.1 | EST | 1 |
| 130 | 7373.003.6-C_at | −0.73258 | 0.73257952 | 10.32297 | <1e-16 | 7373.003. | NM_021110.1 | CQ716670.1 | GENBANK_PATENT | 1 |
| 131 | 10010.002.1-E_at | −0.7322 | 0.73219822 | 10.31139 | <1e-16 | 10010.002. | NM_004180.2 | CF242863.1 | EST | 1 |
| 132 | 59.026.1-B_at | −0.73215 | 0.73215036 | 10.30993 | <1e-16 | 59.026.1 | — | — | — | — |
| 133 | 4915.011.1-F_at | −0.73192 | 0.73191927 | 10.30292 | <1e-16 | 4915.011. | NM_006180.3 | CQ723929.1 | GENBANK_PATENT | 1 |
| 134 | 3872.007.1-D_at | −0.73192 | 0.73191502 | 10.30279 | <1e-16 | 3872.007. | NM_000422.1 | BU155457.1 | EST | 1 |
| 135 | 26289.002.1-D_at | −0.73171 | 0.73171045 | 10.2966 | <1e-16 | 26289.002. | NM_174858.1 | BF966377.1 | EST | 1 |
| 136 | 84668.002.1-C_at | −0.73162 | 0.73162167 | 10.29391 | <1e-16 | 84668.002. | NM_032581.2 | AL833296.1 | mRNA | 20 |
| 137 | 1756.002.2-T_at | −0.73157 | 0.73156873 | 10.2923 | <1e-16 | 1756.002. | NM_000109.2 | NM_004016.1 | REFSEQ | 30 |
| 138 | 57447.033.1-C_at | −0.73085 | 0.73084864 | 10.27055 | <1e-16 | 57447.033 | NM_201535.1 | DA135222.1 | EST | 1 |
| 139 | 26289.009.1-E_at | −0.7304 | 0.73039812 | 10.25697 | <1e-16 | 26289.009. | NM_174858.1 | AA393277.1 | EST | 1 |
| 140 | 3872.006.1-F_at | −0.73024 | 0.73023988 | 10.25221 | <1e-16 | 3872.006. | NM_000422.1 | BM017443.1 | EST | 1 |
| 141 | 3861.022.1-D_at | −0.72983 | 0.72982952 | 10.23988 | <1e-16 | 3861.022. | NM_000526.3 | BI085500.1 | EST | 1 |
| 142 | 3861.020.1-B_at | −0.72921 | 0.72920518 | 10.22116 | <1e-16 | 3861.020. | NM_000526.3 | BM018298.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 143 | 667.021.1-B_at | −0.72908 | 0.72907922 | 10.21739 | <1e-16 | 667.021.1 | NM_183380.1 | DB134537.1 | EST | 1 |
| 144 | 57447.027.1-F_at | −0.72812 | 0.72812186 | 10.18881 | <1e-16 | 57447.027 | NM_201535.1 | BM810623.1 | EST | 9 |
| 145 | 56477.001.1-D_at | −0.72775 | 0.72774687 | 10.17766 | <1e-16 | 56477.001 | NM_148672.1 | NM_019846.3 | REFSEQ | 13 |
| 146 | 26289.008.1-F_at | −0.72745 | 0.72744814 | 10.16878 | <1e-16 | 26289.008 | NM_174858.1 | AV721097.1 | EST | 1 |
| 147 | 59.024.2-D_at | −0.72739 | 0.72738851 | 10.16701 | <1e-16 | 59.024.2 | — | — | — | — |
| 148 | 4629.005.1-T_at | −0.72738 | 0.7273826 | 10.16683 | <1e-16 | 4629.005. | NM_022844.1 | CB963138.1 | EST | 3 |
| 149 | 3815.002.1-T_at | −0.72727 | 0.72727235 | 10.16356 | <1e-16 | 3815.002. | NM_000222.1 | CQ719901.1 | GENBANK_PATENT | 1 |
| 150 | 23336.001.1-B_at | −0.72692 | 0.7269191 | 10.15309 | <1e-16 | 23336.001 | NM_145728.1 | AJ697971.1 | mRNA | 1 |
| 151 | 3084.004.2-F_at | −0.72617 | 0.72616697 | 10.13085 | <1e-16 | 3084.004. | NM_013957.1 | NM_013964.1 | REFSEQ | 5 |
| 152 | 27122.014.2-T_at | −0.72585 | 0.72585166 | 10.12156 | 1E-16 | 27122.014 | NM_013253.4 | DA180412.1 | EST | 1 |
| 153 | 26289.008.1-C_at | −0.72537 | 0.72537026 | 10.10738 | 1E-16 | 26289.008 | NM_174858.1 | AV721097.1 | EST | 1 |
| 154 | 286887.003.2-B | −0.72458 | 0.72457637 | 10.08408 | 1E-16 | 286887.00 | NM_173086.2 | BG876719.1 | EST | 1 |
| 155 | 4629.005.1-F_at | −0.72437 | 0.72437411 | 10.07816 | 1E-16 | 4629.005. | NM_022844.1 | CB963138.1 | EST | 3 |
| 156 | 3872.009.1-T_at | −0.72329 | 0.72328551 | 10.04637 | 1E-16 | 3872.009. | NM_000422.1 | BX647923.1 | mRNA | 91 |
| 157 | 59.014.2-D_at | −0.72287 | 0.72287431 | 10.0344 | 1E-16 | 59.014.2 | NM_001613.1 | CB962422.1 | EST | 1 |
| 158 | 403340.001.2-B | −0.72269 | 0.72269253 | 10.02912 | 1E-16 | 403340.00 | NM_203481.1 | DA145754.1 | EST | 1 |
| 159 | 3852.014.1-F_at | −0.72194 | 0.72194027 | 10.0073 | 1E-16 | 3852.014. | NM_000424.2 | BF826002.1 | EST | 1 |
| 160 | 27122.001.1-T_at | −0.72089 | 0.72088962 | 9.976959 | 1E-16 | 27122.001 | NM_013253.4 | BP290952.1 | EST | 1 |
| 161 | 26289.008.1-T_at | −0.72077 | 0.72076825 | 9.973463 | 1E-16 | 26289.008 | NM_000222.1 | CQ719901.1 | GENBANK_PATENT | 1 |
| 162 | 3815.002.3-T_at | −0.72074 | 0.72073551 | 9.97252 | 1E-16 | 3815.002. | NM_000424.2 | BG675837.1 | EST | 1 |
| 163 | 3852.008.1-E_at | −0.72072 | 0.72072375 | 9.972181 | 1E-16 | 3852.008. | NM_174858.1 | BG189938.1 | EST | 1 |
| 164 | 26289.012.1-T_at | −0.72026 | 0.72026202 | 9.958901 | 1E-16 | 26289.012 | NM_174858.1 | DA259560.1 | EST | 1 |
| 165 | 4638.006.1-F_at | −0.72019 | 0.72019094 | 9.956859 | 1E-16 | 4638.006. | NM_053205.2 | DR005817.1 | EST | 2 |
| 166 | 8626.005.1-B_at | −0.71997 | 0.71997497 | 9.950658 | 1E-16 | 8626.005. | NM_003722.3 | AB042841.1 | mRNA | 1 |
| 167 | 3815.002.4-T_at | −0.71955 | 0.71955195 | 9.938531 | 1E-16 | 3815.002. | NM_000222.1 | CQ719901.1 | GENBANK_PATENT | 1 |
| 168 | 84668.004.1-T_at | −0.71918 | 0.71917508 | 9.927746 | 1E-16 | 84668.004 | NM_032581.2 | AL597549.1 | EST | 1 |
| 169 | 3872.007.1-F_at | −0.71916 | 0.71915759 | 9.927246 | 1E-16 | 3872.007. | NM_000422.1 | BU155457.1 | EST | 1 |
| 170 | 57447.031.1-F_at | −0.7189 | 0.71889801 | 9.919829 | 1E-16 | 57447.031 | NM_201535.1 | AI272253.1 | EST | 1 |
| 171 | 3084.012.3-T_at | −0.71856 | 0.71855665 | 9.910088 | 2E-16 | 3084.012. | NM_013957.1 | U02325.1 | mRNA | 1 |
| 172 | 3852.005.1-T_at | −0.71827 | 0.71827136 | 9.901958 | 2E-16 | 3852.005. | NM_000424.2 | R47851.1 | EST | 1 |
| 173 | 84417.001.2-T_at | −0.71816 | 0.71816117 | 9.898821 | 2E-16 | 84417.001 | NM_032411.1 | BI561114.1 | EST | 1 |
| 174 | 3866.003.2-T_at | −0.71746 | 0.71745931 | 9.878874 | 2E-16 | 3866.003. | NM_022275.2 | AK090604.1 | mRNA | 22 |
| 175 | 3866.008.1-C_at | −0.71716 | 0.71715783 | 9.870325 | 2E-16 | 3866.008. | NM_022275.2 | BI771363.1 | EST | 1 |
| 176 | 3852.009.1-F_at | −0.71671 | 0.71671024 | 9.857654 | 3E-16 | 3852.009. | NM_000424.2 | BQ378037.1 | EST | 1 |
| 177 | 59.015.1-B_at | −0.71663 | 0.7166277 | 9.85532 | 3E-16 | 59.015.1. | NM_001613.1 | BP372009.1 | EST | 1 |
| 178 | 79937.002.1-F_at | −0.71652 | 0.71651832 | 9.852229 | 3E-16 | 79937.002 | NM_033655.2 | AB051501.2 | mRNA | 9 |
| 179 | 7153.002.6-F_at | −0.716462 | 0.71646227 | 9.850645 | 3E-16 | 7153.002. | NM_001067.2 | CQ735949.1 | GENBANK_PATENT | 114 |
| 180 | 4281.010.1-B_at | −0.71619 | 0.71619361 | 9.84306 | 3E-16 | 4281.010. | NM_033290.1 | AY540016.1 | mRNA | 1 |
| 181 | 59.008.1-B_at | −0.71578 | 0.7157817 | 9.831448 | 2E-16 | 59.008.1 | NM_001613.1 | BP373197.1 | EST | 1 |
| 182 | 1264.007.1-T_at | −0.71577 | 0.71576716 | 9.831038 | 3E-16 | 1264.007. | NM_001299.4 | CX761868.1 | EST | 1 |
| 183 | 3868.004.1-T_at | −0.7156 | 0.71560057 | 9.826348 | 3E-16 | 3868.004. | NM_005557.2 | BM045170.1 | EST | 1 |
| 184 | 3084.002.1-F_at | −0.71513 | 0.71512815 | 9.813066 | 3E-16 | 3084.002. | NM_013957.1 | CN603657.1 | EST | 1 |
| 185 | 5137.004.2-T_at | −0.71508 | 0.71508204 | 9.811771 | 3E-16 | 5137.004. | NM_005020.1 | BP226298.1 | EST | 1 |
| 186 | 4629.022.1-F_at | −0.71428 | 0.71427853 | 9.789249 | 3E-16 | 4629.022. | NM_022844.1 | AX898971.1 | GENBANK_PATENT | 1 |
| 187 | 4915.011.1-T_at | −0.71337 | 0.71336654 | 9.763782 | 3E-16 | 4915.011. | NM_006180.3 | CQ723929.1 | GENBANK_PATENT | 1 |
| 188 | 3852.013.1-E_at | −0.71333 | 0.71332619 | 9.762657 | 4E-16 | 3852.013. | NM_000424.2 | BG682634.1 | EST | 1 |
| 189 | 59.012.2-T_at | −0.71189 | 0.71189085 | 9.722787 | 4E-16 | 59.012.2 | NM_001613.1 | AL546033.3 | EST | 1 |
| 190 | 59.015.1-F_at | −0.71184 | 0.71184354 | 9.721477 | 4E-16 | 59.015.1 | NM_001613.1 | BP372009.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 191 | 4638.006.2-T_at | −0.7112 | 0.71119714 | 9.703606 | 4E-16 | 4638.006. | NM_053025.2 | DR005817.1 | EST | 2 |
| 192 | 23336.002.1-B_at | −0.7108 | 0.71079772 | 9.692588 | 6E-16 | 23336.002 | NM_145728.1 | NM_015286.4 | REFSEQ | 6 |
| 193 | 3868.005.1-C_at | −0.70987 | 0.7098711 | 9.6671 | 6E-16 | 3868.005. | NM_005557.2 | BG682632.1 | EST | 1 |
| 194 | 3866.011.2-D_at | −0.7087 | 0.70870117 | 9.635065 | 7E-16 | 3866.011. | NM_002275.2 | BQ218433.1 | EST | 1 |
| 195 | 56477.001.1-T_at | −0.70868 | 0.70868235 | 9.634551 | 7E-16 | 56477.001 | NM_148672.1 | NM_019846.3 | REFSEQ | 13 |
| 196 | 3815.001.1-T_at | −0.70825 | 0.70824726 | 9.622678 | 7E-16 | 3815.001. | NM_000222.1 | CS237377.1 | GENBANK_PATENT | 1 |
| 197 | 4311.001.1-T_at | −0.70821 | 0.70820529 | 9.621535 | 7E-16 | 4311.001. | NM_000902.2 | CB988534.1 | EST | 1 |
| 198 | 1264.003.1-D_at | −0.70785 | 0.70785219 | 9.611918 | 8E-16 | 1264.003. | NM_001299.4 | CV811526.1 | EST | 1 |
| 199 | 59.031.1-T_at | −0.70756 | 0.70755684 | 9.603885 | 8E-16 | 59.031.1 | NM_001613.1 | BG197213.1 | EST | 19 |
| 200 | 57447.030.1-B_at | −0.70751 | 0.70750665 | 9.60252 | 8E-16 | 57447.030 | NM_201535.1 | BM783465.1 | EST | 5 |
| 201 | 1410.003.2-B_at | −0.70746 | 0.70745636 | 9.601154 | 8E-16 | 1410.003. | NM_001885.1 | AX899079.1 | GENBANK_PATENT | 1 |
| 202 | 3866.009.2-D_at | −0.70722 | 0.70721526 | 9.594607 | 8E-16 | 3866.009. | NM_002275.2 | BI457146.1 | EST | 1 |
| 203 | 59.026.1-T_at | −0.70717 | 0.70717265 | 9.59345 | 8E-16 | 59.026.1 | — | — | — | — |
| 204 | 440421.001.1-T | −0.70711 | 0.70711453 | 9.591873 | 8E-16 | 440421.00 | XM_496202.2 | XM_934894.1 | REFSEQ | 2 |
| 205 | 1756.022.4-D_at | −0.70675 | 0.70675086 | 9.582014 | 9E-16 | 1756.022. | NM_000109.2 | CQ714747.1 | GENBANK_PATENT | 1 |
| 206 | 65983.009.1-D_at | −0.7066 | 0.70660056 | 9.577944 | 9E-16 | 65983.009 | NM_023927.1 | CQ413222.1 | GENBANK_PATENT | 2 |
| 207 | 57447.041.1-T_at | −0.70624 | 0.70624401 | 9.5683 | 9E-16 | 57447.041 | NM_201535.1 | DA295124.1 | EST | 1 |
| 208 | 3872.010.2-D_at | −0.70603 | 0.7060339 | 9.562622 | 1E-15 | 3872.010. | NM_000422.1 | BM008795.1 | EST | 1 |
| 209 | 4629.006.2-T_at | −0.70601 | 0.70600879 | 9.561944 | 1E-15 | 4629.006. | NM_022844.1 | DB079784.1 | EST | 1 |
| 210 | 3861.018.1-F_at | −0.70592 | 0.70592127 | 9.559582 | 1E-15 | 3861.018. | NM_000526.3 | BM019687.1 | EST | 1 |
| 211 | 3815.002.1-T_at | −0.70576 | 0.70576231 | 9.555292 | 1E-15 | 3815.002. | NM_000222.1 | CQ719901.1 | GENBANK_PATENT | 1 |
| 212 | 3866.012.2-D_at | −0.70556 | 0.70555782 | 9.549778 | 1E-15 | 3866.012. | NM_002275.2 | BI772438.1 | EST | 1 |
| 213 | 57447.021.1-D_at | −0.70548 | 0.70548085 | 9.547704 | 1E-15 | 57447.021 | NM_201535.1 | BQ954948.1 | EST | 28 |
| 214 | 59.015.1-T_at | −0.70494 | 0.7049442 | 9.533261 | 1E-15 | 59.015.1 | NM_001613.1 | BP372009.1 | EST | 1 |
| 215 | 8626.007.1-F_at | −0.70484 | 0.70483534 | 9.530036 | 1E-15 | 8626.007. | NM_003722.3 | BG698723.1 | EST | 1 |
| 216 | 5288.001.1-B_at | −0.70452 | 0.70452172 | 9.521914 | 1E-15 | 5288.001. | NM_004570.2 | CQ720591.1 | GENBANK_PATENT | 1 |
| 217 | 72.001.1-B_at | −0.70441 | 0.70440953 | 9.518904 | 1E-15 | 72.001.1 | NM_001615.3 | BP330025.1 | EST | 1 |
| 218 | 3866.006.2-D_at | −0.70383 | 0.70382789 | 9.503322 | 2E-15 | 3866.006. | NM_002275.2 | BQ641523.1 | EST | 1 |
| 219 | 3852.004.1-T_at | −0.70371 | 0.70371224 | 9.500228 | 2E-15 | 3852.004. | NM_000424.2 | BE715131.1 | EST | 1 |
| 220 | 4629.016.2-T_at | −0.70364 | 0.70363752 | 9.49823 | 2E-15 | 4629.016. | NM_022844.1 | DB289769.1 | EST | 1 |
| 221 | 4629.007.1-T_at | −0.70359 | 0.70358925 | 9.49694 | 2E-15 | 4629.007. | NM_022844.1 | AY520817.1 | mRNA | 16 |
| 222 | 65983.008.1-T_at | −0.70354 | 0.70353523 | 9.495496 | 2E-15 | 65983.008 | NM_023927.1 | BI547735.1 | EST | 2 |
| 223 | 65983.013.1-F_at | −0.70278 | 0.7027824 | 9.475409 | 2E-15 | 65983.013 | NM_023927.1 | AA610396.1 | EST | 1 |
| 224 | 3084.004.1-F_at | −0.70205 | 0.70204717 | 9.455852 | 2E-15 | 3084.004. | NM_013957.1 | NM_013964.1 | REFSEQ | 5 |
| 225 | 27122.007.1-F_at | −0.70181 | 0.70180898 | 9.449529 | 2E-15 | 27122.007 | NM_013253.4 | DA177251.1 | EST | 1 |
| 226 | 3866.008.1-D_at | −0.70143 | 0.70142639 | 9.439386 | 2E-15 | 3866.008. | NM_002275.2 | BI771363.1 | EST | 1 |
| 227 | 26289.009.1-T_at | −0.70109 | 0.70108634 | 9.430384 | 2E-15 | 26289.009 | NM_174858.1 | AA393277.1 | EST | 1 |
| 228 | 59.009.1-B_at | −0.70065 | 0.7006532 | 9.418936 | 2E-15 | 59.009.1 | NM_001613.1 | CD299238.1 | EST | 1 |
| 229 | 4629.010.1-D_at | −0.70044 | 0.70044198 | 9.413361 | 2E-15 | 4629.010. | NM_022844.1 | AI285326.1 | EST | 1 |
| 230 | 59.023.1-B_at | −0.70011 | 0.70010609 | 9.404505 | 2E-15 | 59.023.1 | NM_001613.1 | DB248573.1 | EST | 1 |
| 231 | 26289.002.1-F_at | −0.69973 | 0.6997339 | 9.394706 | 3E-15 | 26289.002 | NM_174858.1 | BF966377.1 | EST | 1 |
| 232 | 1908.001.1-T_at | −0.69949 | 0.69948609 | 9.388191 | 3E-15 | 1908.001. | NM_207032.1 | BC008876.2 | mRNA | 3 |
| 233 | 4915.008.1-F_at | −0.69917 | 0.69916784 | 9.379833 | 3E-15 | 4915.008. | NM_006180.3 | NM_001007097 | REFSEQ | 4 |
| 234 | 23336.002.1-B_at | −0.69904 | 0.69903724 | 9.376406 | 3E-15 | 23336.002 | NM_145728.1 | NM_015286.4 | REFSEQ | 6 |
| 235 | 3861.008.1-C_at | −0.69903 | 0.69902539 | 9.376095 | 3E-15 | 3861.008. | NM_000526.3 | BE184532.1 | EST | 1 |
| 236 | 3861.008.1-D_at | −0.69889 | 0.69889457 | 9.372664 | 3E-15 | 3861.008. | NM_000526.3 | BE184532.1 | EST | 1 |
| 237 | 57447.035.1-E_at | −0.69855 | 0.69855253 | 9.363704 | 3E-15 | 57447.035 | NM_201535.1 | BQ636638.1 | EST | 1 |
| 238 | 3861.018.1-C_at | −0.69848 | 0.69848178 | 9.361852 | 3E-15 | 3861.018. | NM_000526.3 | BM019687.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 239 | 1308.003.1-B_at | −0.69839 | 0.69838688 | 9.359369 | 3E-15 | 1308.003. | NM_130778.1 | NM_000494.2 | REFSEQ | 19 |
| 240 | 667.022.1-B_at | −0.69713 | 0.69712975 | 9.326564 | 3E-15 | 667.022.1 | NM_183380.1 | AX683196.1 | GENBANK_PATENT | 1 |
| 241 | 3866.011.2-T_at | −0.69701 | 0.69700959 | 9.323438 | 3E-15 | 3866.011. | NM_002275.2 | BQ218433.1 | EST | 1 |
| 242 | 2115.001.2-F_at | −0.69674 | 0.69674446 | 9.316544 | 3E-15 | 2115.001. | NM_004956.3 | X87175.1 | mRNA | 1 |
| 243 | 3866.011.2-B_at | −0.69651 | 0.69651246 | 9.310518 | 3E-15 | 3866.011. | NM_002275.2 | BQ218433.1 | EST | 1 |
| 244 | 26289.010.1-T_at | −0.69627 | 0.69627463 | 9.304346 | 3E-15 | 26289.010 | NM_174858.1 | AX988359.1 | GENBANK_PATENT | 1 |
| 245 | 27303.004.1-F_at | −0.69571 | 0.69571431 | 9.28983 | 4E-15 | 27303.004 | NM_001003793. | BQ876639.1 | EST | 1 |
| 246 | 59.003.1-B_at | −0.69503 | 0.69503447 | 9.27226 | 4E-15 | 59.003.1 | NM_001613.1 | DD218797.1 | GENBANK_PATENT | 1 |
| 247 | 4311.009.1-C_at | −0.69487 | 0.69486903 | 9.267992 | 4E-15 | 4311.009. | NM_000902.2 | A30431.1 | GENBANK_PATENT | 1 |
| 248 | 7373.003.6-B_at | −0.69405 | 0.69404745 | 9.246838 | 4E-15 | 7373.003. | NM_021110.1 | CQ716670.1 | GENBANK_PATENT | 1 |
| 249 | 65983.004.1-T_at | −0.69339 | 0.69339166 | 9.230003 | 5E-15 | 65983.004 | NM_023927.1 | BP262020.1 | EST | 1 |
| 250 | 26289.013.1-D_at | −0.69304 | 0.69304425 | 9.221102 | 5E-15 | 26289.013 | NM_174858.1 | CK024190.1 | EST | 1 |
| 251 | 3866.004.1-F_at | −0.69262 | 0.6926248 | 9.210372 | 5E-15 | 3866.004. | NM_002275.2 | BC110649.1 | mRNA | 1 |
| 252 | 56477.001.1-F_at | −0.69247 | 0.69247193 | 9.206466 | 5E-15 | 56477.001 | NM_148672.1 | NM_019846.3 | REFSEQ | 13 |
| 253 | 57447.037.1-F_at | −0.69228 | 0.69227756 | 9.201453 | 5E-15 | 57447.037 | NM_201535.1 | BF793156.1 | EST | 1 |
| 254 | 59.022.2-T_at | −0.69208 | 0.69207912 | 9.19644 | 6E-15 | 59.022.2 | — | — | — | — |
| 255 | 147495.008.1-F | −0.69208 | 0.69207819 | 9.196417 | 6E-15 | 147495.00 | NM_153000.3 | BU541433.1 | EST | 1 |
| 256 | 2.018.1-T_at | −0.69207 | 0.69207481 | 9.196331 | 6E-15 | 2.018.1 | NM_000014.4 | DB090657.1 | EST | 1 |
| 257 | 140807.003.1-E | −0.69207 | 0.69207171 | 9.196251 | 6E-15 | 140807.00 | NM_080747.1 | DB022590.1 | EST | 1 |
| 258 | 65983.009.1-T_at | −0.69206 | 0.69205534 | 9.195834 | 6E-15 | 65983.009 | NM_023927.1 | CQ413222.1 | GENBANK_PATENT | 2 |
| 259 | 84668.002.1-F_at | −0.69156 | 0.69155609 | 9.183115 | 6E-15 | 84668.002 | NM_032581.2 | AL833296.1 | mRNA | 20 |
| 260 | 3872.007.1-C_at | −0.69153 | 0.69153411 | 9.182556 | 6E-15 | 3872.007. | NM_000422.1 | BU155457.1 | EST | 1 |
| 261 | 2115.008.1-T_at | −0.69097 | 0.6909716 | 9.168257 | 6E-15 | 2115.008. | NM_004956.3 | BC045776.1 | mRNA | 3 |
| 262 | 65983.004.2-T_at | −0.69096 | 0.69095787 | 9.167908 | 6E-15 | 65983.004 | NM_023927.1 | BP262020.1 | EST | 1 |
| 263 | 57447.034.1-D_at | −0.69053 | 0.69052533 | 9.156935 | 7E-15 | 57447.034 | NM_201535.1 | BC011240.1 | mRNA | 1 |
| 264 | 3866.001.1-F_at | −0.69016 | 0.69016212 | 9.147735 | 7E-15 | 3866.001. | NM_002275.2 | CQ733235.1 | GENBANK_PATENT | 23 |
| 265 | 3866.008.1-F_at | −0.69014 | 0.69014281 | 9.147247 | 7E-15 | 3866.008. | NM_002275.2 | BI771363.1 | EST | 1 |
| 266 | 1959.003.1-C_at | −0.68985 | 0.68984796 | 9.139789 | 7E-15 | 1959.003. | NM_000399.2 | BX414563.2 | EST | 3 |
| 267 | 389432.002.1-T | −0.68963 | 0.6896308 | 9.134301 | 8E-15 | 389432.00 | NM_001030060. | CQ751492.1 | GENBANK_PATENT | 1 |
| 268 | 389734.001.1-T | −0.68953 | 0.68953203 | 9.131807 | 8E-15 | 389734.00 | XM_928572.1 | NM_033655.2 | REFSEQ | 1 |
| 269 | 3855.001.2-D_at | −0.68928 | 0.68928425 | 9.125555 | 8E-15 | 3855.001. | NM_005556.3 | BM754696.1 | EST | 1 |
| 270 | 3866.003.1-T_at | −0.68911 | 0.68910803 | 9.121111 | 8E-15 | 3866.003. | NM_002275.2 | AK090604.1 | mRNA | 22 |
| 271 | 3084.006.1-F_at | −0.689 | 0.68900076 | 9.118408 | 8E-15 | 3084.006. | NM_013957.1 | NM_013956.1 | REFSEQ | 3 |
| 272 | 4915.008.1-B_at | −0.68884 | 0.68884477 | 9.114479 | 8E-15 | 4915.008. | NM_006180.3 | NM_001007097 | REFSEQ | 4 |
| 273 | 2115.011.1-T_at | −0.68881 | 0.68880926 | 9.113585 | 8E-15 | 2115.011. | NM_004956.3 | DB093597.1 | EST | 1 |
| 274 | 65983.005.1-T_at | −0.68876 | 0.68875602 | 9.112245 | 8E-15 | 65983.005 | NM_023927.1 | CQ471280.1 | GENBANK_PATENT | 6 |
| 275 | 84668.004.1-T_at | −0.68808 | 0.68807773 | 9.095195 | 9E-15 | 84668.004 | NM_032581.2 | AL597549.1 | EST | 1 |
| 276 | 59.015.2-T_at | −0.68802 | 0.68801589 | 9.093643 | 9E-15 | 59.015.2 | NM_001613.1 | BP372009.1 | EST | 1 |
| 277 | 2119.006.1-B_at | −0.6878 | 0.687801 | 9.088252 | 9E-15 | 2119.006. | NM_004454.1 | DB094869.1 | EST | 1 |
| 278 | 4638.006.2-F_at | −0.68764 | 0.6876412 | 9.084246 | 1E-14 | 4638.006. | NM_053025.2 | DR005817.1 | EST | 2 |
| 279 | 3866.007.2-D_at | −0.68699 | 0.68699646 | 9.068108 | 1E-14 | 3866.007. | NM_002275.2 | BM548942.1 | EST | 1 |
| 280 | 59.014.1-F_at | −0.68691 | 0.68691236 | 9.066007 | 1E-14 | 59.014.1 | NM_001613.1 | CB962422.1 | EST | 1 |
| 281 | 3866.001.2-F_at | −0.68681 | 0.68680934 | 9.063433 | 1E-14 | 3866.001. | NM_002275.2 | CQ733235.1 | GENBANK_PATENT | 23 |
| 282 | 1308.008.1-B_at | −0.68652 | 0.68652289 | 9.056281 | 1E-14 | 1308.008. | NM_130778.1 | BE148646.1 | EST | 1 |
| 283 | 59.026.1-F_at | −0.68647 | 0.68647292 | 9.055034 | 1E-14 | 59.026.1 | — | — | — | — |
| 284 | 3866.013.1-T_at | −0.68626 | 0.68625953 | 9.049713 | 1E-14 | 3866.013. | NM_002275.2 | BI769443.1 | EST | 1 |
| 285 | 1264.001.2-F_at | −0.68577 | 0.68577484 | 9.037643 | 1E-14 | 1264.001. | NM_001299.4 | CX761868.1 | EST | 1 |
| 286 | 3866.007.2-T_at | −0.68566 | 0.68566296 | 9.034861 | 1E-14 | 3866.007. | NM_002275.2 | BM548942.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 287 | 27122.013.1-T_at | −0.68541 | 0.68541178 | 9.028617 | 1E−14 | 27122.013 | NM_013253.4 | DR155720.1 | EST | 1 |
| 288 | 27122.006.2-T_at | −0.68531 | 0.68531032 | 9.026097 | 1E−14 | 27122.006 | NM_013253.4 | DA171350.1 | EST | 1 |
| 289 | 3866.006.2-T_at | −0.68509 | 0.68508881 | 9.020598 | 1E−14 | 3866.006. | NM_002275.2 | BQ641523.1 | EST | 1 |
| 290 | 3866.009.2-T_at | −0.68506 | 0.68506091 | 9.019906 | 1E−14 | 3866.009. | NM_002275.2 | BI457146.1 | EST | 1 |
| 291 | 4240.004.1-D_at | −0.68504 | 0.68503667 | 9.019305 | 1E−14 | 4240.004. | NM_005928.1 | BC003610.2 | mRNA | 448 |
| 292 | 3866.010.1-C_at | −0.68501 | 0.68500991 | 9.018641 | 1E−14 | 3866.010. | NM_002275.2 | BM045201.1 | EST | 1 |
| 293 | 3866.009.2-B_at | −0.68464 | 0.68464309 | 9.009548 | 1E−14 | 3866.009. | NM_002275.2 | BI457146.1 | EST | 1 |
| 294 | 3866.009.1-T_at | −0.68457 | 0.68456652 | 9.007652 | 1E−14 | 3866.009. | NM_002275.2 | BI457146.1 | EST | 1 |
| 295 | 4629.006.1-T_at | −0.68451 | 0.68450911 | 9.00623 | 1E−14 | 4629.006. | NM_022844.1 | DB079784.1 | EST | 1 |
| 296 | 7018.029.1-B_at | −0.68388 | 0.68388329 | 8.990755 | 2E−14 | 7018.029. | NM_001063.2 | AV656085.1 | EST | 1 |
| 297 | 1410.002.2-B_at | −0.68375 | 0.8837454 | 8.987351 | 2E−14 | 1410.002. | NM_001885.1 | AX899073.1 | GENBANK_PATENT | 4 |
| 298 | 3866.012.1-T_at | −0.68307 | 0.68306583 | 8.970598 | 2E−14 | 3866.012. | NM_002275.2 | BI772438.1 | EST | 1 |
| 299 | 59.034.2-D_at | −0.68305 | 0.68305272 | 8.970275 | 2E−14 | 59.034.2 | — | — | — | — |
| 300 | 27122.019.1-F_at | −0.68293 | 0.68293177 | 8.967298 | 2E−14 | 27122.019 | NM_013253.4 | CX758435.1 | EST | 1 |
| 301 | 5156.001.1-T_at | −0.68292 | 0.6829222 | 8.967063 | 2E−14 | 5156.001. | NM_006206.3 | BC015186.1 | mRNA | 1 |
| 302 | 389734.001.2-T | −0.68274 | 0.68273641 | 8.962493 | 2E−14 | 389734.00 | XM_928572.1 | NM_033655.2 | REFSEQ | 1 |
| 303 | 27122.014.1-T_at | −0.68257 | 0.68256552 | 8.958292 | 2E−14 | 27122.014 | NM_013253.4 | DA180412.1 | EST | 1 |
| 304 | 57447.010.3-T_at | −0.68236 | 0.68236044 | 8.953255 | 2E−14 | 57447.010 | NM_201535.1 | BP349691.1 | EST | 1 |
| 305 | 358.018.1-F_at | −0.68232 | 0.68232244 | 8.952322 | 2E−14 | 358.018.1 | NM_198098.1 | BI765065.1 | EST | 1 |
| 306 | 3866.006.1-T_at | −0.68218 | 0.6821773 | 8.948759 | 2E−14 | 3866.006. | NM_002275.2 | BQ641523.1 | EST | 1 |
| 307 | 7373.001.1-T_at | −0.68199 | 0.68198548 | 8.944055 | 2E−14 | 7373.001. | NM_021110.1 | DB089175.1 | EST | 1 |
| 308 | 26289.012.1-B_at | −0.68184 | 0.68184048 | 8.940501 | 2E−14 | 26289.012 | NM_174858.1 | BG189938.1 | EST | 1 |
| 309 | 57447.029.1-T_at | −0.68178 | 0.68178369 | 8.939109 | 2E−14 | 57447.029 | NM_201535.1 | BX354120.2 | EST | 6 |
| 310 | 358.018.1-B_at | −0.68156 | 0.68155712 | 8.933561 | 2E−14 | 358.018.1 | NM_198098.1 | BI765065.1 | EST | 1 |
| 311 | 79068.010.1-B_at | −0.68149 | 0.68149173 | 8.93196 | 2E−14 | 79068.010 | XM_051200.8 | DA647247.1 | EST | 1 |
| 312 | 59.024.1-B_at | −0.68126 | 0.68126043 | 8.926302 | 2E−14 | 59.024.1 | — | — | — | — |
| 313 | 59.004.1-B_at | −0.68117 | 0.68116935 | 8.924076 | 2E−14 | 59.004.1 | NM_001613.1 | CQ696293.1 | GENBANK_PATENT | 1 |
| 314 | 3866.011.1-T_at | −0.68101 | 0.68100958 | 8.920172 | 2E−14 | 3866.011. | NM_002275.2 | BQ218433.1 | EST | 1 |
| 315 | 3866.013.1-E_at | −0.68096 | 0.68096121 | 8.91899 | 2E−14 | 3866.013. | NM_002275.2 | BI769443.1 | EST | 1 |
| 316 | 3866.010.1-D_at | −0.68032 | 0.68032145 | 8.903385 | 2E−14 | 3866.010. | NM_002275.2 | BM045201.1 | EST | 1 |
| 317 | 59.004.1-T_at | −0.68016 | 0.68016229 | 8.899508 | 2E−14 | 59.004.1 | NM_001613.1 | CQ696293.1 | GENBANK_PATENT | 37 |
| 318 | 2115.012.1-T_at | −0.68003 | 0.68003217 | 8.896341 | 2E−14 | 2115.012. | NM_021110.1 | DA407403.1 | EST | 1 |
| 319 | 2.018.1-D_at | −0.68003 | 0.68003048 | 8.8963 | 2E−14 | 2.018.1 | NM_004956.3 | DB090657.1 | EST | 1 |
| 320 | 2115.007.1-T_at | −0.67992 | 0.67991611 | 8.893517 | 2E−14 | 2115.007. | NM_004956.3 | DA189670.1 | EST | 1 |
| 321 | 59.040.1-T_at | −0.67978 | 0.67977663 | 8.890125 | 2E−14 | 59.040.1 | NM_001613.1 | EH_001613.6 | PREDICTED | 1 |
| 322 | 130497.001.2-T | −0.67974 | 0.67974133 | 8.889267 | 2E−14 | 130497.00 | NM_145260.2 | BP316395.1 | EST | 1 |
| 323 | 140885.014.1-T | −0.67971 | 0.67971161 | 8.888544 | 2E−14 | 140885.01 | NM_080792.2 | DR423079.1 | EST | 1 |
| 324 | 3866.005.1-F_at | −0.6797 | 0.67970122 | 8.888292 | 2E−14 | 3866.005. | NM_002275.2 | AL832226.1 | mRNA | 37 |
| 325 | 7373.003.3-F_at | −0.67961 | 0.67961087 | 8.886096 | 3E−14 | 7373.003. | NM_021110.1 | CQ716670.1 | GENBANK_PATENT | 1 |
| 326 | 8404.028.1-F_at | −0.67957 | 0.67957039 | 8.885112 | 3E−14 | 8404.028. | NM_004684.2 | CQ727530.1 | GENBANK_PATENT | 1 |
| 327 | 3860.007.1-D_at | −0.67955 | 0.67954786 | 8.884565 | 3E−14 | 3860.007. | NM_153490.1 | DB256579.1 | EST | 1 |
| 328 | 4638.003.1-C_at | −0.67882 | 0.678822 | 8.866957 | 3E−14 | 4638.003. | NM_053025.2 | BP289609.1 | EST | 2 |
| 329 | 3872.009.1-E_at | −0.67861 | 0.67861088 | 8.861844 | 3E−14 | 3872.009. | NM_000422.1 | BX647923.1 | mRNA | 91 |
| 330 | 59.004.2-T_at | −0.67859 | 0.67859272 | 8.861405 | 3E−14 | 59.004.2 | NM_001613.1 | CQ696293.1 | GENBANK_PATENT | 1 |
| 331 | 3872.006.1-C_at | −0.67843 | 0.67842819 | 8.857424 | 3E−14 | 3872.006. | NM_000422.1 | BM017443.1 | EST | 1 |
| 332 | 3866.005.1-C_at | −0.67822 | 0.67822035 | 8.852398 | 3E−14 | 3866.005. | NM_002275.2 | AL832226.1 | mRNA | 37 |
| 333 | 25925.008.1-T_at | −0.67797 | 0.6779714 | 8.846384 | 3E−14 | 25925.008 | NM_015461.1 | DA093254.1 | EST | 1 |
| 334 | 23650.011.2-T_at | −0.67792 | 0.67792361 | 8.84523 | 3E−14 | 23650.011 | NM_058193.1 | NM_012101.2 | REFSEQ | 11 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 335 | 3866.012.2-T_at | −0.67755 | 0.67754608 | 8.836122 | 3E-14 | 3866.012. | NM_002275.2 | BI772438.1 | EST | 1 |
| 336 | 3852.017.1-D_at | −0.6775 | 0.67750467 | 8.835124 | 3E-14 | 3852.017. | NM_000424.2 | CV575305.1 | EST | 1 |
| 337 | 4915.005.1-T_at | −0.67735 | 0.67734733 | 8.831332 | 3E-14 | 4915.005. | NM_006180.3 | BP348402.1 | EST | 1 |
| 338 | 4638.003.1-B_at | −0.67707 | 0.67706981 | 8.82465 | 3E-14 | 4638.003. | NM_053025.2 | BP289609.1 | EST | 2 |
| 339 | 1756.003.1-B_at | −0.67674 | 0.67673545 | 8.816608 | 4E-14 | 1756.003. | NM_000109.2 | AB208836.1 | mRNA | 1 |
| 340 | 4638.006.1-F_at | −0.67651 | 0.6765092 | 8.811172 | 4E-14 | 4638.006. | NM_053025.2 | DR005817.1 | EST | 2 |
| 341 | 57447.035.1-F_at | −0.67604 | 0.67604162 | 8.799953 | 4E-14 | 57447.035 | NM_201535.1 | BQ636638.1 | EST | 1 |
| 342 | 4638.014.1-T_at | −0.67585 | 0.67584646 | 8.795276 | 4E-14 | 4638.014. | NM_053025.2 | NM_053027.2 | REFSEQ | 2 |
| 343 | 7373.003.4-T_at | −0.67582 | 0.67582231 | 8.794697 | 4E-14 | 7373.003. | NM_021110.1 | CQ716670.1 | GENBANK_PATENT | 1 |
| 344 | 27122.014.2-D_at | −0.67579 | 0.67578648 | 8.793839 | 4E-14 | 27122.014 | NM_013253.4 | DA180412.1 | EST | 1 |
| 345 | 3866.007.1-T_at | −0.67504 | 0.67503748 | 8.775925 | 4E-14 | 3866.007. | NM_002275.2 | BM548942.1 | EST | 1 |
| 346 | 2707.002.1-E_at | −0.67499 | 0.67498884 | 8.774763 | 4E-14 | 2707.002. | NM_024009.2 | DA669405.1 | EST | 4 |
| 347 | 59.024.1-T_at | −0.67481 | 0.67480778 | 8.770441 | 4E-14 | 59.024.1 | — | — | — | |
| 348 | 23650.011.1-T_at | −0.6747 | 0.67469739 | 8.767807 | 4E-14 | 23650.011 | NM_058193.1 | NM_012101.2 | REFSEQ | 11 |
| 349 | 4638.011.1-F_at | −0.67462 | 0.67462378 | 8.766052 | 4E-14 | 4638.011. | NM_053025.2 | DB267860.1 | EST | 1 |
| 350 | 7373.002.1-F_at | −0.67455 | 0.67455304 | 8.764365 | 5E-14 | 7373.002. | NM_021110.1 | BC036192.1 | mRNA | 2 |
| 351 | 3866.013.1-F_at | −0.6745 | 0.6744968 | 8.763024 | 5E-14 | 3866.013. | NM_002275.2 | BI769443.1 | EST | 1 |
| 352 | 5608.002.1-T_at | −0.67444 | 0.67443693 | 8.761597 | 5E-14 | 5608.002. | NM_002758.2 | DA427998.1 | EST | 1 |
| 353 | 3866.001.1-C_at | −0.67411 | 0.67411218 | 8.753863 | 5E-14 | 3866.001. | NM_002275.2 | CQ733235.1 | GENBANK_PATENT | 23 |
| 354 | 1756.013.1-B_at | −0.67402 | 0.67402382 | 8.75176 | 5E-14 | 1756.013. | NM_000109.2 | NM_004019.1 | REFSEQ | 2 |
| 355 | 2115.006.1-E_at | −0.67381 | 0.67381491 | 8.746791 | 5E-14 | 2115.006. | NM_004956.3 | DA210177.1 | EST | 1 |
| 356 | 6376.001.2-F_at | −0.67341 | 0.6734055 | 8.737064 | 5E-14 | 6376.001. | NM_002996.3 | AK223351.1 | mRNA | 48 |
| 357 | 3084.004.1-B_at | −0.67338 | 0.67337698 | 8.736388 | 5E-14 | 3084.004. | NM_013957.1 | NM_013964.1 | REFSEQ | 5 |
| 358 | 3815.002.4F_at | −0.67334 | 0.67333838 | 8.735471 | 5E-14 | 3815.002. | NM_000222.1 | CQ719901.1 | GENBANK_PATENT | 1 |
| 359 | 8404.002.1-D_at | −0.6733 | 0.6733018 | 8.734603 | 5E-14 | 8404.002. | NM_004684.2 | BP383384.1 | EST | 1 |
| 360 | 1264.006.1-T_at | −0.67319 | 0.67318534 | 8.73184 | 5E-14 | 1264.006. | NM_001299.4 | CN366945.1 | EST | 1 |
| 361 | 59.022.2-D_at | −0.67316 | 0.67315986 | 8.731236 | 5E-14 | 59.022.2 | — | — | — | |
| 362 | 25925.001.1-T_at | −0.67306 | 0.67306029 | 8.728874 | 6E-14 | 25925.001 | NM_015461.1 | BC032869.2 | mRNA | 19 |
| 363 | 4638.006.2-B_at | −0.67278 | 0.67278344 | 8.722314 | 6E-14 | 4638.006. | NM_053025.2 | DR005817.1 | EST | 2 |
| 364 | 7373.003.5-B_at | −0.67271 | 0.67270981 | 8.72057 | 6E-14 | 7373.003. | NM_021110.1 | CQ716670.1 | GENBANK_PATENT | 1 |
| 365 | 8404.035.1-B_at | −0.6727 | 0.67269572 | 8.720236 | 6E-14 | 8404.035. | NM_004684.2 | BG716198.1 | EST | 1 |
| 366 | 59.012.1-T_at | −0.67254 | 0.67254112 | 8.716577 | 7E-14 | 59.012.1 | NM_001613.1 | AL546033.3 | EST | 1 |
| 367 | 3852.017.2-T_at | −0.67188 | 0.67188165 | 8.70099 | 7E-14 | 3852.017. | NM_000424.2 | CV575305.1 | EST | 1 |
| 368 | 3866.012.2-B_at | −0.67185 | 0.67184565 | 8.70014 | 7E-14 | 3866.012. | NM_002275.2 | BI772438.1 | EST | 1 |
| 369 | 2.022.1-B_at | −0.67169 | 0.67168628 | 8.69638 | 6E-14 | 2.022.1 | NM_000424.4 | BP343424.1 | EST | 1 |
| 370 | 27122.016.1-F_at | −0.67125 | 0.67124955 | 8.686085 | 7E-14 | 27122.016 | NM_013253.4 | BQ962557.1 | GENBANK_PATENT | 1 |
| 371 | 4311.009.1-B_at | −0.67109 | 0.67108684 | 8.682254 | 7E-14 | 4311.009. | NM_000902.2 | A30431.1 | EST | 1 |
| 372 | 59.031.2-T_at | −0.67084 | 0.67084085 | 8.676467 | 7E-14 | 59.031.2 | NM_001613.1 | BG197213.1 | EST | 19 |
| 373 | 4311.009.1-T_at | −0.67054 | 0.67053973 | 8.669389 | 7E-14 | 4311.009. | NM_000902.2 | A30431.1 | GENBANK_PATENT | 1 |
| 374 | 3866.006.2-B_at | −0.67045 | 0.67044748 | 8.667223 | 7E-14 | 3866.006. | NM_002275.2 | BQ641523.1 | EST | 1 |
| 375 | 57447.025.2-T_at | −0.67023 | 0.67022566 | 8.662016 | 7E-14 | 57447.025 | NM_201535.1 | DA646455.1 | EST | 2 |
| 376 | 1717.007.1-F_at | −0.67014 | 0.67013656 | 8.659925 | 8E-14 | 1717.007. | NM_001360.1 | BX438503.2 | GENBANK_PATENT | 1 |
| 377 | 59.004.2-D_at | −0.67008 | 0.67008376 | 8.658687 | 8E-14 | 59.004.2 | NM_001613.1 | CQ696293.1 | GENBANK_PATENT | 1 |
| 378 | 3866.007.2-B_at | −0.66995 | 0.66994537 | 8.655442 | 8E-14 | 3866.007. | NM_002275.2 | BM548942.1 | EST | 1 |
| 379 | 3866.010.1-F_at | −0.66945 | 0.66944797 | 8.643794 | 8E-14 | 3866.010. | NM_002275.2 | BM045201.1 | EST | 1 |
| 380 | 9768.001.1-T_at | −0.66933 | 0.66933125 | 8.641063 | 8E-14 | 9768.004. | NM_014736.4 | BG506365.1 | EST | 1 |
| 381 | 3084.012.2-T_at | −0.66928 | 0.66928297 | 8.639934 | 8E-14 | 3084.012. | NM_013957.1 | U02325.1 | mRNA | 2 |
| 382 | 1410.004.2-B_at | −0.66925 | 0.66925228 | 8.639216 | 8E-14 | 1410.004. | NM_001885.1 | AX888027.1 | GENBANK_PATENT | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 383 | 59.008.1-D_at | −0.66919 | 0.66919054 | 8.637773 | 8E-14 | 59.008.1 | NM_001613.1 | BP373197.1 | EST | 1 |
| 384 | 57447.030.1-C_at | −0.66908 | 0.66908366 | 8.635275 | 8E-14 | 57447.030 | NM_201535.1 | BM783465.1 | EST | 5 |
| 385 | 2327.002.1-D_at | −0.66908 | 0.66907887 | 8.635163 | 8E-14 | 2327.002. | NM_001460.2 | CD684429.1 | EST | 1 |
| 386 | 1308.004.1-B_at | −0.66865 | 0.66864754 | 8.625092 | 9E-14 | 1308.004. | NM_130778.1 | BF615666.1 | EST | 1 |
| 387 | 2568.005.2-B_at | −0.66838 | 0.66838113 | 8.61888 | 9E-14 | 2568.005. | NM_014211.1 | AK055205.1 | mRNA | 11 |
| 388 | 2568.001.1-T_at | −0.66811 | 0.66811257 | 8.612624 | 9E-14 | 2568.001. | NM_014211.1 | BX509618.1 | EST | 1 |
| 389 | 3084.004.2-T_at | −0.66789 | 0.66788994 | 8.607442 | 1E-13 | 3084.004. | NM_013957.1 | NM_013964.1 | REFSEQ | 5 |
| 390 | 7373.003.4-B_at | −0.66777 | 0.66776994 | 8.604651 | 1E-13 | 7373.003. | NM_021110.1 | CQ716670.1 | GENBANK_PATENT | 1 |
| 391 | 7153.002.2-D_at | −0.667642 | 0.66764203 | 8.601677 | 1E-13 | 7153.002. | NM_001067.2 | CQ735949.1 | GENBANK_PATENT | 114 |
| 392 | 2893.006.2-T_at | −0.66761 | 0.66760773 | 8.600829 | 1E-13 | 2893.006. | NM_000829.1 | BF669210.1 | EST | 1 |
| 393 | 3872.016.1-D_at | −0.66759 | 0.66758641 | 8.600384 | 1E-13 | 3872.016. | NM_000422.1 | CB127430.1 | EST | 1 |
| 394 | 9413.006.1-F_at | −0.6674 | 0.6674036 | 8.596137 | 1E-13 | 9413.006. | NM_004816.2 | BC021685.1 | mRNA | 2 |
| 395 | 59.023.2-B_at | −0.66731 | 0.6673108 | 8.593982 | 1E-13 | 59.023.2 | NM_001613.1 | DB248573.1 | EST | 1 |
| 396 | 72.005.1-B_at | −0.66711 | 0.66711142 | 8.589354 | 1E-13 | 72.005.1 | NM_001615.3 | CF130984.1 | EST | 20 |
| 397 | 4915.011.1-C_at | −0.66689 | 0.66688915 | 8.5842 | 1E-13 | 4915.011. | NM_006180.3 | CQ723929.1 | GENBANK_PATENT | 1 |
| 398 | 27122.018.1-F_at | −0.66662 | 0.6666247 | 8.578072 | 1E-13 | 27122.018 | NM_013253.4 | BG715341.1 | EST | 1 |
| 399 | 3852.006.1-B_at | −0.66652 | 0.66652184 | 8.57569 | 1E-13 | 3852.006. | NM_000424.2 | BG679014.1 | EST | 1 |
| 400 | 4638.006.2-D_at | −0.66649 | 0.66648584 | 8.574857 | 1E-13 | 4638.006. | NM_053025.2 | DR005817.1 | EST | 2 |
| 401 | 7153.005.1-E_at | −0.666056 | 0.66605623 | 8.56492 | 1E-13 | 7153.005. | NM_001067.2 | DB061604.1 | EST | 1 |
| 402 | 7373.001.2-T_at | −0.66587 | 0.66587031 | 8.560624 | 1E-13 | 7373.001. | NM_021110.1 | DB089175.1 | EST | 1 |
| 403 | 7018.026.1-B_at | −0.66537 | 0.66537209 | 8.549127 | 1E-13 | 7018.026. | NM_001063.2 | BM690655.1 | EST | 1 |
| 404 | 7402.014.1-B_at | −0.66525 | 0.66524627 | 8.546227 | 1E-13 | 7402.014. | NM_007124.1 | AL703969.1 | EST | 1 |
| 405 | 57447.010.3-D_at | −0.66513 | 0.66513034 | 8.543556 | 1E-13 | 57447.010 | NM_201535.1 | BP349691.1 | EST | 1 |
| 406 | 140446.004.1-T | −0.66502 | 0.66501858 | 8.540982 | 1E-13 | 140446.00 | NM_058242.1 | DB016079.1 | EST | 1 |
| 407 | 59.026.2-T_at | −0.66495 | 0.66494798 | 8.539356 | 1E-13 | 59.026.2 | — | — | — | — |
| 408 | 59.038.1-T_at | −0.66494 | 0.66493959 | 8.539163 | 1E-13 | 59.038.1 | NM_001613.1 | EH_001613.2 | PREDICTED | 1 |
| 409 | 4240.009.1-C_at | −0.66471 | 0.66470997 | 8.553879 | 1E-13 | 4240.009. | NM_005928.1 | BG829936.1 | EST | 2 |
| 410 | 57447.030.1-F_at | −0.66468 | 0.66468295 | 8.533258 | 1E-13 | 57447.030 | NM_201535.1 | BM783465.1 | EST | 5 |
| 411 | 9768.004.1-B_at | −0.664563 | 0.66456315 | 8.530503 | 1E-13 | 9768.004. | NM_014736.4 | BG506365.1 | EST | 2 |
| 412 | 57447.008.1-T_at | −0.66453 | 0.66453368 | 8.529826 | 1E-13 | 57447.008 | NM_201535.1 | DB195772.1 | EST | 1 |
| 413 | 59.014.2-T_at | −0.66423 | 0.66423397 | 8.52294 | 1E-13 | 59.014.2 | NM_001613.1 | CB962422.1 | EST | 1 |
| 414 | 4915.012.1-T_at | −0.66407 | 0.6640741 | 8.51927 | 1E-13 | 4915.012. | NM_006180.3 | CD103051.1 | EST | 1 |
| 415 | 3866.004.1-T_at | −0.66398 | 0.66397879 | 8.517083 | 1E-13 | 3866.004. | NM_002275.2 | BC110649.1 | mRNA | 1 |
| 416 | 2582.007.2-C_at | −0.66357 | 0.66357028 | 8.507718 | 2E-13 | 2582.007. | NM_001008216. | AK057302.1 | GENBANK_PATENT | 32 |
| 417 | 7153.002.5-T_at | 0.663259 | 0.66325931 | 8.500598 | 2E-13 | 7153.002. | NM_001067.2 | CQ735949.1 | GENBANK_PATENT | 114 |
| 418 | 4638.009.1-F_at | −0.66296 | 0.66295877 | 8.493725 | 2E-13 | 4638.009. | NM_053025.2 | AX885051.1 | GENBANK_PATENT | 39 |
| 419 | 3861.023.1-T_at | −0.66279 | 0.66279224 | 8.489919 | 2E-13 | 3861.023. | NM_000526.3 | BG676679.1 | EST | 1 |
| 420 | 5858.003.3-C_at | −0.66243 | 0.66242627 | 8.481564 | 2E-13 | 5858.003. | NM_002864.1 | AX512279.1 | GENBANK_PATENT | 2 |
| 421 | 3861.020.1-F_at | −0.66242 | 0.66241661 | 8.481344 | 2E-13 | 3861.020. | NM_000526.3 | BM018298.1 | EST | 1 |
| 422 | 147495.005.1-T | −0.66232 | 0.66231598 | 8.479048 | 2E-13 | 147495.00 | NM_153000.3 | BI822892.1 | EST | 1 |
| 423 | 4638.006.2-C_at | −0.66228 | 0.66227571 | 8.47813 | 2E-13 | 4638.006. | NM_053025.2 | DR005817.1 | EST | 2 |
| 424 | 1308.004.1-F_at | −0.66213 | 0.66212634 | 8.474725 | 2E-13 | 1308.004. | NM_130778.1 | BF615666.1 | EST | 1 |
| 425 | 4915.004.1-F_at | −0.66185 | 0.66184583 | 8.468335 | 2E-13 | 4915.004. | NM_006180.3 | NM_001018066 | REFSEQ | 28 |
| 426 | 3866.008.1-B_at | −0.66173 | 0.66172906 | 8.465676 | 2E-13 | 3866.008. | NM_002275.2 | BI771363.1 | EST | 1 |
| 427 | 8626.002.1-E_at | −0.66173 | 0.66172521 | 8.465589 | 2E-13 | 8626.002. | NM_000526.1 | AB016072.1 | mRNA | 16 |
| 428 | 1264.003.1-T_at | −0.66156 | 0.66156109 | 8.461855 | 2E-13 | 1264.003. | NM_037722.3 | CV811526.1 | EST | 1 |
| 429 | 59.042.1-F_at | −0.66151 | 0.66151227 | 8.460744 | 2E-13 | 59.042.1 | NM_001299.4 | EH_001613.8 | PREDICTED | 1 |
| 430 | 4833.004.1-C_at | 0.661269 | 0.66126853 | 8.455204 | 2E-13 | 4833.004. | NM_005009.2 | BG478602.1 | EST | 8 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 431 | 2568.006.1-B_at | −0.66106 | 0.661057 | 8.450399 | 2E-13 | 2568.006. | NM_014211.1 | CD385249.1 | EST | 1 |
| 432 | 57447.004.2-T_at | −0.66103 | 0.66102604 | 8.449696 | 2E-13 | 57447.004 | NM_201535.1 | CD515320.1 | EST | 2 |
| 433 | 59.014.2-B_at | −0.66085 | 0.66084763 | 8.445647 | 2E-13 | 59.014.2 | NM_001613.1 | CB962422.1 | EST | 1 |
| 434 | 3084.012.1-T_at | −0.66068 | 0.66068046 | 8.441855 | 2E-13 | 3084.012. | NM_013957.1 | U02325.1 | mRNA | 1 |
| 435 | 27122.017.1-T_at | −0.6605 | 0.66049978 | 8.43776 | 2E-13 | 27122.017 | NM_013253.4 | CB155251.1 | EST | 1 |
| 436 | 3852.012.2-T_at | −0.66039 | 0.66039403 | 8.435364 | 2E-13 | 3852.012. | NM_000424.2 | CQ733668.1 | GENBANK_PATENT | 1 |
| 437 | 59.033.1-T_at | −0.66029 | 0.66028879 | 8.43298 | 2E-13 | 59.033.1 | — | — | — | — |
| 438 | 27122.002.1-C_at | −0.66018 | 0.66018203 | 8.430563 | 2E-13 | 27122.002 | NM_013253.4 | AK098756.1 | mRNA | 1 |
| 439 | 3880.011.1-B_at | −0.65981 | 0.65981353 | 8.422227 | 2E-13 | 3880.011. | NM_002276.3 | BP330400.1 | EST | 1 |
| 440 | 65983.013.1-T_at | −0.65959 | 0.65958733 | 8.417116 | 2E-13 | 65983.013 | NM_023927.1 | AA610396.1 | EST | 1 |
| 441 | 3872.014.1-T_at | −0.65949 | 0.65948987 | 8.414915 | 2E-13 | 3872.014. | NM_000422.1 | BG678436.1 | EST | 1 |
| 442 | 162605.001.4-C | −0.65946 | 0.65945748 | 8.414184 | 2E-13 | 162605.00 | NM_181535.2 | CQ735954.1 | GENBANK_PATENT | 1 |
| 443 | 59.031.2-B_at | −0.65937 | 0.65937317 | 8.41228 | 2E-13 | 59.031.2 | NM_001613.1 | BG197213.1 | EST | 19 |
| 444 | 3084.012.2-B_at | −0.65926 | 0.65925637 | 8.409644 | 3E-13 | 3084.012. | NM_013957.1 | U02325.1 | mRNA | 1 |
| 445 | 5858.001.2-C_at | −0.65925 | 0.65925226 | 8.409552 | 3E-13 | 5858.001. | NM_002864.1 | BC111756.1 | mRNA | 2 |
| 446 | 65983.010.1-T_at | −0.65919 | 0.65918848 | 8.408113 | 3E-13 | 65983.010 | NM_023927.1 | DB261377.1 | EST | 1 |
| 447 | 7373.003.5-F_at | −0.65893 | 0.65892789 | 8.402237 | 3E-13 | 7373.003. | NM_021110.1 | CQ716670.1 | GENBANK_PATENT | 1 |
| 448 | 3866.010.1-T_at | −0.65871 | 0.65871193 | 8.397372 | 3E-13 | 3866.010. | NM_002275.2 | BM045201.1 | EST | 1 |
| 449 | 8404.005.1-B_at | −0.65871 | 0.65870759 | 8.397274 | 3E-13 | 8404.005. | NM_004684.2 | DA763956.1 | EST | 1 |
| 450 | 3866.005.1-T_at | −0.65866 | 0.65866359 | 8.396284 | 3E-13 | 3866.005. | NM_002275.2 | AL832226.1 | mRNA | 37 |
| 451 | 59.003.1-F_at | −0.65865 | 0.65864902 | 8.395956 | 3E-13 | 59.003.1 | NM_001613.1 | DD218797.1 | GENBANK_PATENT | 1 |
| 452 | 7153.002.5-F_at | 0.658561 | 0.65856119 | 8.393979 | 3E-13 | 7153.002. | NM_001067.2 | CQ735949.1 | GENBANK_PATENT | 114 |
| 453 | 2487.001.1-T_at | −0.65846 | 0.65846487 | 8.391811 | 3E-13 | 2487.001. | NM_001463.2 | CS141780.1 | GENBANK_PATENT | 7 |
| 454 | 3866.010.1-B_at | −0.6577 | 0.65770261 | 8.374683 | 3E-13 | 3866.010. | NM_002275.2 | BM045201.1 | EST | 1 |
| 455 | 147495.009.1-T | −0.65745 | 0.65745477 | 8.369124 | 3E-13 | 147495.00 | NM_153000.3 | CX164031.1 | EST | 1 |
| 456 | 65983.003.2-T_at | −0.65736 | 0.65735504 | 8.366888 | 3E-13 | 65983.003 | NM_023927.1 | BP292708.1 | EST | 1 |
| 457 | 59.040.1-D_at | −0.65731 | 0.65731134 | 8.365909 | 3E-13 | 59.040.1 | NM_001613.1 | EH_001613.6 | PREDICTED | 1 |
| 458 | 59.024.2-T_at | −0.6568 | 0.65679913 | 8.35444 | 3E-13 | 59.024.2 | — | — | — | — |
| 459 | 1717.009.2-B_at | −0.65673 | 0.65673229 | 8.352945 | 3E-13 | 1717.009. | NM_001360.1 | DB170498.1 | EST | 1 |
| 460 | 1756.027.1-F_at | −0.65672 | 0.6567193 | 8.352655 | 3E-13 | 1756.027. | NM_000109.2 | S60971.1 | mRNA | 1 |
| 461 | 59.042.1-B_at | −0.65672 | 0.65671619 | 8.352585 | 3E-13 | 59.042.1 | NM_001613.1 | EH_001613.8 | PREDICTED | 1 |
| 462 | 7153.002.5-D_at | 0.656687 | 0.65668727 | 8.351939 | 3E-13 | 7153.002. | NM_001067.2 | CQ735949.1 | GENBANK_PATENT | 114 |
| 463 | 57447.031.1-F_at | −0.6565 | 0.65650401 | 8.347842 | 4E-13 | 57447.031 | NM_201535.1 | AI272253.1 | EST | 1 |
| 464 | 140885.011.1-C | −0.65642 | 0.6564245 | 8.346065 | 4E-13 | 140885.01 | NM_080792.2 | BM041242.1 | EST | 1 |
| 465 | 59.003.1-T_at | −0.65633 | 0.65632979 | 8.34395 | 4E-13 | 59.003.1 | NM_001613.1 | DD218797.1 | GENBANK_PATENT | 1 |
| 466 | 3832.002.1-D_at | 0.655783 | 0.65578291 | 8.331747 | 4E-13 | 3832.002. | NM_004523.2 | BQ959682.1 | EST | 1 |
| 467 | 3880.005.1-D_at | −0.65576 | 0.65576275 | 8.331298 | 4E-13 | 3880.005. | NM_002276.3 | BE732853.1 | EST | 1 |
| 468 | 3084.012.1-F_at | −0.65533 | 0.65532867 | 8.32163 | 4E-13 | 3084.012. | NM_013957.1 | U02325.1 | mRNA | 1 |
| 469 | 6595.012.1-D_at | −0.65524 | 0.65523847 | 8.319622 | 4E-13 | 6595.012. | NM_003070.3 | DA368288.1 | EST | 1 |
| 470 | 59.012.2-D_at | −0.65512 | 0.65511987 | 8.316984 | 4E-13 | 59.012.2 | NM_001613.1 | AL546033.3 | EST | 1 |
| 471 | 57447.034.1-C_at | −0.655 | 0.65500441 | 8.314417 | 4E-13 | 57447.034 | NM_201535.1 | BC011240.1 | mRNA | 1 |
| 472 | 56477.001.1-B_at | −0.65493 | 0.65492856 | 8.312731 | 4E-13 | 56477.001 | NM_148672.1 | NM_019846.3 | REFSEQ | 13 |
| 473 | 57447.041.1-D_at | −0.65415 | 0.65415460 | 8.295552 | 4E-13 | 57447.041 | NM_201535.1 | DA295124.1 | EST | 1 |
| 474 | 9768.005.1-B_at | 0.653838 | 0.65383824 | 8.288543 | 5E-13 | 9768.005. | NM_014736.4 | BG529193.1 | EST | 13 |
| 475 | 285203.001.2-C | −0.65337 | 0.653374 | 8.278271 | 5E-13 | 285203.00 | NM_173654.1 | AK126187.1 | mRNA | 3 |
| 476 | 147495.006.1-B | −0.65324 | 0.6532398 | 8.275305 | 5E-13 | 147495.00 | NM_153000.3 | CN421888.1 | EST | 1 |
| 477 | 7018.029.1-D_at | −0.65323 | 0.65323377 | 8.275172 | 5E-13 | 7018.029. | NM_001063.2 | AV656085.1 | EST | 1 |
| 478 | 3852.009.1-T_at | −0.65315 | 0.65314811 | 8.273279 | 5E-13 | 3852.009. | NM_000424.2 | BQ378037.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 479 | 59.023.2-D_at | −0.65311 | 0.65311489 | 8.272545 | 5E-13 | 59.023.2 | NM_001613.1 | DB248573.1 | EST | 1 |
| 480 | 1959.002.1-D_at | −0.65279 | 0.65278556 | 8.265275 | 5E-13 | 1959.002. | NM_000399.2 | DB264199.1 | EST | 5 |
| 481 | 7018.014.1-D_at | −0.65274 | 0.65273731 | 8.264211 | 5E-13 | 7018.014. | NM_001063.2 | AX147483.1 | GENBANK_PATENT | 1 |
| 482 | 5858.004.1-F_at | −0.65256 | 0.65255793 | 8.260255 | 5E-13 | 5858.004. | NM_002864.1 | DB033417.1 | EST | 1 |
| 483 | 79192.002.2-D_at | −0.65251 | 0.65251201 | 8.259242 | 5E-13 | 79192.002 | NM_024337.3 | CQ731489.1 | GENBANK_PATENT | 1 |
| 484 | 59.008.2-B_at | −0.65248 | 0.65247737 | 8.258479 | 5E-13 | 59.008.2 | NM_001613.1 | BP373197.1 | EST | 1 |
| 485 | 8404.008.1-E_at | −0.65196 | 0.65195548 | 8.246986 | 6E-13 | 8404.008. | NM_004684.2 | DA342341.1 | EST | 1 |
| 486 | 59.008.1-F_at | −0.65193 | 0.65192656 | 8.24635 | 6E-13 | 59.008.1 | NM_001613.1 | BP373197.1 | EST | 1 |
| 487 | 4240.011.1-B_at | −0.65168 | 0.65168158 | 8.240963 | 6E-13 | 4240.011. | NM_005928.1 | DA921691.1 | EST | 1 |
| 488 | 94274.002.1-C_at | −0.65161 | 0.65161159 | 8.239425 | 6E-13 | 94274.002 | NM_033256.1 | CQ730829.1 | GENBANK_PATENT | 1 |
| 489 | 4638.015.1-T_at | −0.65116 | 0.65115703 | 8.229444 | 6E-13 | 4638.015. | NM_053025.2 | NM_053029.2 | REFSEQ | 2 |
| 490 | 6376.001.1-T_at | −0.65101 | 0.6510092 | 8.226201 | 6E-13 | 6376.001. | NM_002996.3 | AK223351.1 | mRNA | 48 |
| 491 | 57447.043.1-F_at | −0.65059 | 0.65059178 | 8.217053 | 6E-13 | 57447.043 | NM_201535.1 | DA829299.1 | EST | 1 |
| 492 | 59.039.1-T_at | −0.65045 | 0.65045393 | 8.214035 | 6E-13 | 59.039.1 | NM_001613.1 | EH_001613.4 | PREDICTED | 1 |
| 493 | 4638.006.1-B_at | −0.65024 | 0.65023997 | 8.209353 | 7E-13 | 4638.006. | NM_053025.2 | DR005817.1 | EST | 2 |
| 494 | 25802.003.1-F_at | −0.65011 | 0.65011381 | 8.206594 | 7E-13 | 25802.003 | NM_012134.1 | BC001755.1 | mRNA | 1 |
| 495 | 57447.025.1-T_at | −0.65004 | 0.65003729 | 8.204921 | 7E-13 | 57447.025 | NM_201535.1 | DA646455.1 | EST | 2 |
| 496 | 57447.017.1-T_at | −0.64984 | 0.64984134 | 8.20064 | 7E-13 | 57447.017 | NM_201535.1 | DA130260.1 | EST | 2 |
| 497 | 7018.026.1-C_at | −0.64969 | 0.64969118 | 8.19736 | 7E-13 | 7018.026. | NM_001063.2 | BM690655.1 | EST | 1 |
| 498 | 7018.028.1-E_at | −0.64913 | 0.64913076 | 8.185136 | 7E-13 | 7018.028. | NM_001063.2 | BX537660.1 | mRNA | 1 |
| 499 | 4915.008.1-C_at | −0.64904 | 0.64904081 | 8.183176 | 7E-13 | 4915.008. | NM_006180.3 | NM_001007097 | REFSEQ | 4 |
| 500 | 358.018.1-C_at | −0.64903 | 0.64902608 | 8.182855 | 7E-13 | 358.018.1 | NM_198098.1 | BT765065.1 | EST | 1 |
| 501 | 7153.002.6-B_at | −0.648669 | 0.648866924 | 8.175087 | 8E-13 | 7153.002. | NM_001067.2 | CQ735949.1 | GENBANK_PATENT | 114 |
| 502 | 57447.012.1-B_at | −0.6478 | 0.64780212 | 8.156247 | 9E-13 | 57447.012 | NM_201535.1 | DB294263.1 | EST | 1 |
| 503 | 59.040.1-T_at | −0.6477 | 0.64769503 | 8.153924 | 9E-13 | 59.040.1 | NM_001613.1 | EH_001613.6 | PREDICTED | 1 |
| 504 | 57447.006.1-T_at | −0.64719 | 0.64718891 | 8.142957 | 9E-13 | 57447.006 | NM_201535.1 | DA283861.1 | EST | 4 |
| 505 | 9493.006.1-A_at | −0.646558 | 0.646555111 | 8.129315 | 1E-12 | 9493.006. | NM_138555.1 | BF240578.1 | EST | 1 |
| 506 | 57447.004.1-T_at | −0.64628 | 0.64628054 | 8.123321 | 1E-12 | 57447.004 | NM_201535.1 | CD515320.1 | EST | 2 |
| 507 | 57447.004.2-B_at | −0.64619 | 0.64619175 | 8.121404 | 1E-12 | 57447.004 | NM_201535.1 | CD515320.1 | EST | 2 |
| 508 | 7373.001.2-D_at | −0.64567 | 0.64566532 | 8.110055 | 1E-12 | 7373.001. | NM_021110.1 | DB089175.1 | EST | 1 |
| 509 | 9493.004.1-B_at | −0.64562 | 0.64562012 | 8.109081 | 1E-12 | 9493.004. | NM_138555.1 | BM792243.1 | EST | 1 |
| 510 | 2568.005.2-C_at | −0.64555 | 0.64555051 | 8.107582 | 1E-12 | 2568.005. | NM_014211.1 | AK055205.1 | mRNA | 11 |
| 511 | 7018.029.1-F_at | −0.64542 | 0.64541955 | 8.104763 | 1E-12 | 7018.029. | NM_001063.2 | AV656085.1 | EST | 1 |
| 512 | 26289.013.1-B_at | −0.64525 | 0.64525015 | 8.101118 | 1E-12 | 26289.013 | NM_174858.1 | CK024190.1 | EST | 1 |
| 513 | 7169.015.1-B_at | −0.64523 | 0.64522581 | 8.100594 | 1E-12 | 7169.015. | NM_213674.1 | DB291177.1 | EST | 1 |
| 514 | 57451.001.3-F_at | −0.64518 | 0.64517957 | 8.0996 | 1E-12 | 57451.001 | XM_931456.1 | CS188752.1 | GENBANK_PATENT | 1 |
| 515 | 2568.005.2-F_at | −0.64485 | 0.64485248 | 8.092569 | 1E-12 | 2568.005. | NM_014211.1 | AK055205.1 | mRNA | 11 |
| 516 | 57447.004.2-F_at | −0.6444 | 0.6444048 | 8.082959 | 1E-12 | 57447.004 | NM_201535.1 | CD515320.1 | EST | 2 |
| 517 | 8404.004.1-B_at | −0.64434 | 0.6443376 | 8.081518 | 1E-12 | 8404.004. | NM_004684.2 | DA589023.1 | EST | 1 |
| 518 | 3855.004.2-D_at | −0.64418 | 0.64418264 | 8.078194 | 1E-12 | 3855.004. | NM_005556.3 | BU164293.1 | EST | 1 |
| 519 | 3872.014.1-F_at | −0.64417 | 0.64416831 | 8.077888 | 1E-12 | 3872.014. | NM_000422.1 | BG678436.1 | EST | 1 |
| 520 | 57447.033.1-F_at | −0.64416 | 0.64415874 | 8.077683 | 1E-12 | 57447.033 | NM_201535.1 | DA135222.1 | EST | 11 |
| 521 | 9452.001.1-T_at | −0.64405 | 0.64404914 | 8.075458 | 1E-12 | 9452.001. | NM_004867.3 | BG713980.1 | EST | 4 |
| 522 | 59.033.2-T_at | −0.64401 | 0.6440144 | 8.07459 | 1E-12 | 59.033.2 | NM_001613.1 | BQ881176.1 | EST | 6 |
| 523 | 3084.009.1-T_at | −0.64398 | 0.64398407 | 8.07394 | 1E-12 | 3084.009. | NM_013957.1 | U02327.1 | mRNA | 2 |
| 524 | 57447.040.1-T_at | −0.64395 | 0.6439477 | 8.073161 | 1E-12 | 57447.040 | NM_201535.1 | DA207862.1 | EST | 1 |
| 525 | 4833.004.1-T_at | 0.643936 | 0.64393608 | 8.072912 | 1E-12 | 4833.004. | NM_005009.2 | BG478602.1 | EST | 8 |
| 526 | 3426.001.1-F_at | −0.64388 | 0.64388211 | 8.071756 | 1E-12 | 3426.001. | NM_000204.1 | BC020718.1 | mRNA | 165 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 527 | 59.034.1-B_at | −0.64382 | 0.64381551 | 8.07033 | 1E-12 | 59.034.1 | — | — | — | — |
| 528 | 10253.001.1-E_at | −0.64381 | 0.64381114 | 8.070237 | 1E-12 | 10253.001 | NM_005842.2 | BE297407.1 | EST | 1 |
| 529 | 9073.001.1-C_at | −0.64379 | 0.64379361 | 8.069862 | 1E-12 | 9073.001. | NM_199328.1 | BC020866.1 | mRNA | 1 |
| 530 | 51201.005.1-T_at | −0.64366 | 0.64366016 | 8.067005 | 1E-12 | 51201.005 | NM_016353.2 | DA655803.1 | EST | 1 |
| 531 | 9477.006.1-C_at | −0.64347 | 0.64347364 | 8.063015 | 1E-12 | 9477.006. | NM_004275.3 | DA588860.1 | EST | 1 |
| 532 | 57447.028.1-T_at | −0.64334 | 0.64334257 | 8.060213 | 1E-12 | 57447.028 | NM_201535.1 | DA205446.1 | EST | 1 |
| 533 | 25925.007.1-T_at | −0.64319 | 0.64319062 | 8.056966 | 1E-12 | 25925.007 | NM_015461.1 | DA235718.1 | EST | 1 |
| 534 | 59.024.2-B_at | −0.64296 | 0.64295617 | 8.051959 | 1E-12 | 59.024.2 | — | — | — | — |
| 535 | 2.022.1-T_at | −0.64285 | 0.64285401 | 8.049778 | 1E-12 | 2.022.1 | NM_000014.4 | BP343424.1 | EST | 1 |
| 536 | 4281.008.2-B_at | −0.64283 | 0.64282648 | 8.04919 | 1E-12 | 4281.008. | NM_033984.1 | AY539984.1 | mRNA | 1 |
| 537 | 90231.001.1-C_at | −0.64281 | 0.64281469 | 8.048939 | 1E-12 | 90231.001 | NM_138346.1 | BQ673619.1 | EST | 1 |
| 538 | 358.012.1-D_at | −0.64281 | 0.64280918 | 8.048821 | 1E-12 | 358.012.1 | NM_198098.1 | AX597685.1 | GENBANK_PATENT | 1 |
| 539 | 3852.021.1-T_at | −0.64278 | 0.64278273 | 8.048257 | 1E-12 | 3852.021. | NM_000424.2 | DA764437.1 | EST | 1 |
| 540 | 7373.003.4-D_at | −0.64275 | 0.64274774 | 8.04751 | 1E-12 | 7373.003. | NM_021110.1 | CQ716670.1 | GENBANK_PATENT | 1 |
| 541 | 57447.048.1-T_at | −0.64264 | 0.64264124 | 8.045239 | 1E-12 | 57447.048 | NM_201535.1 | BX480398.1 | EST | 1 |
| 542 | 358.012.1-B_at | −0.6417 | 0.617015 | 8.025228 | 2E-12 | 358.012.1 | NM_198098.1 | AX597685.1 | GENBANK_PATENT | 1 |
| 543 | 7018.025.1-C_at | −0.64167 | 0.64166912 | 8.024539 | 2E-12 | 7018.025. | NM_001063.2 | BE971065.1 | EST | 1 |
| 544 | 5608.004.1-T_at | −0.64157 | 0.64157449 | 8.022528 | 2E-12 | 5608.004. | NM_002758.2 | AL709891.1 | EST | 1 |
| 545 | 3084.012.2-F_at | −0.64148 | 0.64148473 | 8.020621 | 2E-12 | 3084.012. | NM_013957.1 | U02325.1 | mRNA | 1 |
| 546 | 4306.002.1-C_at | −0.64137 | 0.64137229 | 8.018232 | 2E-12 | 4306.002. | NM_000901.1 | AJ315515.1 | EST | 1 |
| 547 | 4288.004.1-D_at | 0.641215 | 0.64121481 | 8.014889 | 2E-12 | 4288.004. | NM_002417.2 | BP232141.1 | EST | 2 |
| 548 | 57447.002.1-F_at | −0.6411 | 0.6411459 | 8.012549 | 2E-12 | 57447.002 | NM_201535.1 | BF526188.1 | EST | 1 |
| 549 | 4281.018.1-T_at | −0.64087 | 0.64086989 | 8.007571 | 2E-12 | 4281.018. | NM_033290.1 | AY539998.1 | mRNA | 1 |
| 550 | 10144.020.2-B_at | −0.64053 | 0.64053304 | 8.000433 | 2E-12 | 10144.020 | NM_014883.2 | DA864231.1 | EST | 1 |
| 551 | 6876.016.1-E_at | −0.64047 | 0.64046896 | 7.999075 | 2E-12 | 6876.016. | NM_001001522. | AB209555.1 | mRNA | 2 |
| 552 | 57447.008.2-T_at | −0.64046 | 0.64045856 | 7.998855 | 2E-12 | 57447.008 | NM_201535.1 | DB195772.1 | EST | 1 |
| 553 | 51203.004.1-T_at | −0.640272 | 0.64027205 | 7.994907 | 2E-12 | 51203.004 | NM_016359.2 | DB126040.1 | EST | 1 |
| 554 | 2335.028.1-B_at | 0.639825 | 0.63982479 | 7.985449 | 2E-12 | 2335.028. | NM_212482.1 | AJ320525.1 | mRNA | 1 |
| 555 | 7018.028.1-F_at | −0.63974 | 0.63973608 | 7.983575 | 2E-12 | 7018.028. | NM_001063.2 | BX537660.1 | mRNA | 1 |
| 556 | 7373.003.5-T_at | −0.63956 | 0.63955526 | 7.979756 | 2E-12 | 7373.003. | NM_021110.1 | CQ716670.1 | GENBANK_PATENT | 1 |
| 557 | 81557.006.1-C_at | −0.63955 | 0.63955366 | 7.979722 | 2E-12 | 81557.006 | NM_030801.2 | AK094541.1 | mRNA | 9 |
| 558 | 3866.002.1-D_at | −0.63923 | 0.63923163 | 7.972927 | 2E-12 | 3866.002. | NM_022275.2 | BG990007.1 | EST | 1 |
| 559 | 3866.001.1-B_at | −0.63865 | 0.63865251 | 7.960724 | 2E-12 | 3866.001. | NM_002275.2 | CQ733235.1 | GENBANK_PATENT | 23 |
| 560 | 55107.006.2-T_at | −0.63865 | 0.63864972 | 7.960666 | 2E-12 | 55107.006 | NM_018043.4 | CQ722042.1 | GENBANK_PATENT | 1 |
| 561 | 79068.010.1-D_at | −0.63836 | 0.63836198 | 7.954611 | 2E-12 | 79068.010 | XM_051200.8 | DA647247.1 | EST | 1 |
| 562 | 57447.009.1-T_at | −0.63836 | 0.63835821 | 7.954532 | 2E-12 | 57447.009 | NM_201535.1 | BI550962.1 | EST | 1 |
| 563 | 2115.015.1-T_at | 0.63799997 | 0.63799997 | 7.947002 | 2E-12 | 2115.015. | NM_004956.3 | DA220931.1 | EST | 1 |
| 564 | 1756.013.1-C_at | −0.638 | 0.63799967 | 7.946996 | 3E-12 | 1756.013. | NM_000109.2 | NM_004019.1 | REFSEQ | 448 |
| 565 | 7169.015.1-F_at | −0.63796 | 0.63796151 | 7.946194 | 3E-12 | 7169.015. | NM_213674.1 | DB291177.1 | EST | 1 |
| 566 | 65983.013.2-F_at | −0.63792 | 0.63792448 | 7.945416 | 3E-12 | 65983.013 | NM_023927.1 | AA610396.1 | EST | 1 |
| 567 | 8404.001.1-B_at | −0.63758 | 0.63757819 | 7.938148 | 3E-12 | 8404.001. | NM_004684.2 | DA132781.1 | EST | 1 |
| 568 | 4240.004.1-B_at | −0.63705 | 0.6370484 | 7.927043 | 3E-12 | 4240.004. | NM_005928.1 | BC003610.2 | mRNA | 1 |
| 569 | 57447.012.2-T_at | −0.63699 | 0.63699351 | 7.925894 | 3E-12 | 57447.012 | NM_201535.1 | DB294263.1 | EST | 1 |
| 570 | 57447.024.1-F_at | −0.63699 | 0.63698737 | 7.925765 | 3E-12 | 57447.024 | NM_201535.1 | DA566498.1 | EST | 1 |
| 571 | 358.018.1-T_at | −0.63696 | 0.63695985 | 7.925189 | 3E-12 | 358.018.1 | NM_198098.1 | BI765065.1 | EST | 1 |
| 572 | 59.031.1-C_at | −0.63688 | 0.6368768 | 7.92345 | 3E-12 | 59.031.1 | NM_001613.1 | BX480398.1 | EST | 19 |
| 573 | 59.031.1-C_at | −0.63685 | 0.63684644 | 7.922815 | 3E-12 | 59.031.1 | NM_001613.1 | BG197213.1 | EST | 19 |
| 574 | 3860.007.1-F_at | −0.63682 | 0.63682338 | 7.922332 | 3E-12 | 3860.007. | NM_153490.1 | DB256579.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 575 | 8404.028.1-C_at | −0.63664 | 0.63664266 | 7.918551 | 3E-12 | 8404.028. | NM_004684.2 | CQ727530.1 | GENBANK_PATENT | 1 |
| 576 | 4240.011.3-E_at | −0.63664 | 0.63664099 | 7.918517 | 3E-12 | 4240.011. | NM_005928.1 | DA921691.1 | EST | 1 |
| 577 | 59.022.2-B_at | −0.63634 | 0.63633565 | 7.912134 | 3E-12 | 59.022.2 | — | — | — | — |
| 578 | 3866.002.1-F_at | −0.63598 | 0.63598268 | 7.904763 | 3E-12 | 3866.002. | NM_002275.2 | BG990007.1 | EST | 1 |
| 579 | 3866.002.1-T_at | −0.63597 | 0.63596762 | 7.904448 | 3E-12 | 3866.002. | NM_002275.2 | BG990007.1 | EST | 1 |
| 580 | 4915.005.1-B_at | −0.63568 | 0.63568404 | 7.898533 | 3E-12 | 4915.005. | NM_006180.3 | BP348402.1 | EST | 1 |
| 581 | 8404.008.1-F_at | −0.63556 | 0.63555525 | 7.895848 | 3E-12 | 8404.008. | NM_004684.2 | DA342341.1 | EST | 1 |
| 582 | 79608.002.1-F_at | −0.63554 | 0.63553682 | 7.895464 | 3E-12 | 79608.002 | NM_024557.2 | AK021670.1 | mRNA | 3 |
| 583 | 8404.023.1-D_at | −0.63553 | 0.6355289 | 7.895299 | 3E-12 | 8404.023. | NM_004684.2 | BX463355.2 | EST | 1 |
| 584 | 3426.002.1-D_at | −0.63533 | 0.63533255 | 7.891208 | 3E-12 | 3426.002. | NM_000204.1 | CQ718881.1 | GENBANK_PATENT | 1 |
| 585 | 2335.027.1-T_at | −0.635297 | 0.63529691 | 7.890465 | 3E-12 | 2335.027. | NM_212482.1 | AJ320527.1 | mRNA | 1 |
| 586 | 11065.009.1-T_at | 0.635032 | 0.63503202 | 7.884951 | 3E-12 | 11065.009 | NM_181802.1 | CN354813.1 | EST | 1 |
| 587 | 140885.013.1-F | 0.63461 | 0.63461049 | 7.876186 | 3E-12 | 140885.01 | NM_080792.2 | BU180215.1 | EST | 1 |
| 588 | 57447.021.1-B_at | −0.6346 | 0.63459853 | 7.875938 | 3E-12 | 57447.021 | NM_201535.1 | BQ954948.1 | EST | 28 |
| 589 | 25802.004.1-C_at | −0.63457 | 0.63457163 | 7.875379 | 3E-12 | 25802.004 | NM_012134.1 | DA924386.1 | EST | 1 |
| 590 | 4638.014.1-F_at | −0.63442 | 0.63441678 | 7.872162 | 3E-12 | 4638.014. | NM_053025.2 | NM_053027.2 | REFSEQ | 2 |
| 591 | 9493.004.1-F_at | 0.634402 | 0.63440178 | 7.871851 | 3E-12 | 9493.004. | NM_138555.1 | BM792243.1 | EST | 1 |
| 592 | 8404.004.1-B_at | −0.63427 | 0.63426893 | 7.869093 | 3E-12 | 8404.004. | NM_004684.2 | DA589023.1 | EST | 1 |
| 593 | 8404.004.2-T_at | −0.63407 | 0.63407245 | 7.865016 | 3E-12 | 8404.004. | NM_004684.2 | DA589023.1 | EST | 1 |
| 594 | 57447.010.2-T_at | −0.63407 | 0.63406601 | 7.864882 | 3E-12 | 57447.010 | NM_201535.1 | BP349691.1 | EST | 1 |
| 595 | 57447.010.3-B_at | −0.634 | 0.6340009 | 7.863532 | 3E-12 | 57447.010 | NM_201535.1 | BP349691.1 | EST | 1 |
| 596 | 27122.006.1-T_at | −0.63398 | 0.63398053 | 7.863109 | 3E-12 | 27122.006 | NM_013253.4 | DA171350.1 | EST | 1 |
| 597 | 5156.005.1-T_at | −0.63358 | 0.63357822 | 7.854771 | 3E-12 | 5156.005. | NM_006206.3 | BP336054.1 | EST | 1 |
| 598 | 5858.004.1-E_at | −0.63354 | 0.63353969 | 7.853973 | 3E-12 | 5858.004. | NM_002864.1 | DB033417.1 | EST | 1 |
| 599 | 25802.008.1-D_at | −0.63342 | 0.63342256 | 7.851548 | 4E-12 | 25802.008 | NM_012134.1 | DA767597.1 | EST | 1 |
| 600 | 2327.002.2-T_at | −0.63326 | 0.63326081 | 7.848201 | 4E-12 | 2327.002. | NM_001460.2 | CD684429.1 | EST | 1 |
| 601 | 3852.004.1-C_at | −0.63298 | 0.63298294 | 7.842454 | 4E-12 | 3852.004. | NM_000424.2 | BE715131.1 | EST | 1 |
| 602 | 59.026.2-F_at | −0.63296 | 0.63295912 | 7.841961 | 4E-12 | 59.026.2 | — | — | — | — |
| 603 | 57447.029.1-C_at | −0.63295 | 0.63295354 | 7.841846 | 4E-12 | 57447.029 | NM_201535.1 | BX354120.2 | EST | 6 |
| 604 | 7169.022.1-D_at | −0.63293 | 0.63293098 | 7.84138 | 4E-12 | 7169.022. | NM_213674.1 | BG385598.1 | EST | 1 |
| 605 | 23266.001.3-B_at | −0.63277 | 0.63276519 | 7.837954 | 4E-12 | 23266.001 | NM_012302.1 | AK123422.1 | mRNA | 2 |
| 606 | 3084.012.1-B_at | −0.63235 | 0.63235255 | 7.829435 | 4E-12 | 3084.012. | NM_013957.1 | U02325.1 | mRNA | 1 |
| 607 | 29127.019.2-T_at | 0.632352 | 0.63235178 | 7.829419 | 4E-12 | 29127.019 | NM_013277.2 | DA779708.1 | EST | 1 |
| 608 | 10253.004.1-T_at | −0.63208 | 0.63208261 | 7.823868 | 4E-12 | 10253.004 | NM_005842.2 | BQ889545.1 | EST | 2 |
| 609 | 10124.002.1-D_at | −0.63205 | 0.63205489 | 7.823297 | 4E-12 | 10124.002 | NM_001037164. | BG178114.1 | EST | 6 |
| 610 | 3861.013.1-D_at | −0.63198 | 0.63198062 | 7.821766 | 4E-12 | 3861.013. | NM_000526.3 | BM563823.1 | EST | 1 |
| 611 | 8404.032.1-T_at | −0.63197 | 0.63197222 | 7.821593 | 4E-12 | 8404.032. | NM_004684.2 | CQ498058.1 | GENBANK_PATENT | 1 |
| 612 | 84441.002.1-E_at | −0.63188 | 0.63188122 | 7.819718 | 4E-12 | 84441.002 | NM_032427.1 | CQ739825.1 | GENBANK_PATENT | 1 |
| 613 | 2.013.1-E_at | −0.63181 | 0.63181031 | 7.818258 | 4E-12 | 2.013.1 | NM_000014.4 | DA467444.1 | EST | 1 |
| 614 | 3084.004.1-B_at | −0.63137 | 0.63136737 | 7.809141 | 4E-12 | 3084.004. | NM_013957.1 | NM_013964.1 | REFSEQ | 5 |
| 615 | 5288.001.2-F_at | −0.63124 | 0.63123725 | 7.806466 | 5E-12 | 5288.001. | NM_004570.2 | CQ720591.1 | GENBANK_PATENT | 1 |
| 616 | 57447.017.1-F_at | −0.63113 | 0.63113433 | 7.80435 | 5E-12 | 57447.017 | NM_201535.1 | DA130260.1 | EST | 1 |
| 617 | 3084.006.1-T_at | −0.63106 | 0.63105508 | 7.802721 | 5E-12 | 3084.006. | NM_013957.1 | NM_013956.1 | REFSEQ | 3 |
| 618 | 59.039.1-F_at | −0.63095 | 0.63094608 | 7.800482 | 5E-12 | 59.039.1 | NM_001613.1 | EH_001613.4 | PREDICTED | 1 |
| 619 | 2.024.1-T_at | −0.63086 | 0.63085582 | 7.798628 | 5E-12 | 2.024.1 | NM_000014.4 | DB286897.1 | EST | 1 |
| 620 | 3815.002.2-E_at | −0.63085 | 0.63085365 | 7.798584 | 5E-12 | 3815.002. | NM_000222.1 | CQ719901.1 | GENBANK_PATENT | 1 |
| 621 | 1756.009.1-D_at | −0.63082 | 0.63082241 | 7.797942 | 5E-12 | 1756.009. | NM_000109.2 | NM_004023.1 | REFSEQ | 1 |
| 622 | 7091.014.1-B_at | −0.63047 | 0.63046815 | 7.790673 | 5E-12 | 7091.014. | NM_007005.3 | BM480087.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 623 | 4629.015.1-F_at | −0.6304 | 0.6303903 | 7.789255 | 5E-12 | 4629.015. | NM_022844.1 | DB284318.1 | EST | 1 |
| 624 | 59.008.2-F_at | −0.63016 | 0.63015808 | 7.784317 | 5E-12 | 59.008.2 | NM_001613.1 | BP373197.1 | EST | 1 |
| 625 | 2568.005.2-T_at | −0.63012 | 0.6301238 | 7.783614 | 5E-12 | 2568.005. | NM_014211.1 | AK055205.1 | mRNA | 11 |
| 626 | 115207.002.1-T | −0.62994 | 0.62993556 | 7.779759 | 5E-12 | 115207.00 | NM_138444.2 | CQ851144.1 | GENBANK_PATENT | 1 |
| 627 | 4281.001.1-T_at | −0.62982 | 0.62981987 | 7.777391 | 5E-12 | 4281.001. | NM_033290.1 | AY539999.1 | mRNA | 1 |
| 628 | 84668.002.2-T_at | −0.62976 | 0.62975676 | 7.776099 | 5E-12 | 84668.002 | NM_032581.2 | AL833296.1 | mRNA | 20 |
| 629 | 4240.004.1-F_at | −0.6295 | 0.62950111 | 7.77087 | 5E-12 | 4240.004. | NM_005928.1 | BC003610.2 | mRNA | 448 |
| 630 | 8404.005.1-D_at | −0.62918 | 0.62917718 | 7.76425 | 6E-12 | 8404.005. | NM_004684.2 | DA763956.1 | EST | 1 |
| 631 | 8404.032.1-B_at | −0.62902 | 0.62902338 | 7.761109 | 6E-12 | 8404.032. | NM_004684.2 | CQ498058.1 | GENBANK_PATENT | 1 |
| 632 | 57447.044.1-E_at | −0.6289 | 0.62890008 | 7.758592 | 6E-12 | 57447.044 | NM_201535.1 | DB232855.1 | EST | 1 |
| 633 | 8626.006.2-F_at | −0.62867 | 0.6286676 | 7.753849 | 6E-12 | 8626.006. | NM_003722.3 | CB049427.1 | EST | 1 |
| 634 | 57447.051.2-B_at | −0.62855 | 0.62855194 | 7.751491 | 6E-12 | 57447.051 | NM_201535.1 | BX460053.2 | EST | 1 |
| 635 | 1063.001.1-T_at | −0.628003 | 0.62800305 | 7.74031 | 6E-12 | 1063.001. | NM_016343.3 | BG941308.1 | EST | 1 |
| 636 | 3426.002.1-T_at | −0.62796 | 0.62796276 | 7.73949 | 6E-12 | 3426.002. | NM_000204.1 | CQ718881.1 | GENBANK_PATENT | 1 |
| 637 | 1308.001.1-T_at | −0.62793 | 0.62793498 | 7.738925 | 6E-12 | 1308.001. | NM_130778.1 | BM773425.1 | EST | 1 |
| 638 | 389432.002.1-F | −0.62759 | 0.62758948 | 7.731899 | 6E-12 | 389432.00 | NM_001030060. | CQ751492.1 | GENBANK_PATENT | 1 |
| 639 | 57447.017.1-B_at | −0.62755 | 0.62754878 | 7.731072 | 7E-12 | 57447.017 | NM_201535.1 | DA130260.1 | EST | 1 |
| 640 | 2115.014.1-F_at | −0.62729 | 0.62729339 | 7.725883 | 7E-12 | 2115.014. | NM_004956.3 | CN396909.1 | EST | 1 |
| 641 | 5284.004.1-T_at | −0.62724 | 0.6272429 | 7.724858 | 7E-12 | 5284.004. | NM_002644.2 | DB225999.1 | EST | 1 |
| 642 | 57447.029.1-F_at | −0.62716 | 0.271633 | 7.723242 | 7E-12 | 57447.029 | NM_201535.1 | BX354120.2 | EST | 6 |
| 643 | 8626.006.1-F_at | −0.62697 | 0.62697054 | 7.71933 | 7E-12 | 8626.006. | NM_003722.3 | CB049427.1 | EST | 1 |
| 644 | 2982.002.1-C_at | −0.62686 | 0.62686245 | 7.717138 | 7E-12 | 2982.002. | NM_000856.2 | BP199345.1 | EST | 1 |
| 645 | 57447.047.1-C_at | −0.62685 | 0.62685067 | 7.716899 | 7E-12 | 57447.047 | NM_201535.1 | DA353543.1 | EST | 1 |
| 646 | 5803.006.1-E_at | −0.62682 | 0.62681659 | 7.716208 | 7E-12 | 5803.006. | NM_002851.1 | BM473091.1 | EST | 1 |
| 647 | 57447.021.1-F_at | −0.62659 | 0.62658775 | 7.71157 | 7E-12 | 57447.021 | NM_201535.1 | BQ954948.1 | EST | 28 |
| 648 | 57447.039.1-F_at | −0.62651 | 0.62651329 | 7.710061 | 7E-12 | 57447.039 | NM_201535.1 | DA356658.1 | EST | 1 |
| 649 | 4281.008.2-F_at | −0.62638 | 0.62637927 | 7.707347 | 7E-12 | 4281.008. | NM_033290.1 | AY539984.1 | mRNA | 1 |
| 650 | 57447.029.1-D_at | −0.62629 | 0.62629118 | 7.705563 | 7E-12 | 57447.029 | NM_201535.1 | BX354120.2 | EST | 6 |
| 651 | 65983.013.1-B_at | −0.62562 | 0.6256189 | 7.691968 | 8E-12 | 65983.013 | NM_023927.1 | AA610396.1 | EST | 1 |
| 652 | 5284.004.1-D_at | −0.62553 | 0.6255276 | 7.690123 | 8E-12 | 5284.004. | NM_002644.2 | DB225999.1 | EST | 1 |
| 653 | 4240.011.1-D_at | −0.62513 | 0.62512689 | 7.682036 | 8E-12 | 4240.011. | NM_005928.1 | DA921691.1 | EST | 1 |
| 654 | 57447.024.1-T_at | −0.62502 | 0.62502436 | 7.679968 | 8E-12 | 57447.024 | NM_201535.1 | DA566498.1 | EST | 1 |
| 655 | 6876.011.1-B_at | −0.625 | 0.62499658 | 7.679408 | 8E-12 | 6876.011. | NM_001001522. | AW956430.1 | EST | 1 |
| 656 | 7373.003.2-T_at | −0.62485 | 0.62484538 | 7.676359 | 8E-12 | 7373.003. | NM_021110.1 | CQ716670.1 | GENBANK_PATENT | 1 |
| 657 | 3852.014.1-D_at | −0.62476 | 0.62476477 | 7.674735 | 9E-12 | 3852.014. | NM_000424.2 | BF826002.1 | EST | 1 |
| 658 | 4915.005.1-D_at | −0.62473 | 0.62473239 | 7.674083 | 9E-12 | 4915.005. | NM_006180.3 | BP348402.1 | EST | 1 |
| 659 | 9768.002.2-B_at | −0.624527 | 0.62452688 | 7.669944 | 9E-12 | 9768.002. | NM_014736.4 | BM908225.1 | EST | 1 |
| 660 | 140885.010.1-D | −0.62442 | 0.62441747 | 7.667741 | 9E-12 | 140885.01 | NM_080792.2 | CQ728313.1 | GENBANK_PATENT | 1 |
| 661 | 4638.020.1-E_at | −0.62432 | 0.62431859 | 7.665751 | 9E-12 | 4638.020. | NM_053025.2 | DA694890.1 | EST | 1 |
| 662 | 57447.017.1-C_at | −0.62424 | 0.62423695 | 7.664109 | 9E-12 | 57447.017 | NM_201535.1 | DA130260.1 | EST | 1 |
| 663 | 7373.004.1-T_at | −0.62423 | 0.6242336 | 7.664041 | 9E-12 | 7373.004. | NM_021110.1 | M64109.1 | mRNA | 1 |
| 664 | 3852.008.2-E_at | −0.62396 | 0.62396244 | 7.658589 | 9E-12 | 3852.008. | NM_000424.2 | BG675837.1 | EST | 1 |
| 665 | 4281.015.1-E_at | −0.62376 | 0.62376072 | 7.654536 | 9E-12 | 4281.015. | NM_033290.1 | AY540009.1 | mRNA | 1 |
| 666 | 8404.013.1-C_at | −0.62375 | 0.62374788 | 7.654278 | 9E-12 | 8404.013. | NM_004684.2 | BP376616.1 | EST | 1 |
| 667 | 90293.001.3-T_at | −0.62357 | 0.62357218 | 7.65075 | 1E-11 | 90293.001 | NM_033495.2 | CQ714141.1 | GENBANK_PATENT | 9 |
| 668 | 57447.044.1-T_at | −0.62348 | 0.6234819 | 7.648937 | 1E-11 | 57447.044 | NM_201535.1 | DB232855.1 | EST | 1 |
| 669 | 23650.011.2-D_at | −0.62318 | 0.62317705 | 7.642822 | 1E-11 | 23650.011 | NM_058193.1 | NM_012101.2 | REFSEQ | 11 |
| 670 | 2335.006.1-D_at | −0.623003 | 0.62300327 | 7.639338 | 1E-11 | 2335.006. | NM_212482.1 | CX785805.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 671 | 57447.022.1-T_at | −0.6229 | 0.6290388 | 7.637347 | 1E−11 | 57447.022 | NM_201535.1 | DA079074.1 | EST | 2 |
| 672 | 8404.032.1-D_at | −0.62271 | 0.62271252 | 7.633514 | 1E−11 | 8404.032 | NM_004684.2 | CQ498058.1 | GENBANK_PATENT | 1 |
| 673 | 8404.030.1-F_at | −0.62267 | 0.62267432 | 7.632749 | 1E−11 | 8404.030. | NM_004684.2 | CD357736.1 | EST | 1 |
| 674 | 5803.002.2-T_at | −0.6225 | 0.62250014 | 7.629263 | 1E−11 | 5803.002. | NM_002851.1 | CQ725791.1 | GENBANK_PATENT | 24 |
| 675 | 8404.004.2-C_at | −0.62246 | 0.62245993 | 7.628459 | 1E−11 | 8404.004. | NM_004684.2 | DA589023.1 | EST | 1 |
| 676 | 84441.005.1-C_at | −0.62236 | 0.62236291 | 7.626518 | 1E−11 | 84441.005 | NM_032427.1 | CQ739827.1 | GENBANK_PATENT | 1 |
| 677 | 7091.015.1-F_at | −0.62201 | 0.62201208 | 7.619505 | 1E−11 | 7091.015. | NM_007005.3 | CQ724084.1 | GENBANK_PATENT | 1 |
| 678 | 2119.005.1-D_at | −0.62174 | 0.6217418 | 7.614107 | 1E−11 | 2119.005. | NM_004454.1 | BU197295.1 | EST | 1 |
| 679 | 7373.003.6-F_at | −0.6217 | 0.62170218 | 7.613316 | 1E−11 | 7373.003. | NM_021110.1 | CQ716670.1 | GENBANK_PATENT | 1 |
| 680 | 79608.008.1-T_at | −0.6214 | 0.62140438 | 7.607374 | 1E−11 | 79608.008 | NM_024557.2 | DA748988.1 | EST | 2 |
| 681 | 3852.008.1-T_at | −0.62129 | 0.62128908 | 7.605075 | 1E−11 | 3852.008. | NM_000424.2 | BG675837.1 | EST | 1 |
| 682 | 8626.007.1-T_at | −0.62113 | 0.62113254 | 7.601955 | 1E−11 | 8626.007. | NM_003722.3 | BG698723.1 | EST | 1 |
| 683 | 8404.022.1-T_at | −0.62104 | 0.62103797 | 7.60007 | 1E−11 | 8404.022. | NM_004684.2 | BP311988.1 | EST | 1 |
| 684 | 8404.034.1-T_at | −0.62101 | 0.62101196 | 7.599552 | 1E−11 | 8404.034. | NM_004684.2 | DA148306.1 | EST | 1 |
| 685 | 57447.049.1-T_at | −0.62097 | 0.62096556 | 7.598628 | 1E−11 | 57447.049 | NM_201535.1 | DB180733.1 | EST | 1 |
| 686 | 5311.002.1-B_at | −0.62092 | 0.62092128 | 7.597746 | 1E−11 | 5311.002. | NM_000297.2 | CQ727531.1 | GENBANK_PATENT | 1 |
| 687 | 2335.025.3-T_at | 0.620916 | 0.62091648 | 7.597651 | 1E−11 | 2335.025. | NM_212482.1 | CQ715726.1 | GENBANK_PATENT | 3 |
| 688 | 4147.012.1-T_at | −0.62076 | 0.62075962 | 7.594528 | 1E−11 | 4147.012. | NM_002380.3 | BX397573.2 | EST | 1 |
| 689 | 301.015.1-T_at | −0.62074 | 0.62074218 | 7.594181 | 1E−11 | 301.015.1 | NM_000700.1 | BM477702.1 | EST | 1 |
| 690 | 301.004.1-T_at | −0.62073 | 0.62073001 | 7.593939 | 1E−11 | 301.004.1 | NM_000700.1 | DB194639.1 | EST | 1 |
| 691 | 3426.002.2-F_at | −0.62048 | 0.62047946 | 7.588954 | 1E−11 | 3426.002. | NM_000204.1 | CQ718881.1 | GENBANK_PATENT | 24 |
| 692 | 7091.001.1-T_at | −0.62037 | 0.62037055 | 7.586788 | 1E−11 | 7091.001. | NM_007005.3 | BC045650.1 | EST | 2 |
| 693 | 8404.021.1-D_at | −0.62032 | 0.6203222 | 7.585827 | 1E−11 | 8404.021. | NM_004684.2 | DA291834.1 | mRNA | 17 |
| 694 | 7153.002.3-B_at | 0.620304 | 0.62030417 | 7.585469 | 1E−11 | 7153.002. | NM_001067.2 | CQ735949.1 | GENBANK_PATENT | 114 |
| 695 | 53335.002.1-E_at | −0.62026 | 0.62026302 | 7.584651 | 1E−11 | 53335.002 | NM_018014.2 | BU159551.1 | EST | 1 |
| 696 | 5284.003.2-T_at | −0.62002 | 0.62001653 | 7.579754 | 1E−11 | 5284.003. | NM_002644.2 | BP220016.1 | EST | 1 |
| 697 | 4306.002.1-F_at | 0.619996 | 0.61995574 | 7.578547 | 1E−11 | 4306.002. | NM_000901.1 | AJ315515.1 | mRNA | 1 |
| 698 | 5284.003.2-D_at | 0.61991 | 0.61991035 | 7.577646 | 1E−11 | 5284.003. | NM_002644.2 | BP220016.1 | EST | 1 |
| 699 | 5803.002.1-T_at | −0.61977 | 0.61977142 | 7.574888 | 1E−11 | 5803.002. | NM_002851.1 | CQ725791.1 | GENBANK_PATENT | 24 |
| 700 | 10253.004.1-F_at | −0.61973 | 0.61973277 | 7.574121 | 1E−11 | 10253.004 | NM_005842.2 | BQ889545.1 | EST | 2 |
| 701 | 23650.020.1-T_at | −0.61972 | 0.61971511 | 7.573771 | 1E−11 | 23650.020 | NM_058193.1 | DB266728.1 | EST | 1 |
| 702 | 57447.042.1-T_at | −0.61964 | 0.6196367 | 7.572215 | 1E−11 | 57447.042 | NM_201535.1 | DA937014.1 | EST | 1 |
| 703 | 6876.023.1-F_at | −0.6196 | 0.61960408 | 7.571568 | 1E−11 | 6876.023. | NM_001001522. | CN48209.1 | EST | 1 |
| 704 | 7169.015.1-C_at | −0.61949 | 0.61948888 | 7.569283 | 1E−11 | 7169.015. | NM_213674.1 | DB291177.1 | EST | 1 |
| 705 | 7153.002.4-F_at | 0.619203 | 0.61920323 | 7.563622 | 1E−11 | 7153.002. | NM_001067.2 | CQ735949.1 | GENBANK_PATENT | 114 |
| 706 | 4629.016.1-B_at | −0.61918 | 0.61917512 | 7.563065 | 1E−11 | 4629.016. | NM_022844.1 | DB289769.1 | EST | 1 |
| 707 | 6876.002.1-C_at | −0.61913 | 0.61912596 | 7.562091 | 1E−11 | 6876.002. | NM_001001522. | DB262921.1 | EST | 1 |
| 708 | 65983.007.1-T_at | −0.61906 | 0.61905788 | 7.560743 | 1E−11 | 65983.007 | NM_023927.1 | DA388235.1 | EST | 1 |
| 709 | 7373.003.2-F_at | −0.61891 | 0.61891452 | 7.557905 | 1E−11 | 7373.003. | NM_021110.1 | CQ716670.1 | GENBANK_PATENT | 1 |
| 710 | 152015.004.1-T | −0.61872 | 0.61872078 | 7.554071 | 2E−11 | 152015.00 | NM_001012337. | BC015413.1 | mRNA | 2 |
| 711 | 8404.004.2B_at | −0.61824 | 0.61823995 | 7.544566 | 2E−11 | 8404.004. | NM_004684.2 | DA589023.1 | EST | 1 |
| 712 | 6285.001.1-B_at | −0.61815 | 0.61815486 | 7.542886 | 2E−11 | 6285.001. | NM_006272.1 | BP349776.1 | EST | 1 |
| 713 | 2115.007.1-E_at | −0.61784 | 0.61784158 | 7.536702 | 2E−11 | 2115.007. | NM_004956.3 | DA189670.1 | EST | 1 |
| 714 | 2.013.1-T_at | −0.61782 | 0.61782175 | 7.536311 | 2E−11 | 2.013.1 | NM_000014.4 | DA467444.1 | EST | 1 |
| 715 | 6289.005.1-T_at | −0.61778 | 0.6177768 | 7.535424 | 2E−11 | 6289.005. | NM_030754.2 | BG618888.1 | EST | 39 |
| 716 | 9232.002.1-T_at | −0.61778 | 0.61774763 | 7.534848 | 2E−11 | 9232.002. | NM_004219.2 | BM459529.1 | EST | 2 |
| 717 | 59.014.1-B_at | −0.61765 | 0.61765007 | 7.532925 | 2E−11 | 59.014.1 | NM_001613.1 | CB962422.1 | EST | 1 |
| 718 | 59.031.1-F_at | −0.61751 | 0.61750627 | 7.53009 | 2E−11 | 59.031.1 | NM_001613.1 | BG197213.1 | EST | 19 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 719 | 3084.011.1-T_at | −0.61746 | 0.61746489 | 7.529274 | 2E−11 | 3084.011. | NM_013957.1 | CN603661.1 | EST | 1 |
| 720 | 3872.005.1-F_at | −0.61737 | 0.61737414 | 7.527486 | 2E−11 | 3872.005. | NM_000422.1 | BG682094.1 | EST | 1 |
| 721 | 3084.012.3-F_at | −0.6173 | 0.61730492 | 7.526122 | 2E−11 | 3084.012. | NM_013957.1 | U02325.1 | mRNA | 1 |
| 722 | 81704.008.1-F_at | −0.61719 | 0.61719009 | 7.523861 | 2E−11 | 81704.008 | NM_203447.1 | BC045629.1 | mRNA | 1 |
| 723 | 140885.010.2-C | −0.617 | 0.61700383 | 7.520194 | 2E−11 | 140885.01 | NM_080792.2 | CQ728313.1 | GENBANK_PATENT | 1 |
| 724 | 338707.006.1-E | −0.61688 | 0.61688739 | 7.517726 | 2E−11 | 338707.00 | NM_178537.3 | BX115728.1 | EST | 1 |
| 725 | 23266.008.2-T_at | −0.61684 | 0.61683767 | 7.516924 | 2E−11 | 23266.008 | NM_012302.2 | CQ799210.1 | GENBANK_PATENT | 1 |
| 726 | 120.005.2-E_at | −0.61665 | 0.61664987 | 7.513231 | 2E−11 | 120.005.2 | NM_019903.3 | AK223270.1 | mRNA | 78 |
| 727 | 4281.009.1-E_at | −0.61647 | 0.61647345 | 7.509764 | 2E−11 | 4281.009. | NM_033290.1 | AY540014.1 | mRNA | 1 |
| 728 | 4094.001.1-T_at | −0.61638 | 0.61638223 | 7.507972 | 2E−11 | 4094.001. | NM_001031804. | NM_005360.3 | REFSEQ | 17 |
| 729 | 2995.001.1-T_at | −0.61614 | 0.61614044 | 7.503223 | 2E−11 | 2995.001. | NM_002101.3 | CQ729268.1 | GENBANK_PATENT | 1 |
| 730 | 4638.011.1-T_at | −0.61607 | 0.61606684 | 7.501779 | 2E−11 | 4638.011. | NM_053025.2 | DB267860.1 | EST | 1 |
| 731 | 2335.017.1-T_at | −0.61595 | 0.61595485 | 7.499582 | 2E−11 | 2335.017. | NM_212482.1 | CQ896577.1 | GENBANK_PATENT | 4 |
| 732 | 5284.001.1-F_at | −0.61592 | 0.61592058 | 7.498909 | 2E−11 | 5284.001. | NM_002644.2 | AX012182.1 | GENBANK_PATENT | 1 |
| 733 | 8404.026.1-D_at | −0.61589 | 0.61588535 | 7.498218 | 2E−11 | 8404.026. | NM_004684.2 | BX647713.1 | mRNA | 141 |
| 734 | 2335.009.1-D_at | −0.615806 | 0.61580556 | 7.496653 | 2E−11 | 2335.009. | NM_212482.1 | BG927121.1 | EST | 51 |
| 735 | 10461.002.2-F_at | −0.61571 | 0.61570541 | 7.49469 | 2E−11 | 10461.002 | NM_006343.2 | CQ725500.1 | GENBANK_PATENT | 1 |
| 736 | 84441.002.1-T_at | −0.6157 | 0.61570234 | 7.494629 | 2E−11 | 84441.002 | NM_032427.1 | CQ739825.1 | GENBANK_PATENT | 1 |
| 737 | 147495.006.1-T | −0.61568 | 0.61567688 | 7.49413 | 2E−11 | 147495.00 | NM_153000.3 | CN421888.1 | EST | 1 |
| 738 | 7091.010.1-B_at | −0.61565 | 0.61564596 | 7.493524 | 2E−11 | 7091.010. | NM_007005.3 | AL551038.3 | EST | 1 |
| 739 | 8404.008.1-C_at | −0.61554 | 0.61554203 | 7.491488 | 2E−11 | 8404.008. | NM_004684.2 | DA342341.1 | EST | 1 |
| 740 | 6376.001.2-C_at | −0.61538 | 0.61538183 | 7.488349 | 2E−11 | 6376.001. | NM_002996.3 | AK223351.1 | mRNA | 48 |
| 741 | 3832.002.1-B_at | −0.61514 | 0.61501375 | 7.481144 | 2E−11 | 3832.002. | NM_004523.1 | BQ959682.1 | EST | 1 |
| 742 | 59.034.2-T_at | −0.61499 | 0.61498701 | 7.480621 | 2E−11 | 59.034.2 | — | BI822892.1 | EST | — |
| 743 | 147495.005.1-B | −0.61488 | 0.61488109 | 7.478549 | 2E−11 | 147495.00 | NM_153000.3 | BG682094.1 | EST | 1 |
| 744 | 3872.005.1-C_at | −0.61477 | 0.61477315 | 7.476439 | 2E−11 | 3872.005. | NM_000422.1 | AX575481.1 | GENBANK_PATENT | 5 |
| 745 | 79895.001.1-D_at | −0.61472 | 0.61471741 | 7.475349 | 2E−11 | 79895.001 | NM_024837.2 | DB238920.1 | EST | 1 |
| 746 | 57447.038.1-T_at | −0.61465 | 0.61464905 | 7.474013 | 2E−11 | 57447.038 | NM_201535.1 | CQ656872.1 | GENBANK_PATENT | 1 |
| 747 | 7373.008.1-T_at | −0.61439 | 0.61438569 | 7.468868 | 2E−11 | 7373.008. | NM_021110.1 | BQ636126.1 | EST | 1 |
| 748 | 4744.004.1-C_at | −0.61432 | 0.61431915 | 7.467569 | 2E−11 | 4744.004. | NM_021076.2 | CQ728313.1 | GENBANK_PATENT | 1 |
| 749 | 140885.010.1-T | −0.61432 | 0.61431838 | 7.467554 | 2E−11 | 140885.01 | NM_080792.2 | AB209555.1 | mRNA | 2 |
| 750 | 6876.016.2-E_at | −0.61423 | 0.61422523 | 7.465735 | 2E−11 | 6876.016. | NM_001001522. | BP194755.1 | EST | 4 |
| 751 | 8404.015.1-T_at | −0.61419 | 0.61419393 | 7.465124 | 2E−11 | 8404.015. | NM_004684.2 | AY539986.1 | mRNA | 1 |
| 752 | 4281.014.1-T_at | −0.61417 | 0.61416566 | 7.464573 | 2E−11 | 4281.014. | NM_033290.1 | BP363635.1 | EST | 1 |
| 753 | 4288.006.1-T_at | −0.614163 | 0.61416265 | 7.464514 | 2E−11 | 4288.006. | NM_002127.1 | DB064380.1 | EST | 1 |
| 754 | 25925.009.1-E_at | −0.61404 | 0.61403923 | 7.462106 | 2E−11 | 25925.009 | NM_015461.1 | BG829936.1 | mRNA | 2 |
| 755 | 4240.009.1-B_at | −0.61385 | 0.61385445 | 7.458502 | 2E−11 | 4240.009. | NM_005928.1 | DA361412.1 | EST | 1 |
| 756 | 667.010.1-E_at | −0.61376 | 0.61376087 | 7.456678 | 2E−11 | 667.010.1 | NM_183380.1 | AL832226.1 | mRNA | 37 |
| 757 | 3866.005.1-B_at | −0.61345 | 0.61345384 | 7.450696 | 2E−11 | 3866.005. | NM_002275.2 | BP199520.1 | EST | 1 |
| 758 | 57447.011.1-T_at | −0.61343 | 0.61343087 | 7.450249 | 2E−11 | 57447.011 | NM_201535.1 | BC011240.1 | EST | 1 |
| 759 | 57447.034.1-B_at | −0.61342 | 0.61342094 | 7.450055 | 2E−11 | 57447.034 | NM_201535.1 | DA924386.1 | EST | 1 |
| 760 | 25802.004.1-B_at | −0.61332 | 0.61331747 | 7.448041 | 2E−11 | 25802.004 | NM_0121134.1 | DB260047.1 | EST | 1 |
| 761 | 8404.024.1-T_at | −0.61318 | 0.6131717 | 7.44531 | 3E−11 | 8404.024. | NM_004684.2 | BI771628.1 | EST | 1 |
| 762 | 57447.032.1-T | −0.61307 | 0.61306529 | 7.443134 | 3E−11 | 57447.032 | NM_201535.1 | DB134537.1 | EST | 3 |
| 763 | 667.021.1-F_at | −0.61305 | 0.61304874 | 7.442812 | 3E−11 | 667.021.1 | NM_183380.1 | BC111756.1 | mRNA | 1 |
| 764 | 5858.001.2-F_at | −0.61258 | 0.6125845 | 7.433788 | 3E−11 | 5858.001. | NM_002864.1 | — | — | — |
| 765 | 51062.008.1-T_at | −0.61217 | 0.61217313 | 7.425802 | 3E−11 | 51062.008 | NM_015915.3 | CQ719775.1 | GENBANK_PATENT | 2 |
| 766 | 2335.013.1-F_at | −0.612162 | 0.61216233 | 7.425593 | 3E−11 | 2335.013. | NM_212482.1 | AL551632.3 | EST | 2 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 767 | 2568.001.2-T_at | -0.61211 | 0.61210705 | 7.424521 | 3E-11 | 2568.001. | NM_014211.1 | BX509618.1 | EST | 1 |
| 768 | 7170.005.2-D_at | -0.611952 | 0.61195174 | 7.421509 | 3E-11 | 7170.005. | NM_153649.2 | DA762962.1 | EST | 1 |
| 769 | 57447.034.1F_at | -0.61184 | 0.61184024 | 7.419347 | 3E-11 | 57447.034 | NM_201535.1 | BC011240.1 | mRNA | 1 |
| 770 | 7153.002.6-C_at | -0.611814 | 0.61181444 | 7.418847 | 3E-11 | 7153.002. | NM_001067.2 | CQ735949.1 | GENBANK_PATENT | 114 |
| 771 | 2568.003.1-T_at | -0.61165 | 0.61164713 | 7.415606 | 3E-11 | 2568.003. | NM_014211.1 | CD696885.1 | EST | 1 |
| 772 | 59.008.2-T_at | -0.61162 | 0.61161827 | 7.415046 | 3E-11 | 59.008.2 | NM_001613.1 | BP373197.1 | EST | 1 |
| 773 | 9898.015.2-B_at | -0.611466 | 0.61146611 | 7.4121 | 3E-11 | 9898.015. | NM_014847.2 | AI243670.2 | mRNA | 1 |
| 774 | 7018.013.1-T_at | -0.61122 | 0.6112152 | 7.407244 | 3E-11 | 7018.013. | NM_001063.2 | AX147484.1 | GENBANK_PATENT | 1 |
| 775 | 7170.034.2-D_at | -0.611012 | 0.61101246 | 7.403323 | 3E-11 | 7170.034. | NM_153649.2 | DA894441.1 | EST | 1 |
| 776 | 3866.004.1-E_at | -0.61074 | 0.61073542 | 7.397968 | 3E-11 | 3866.004. | NM_002275.2 | BC110649.1 | mRNA | 1 |
| 777 | 5284.001.1-T_at | -0.61068 | 0.61067717 | 7.396843 | 3E-11 | 5284.001. | NM_002644.2 | AX012182.1 | GENBANK_PATENT | 1 |
| 778 | 2.002.1-C_at | -0.61064 | 0.61064092 | 7.396143 | 3E-11 | 2.002.1 | NM_000014.4 | CQ672194.1 | GENBANK_PATENT | 1 |
| 779 | 57447.050.1-T_at | -0.61051 | 0.61050599 | 7.393537 | 3E-11 | 57447.050 | NM_201535.1 | DA257961.1 | EST | 17 |
| 780 | 7018.014.1-F_at | -0.61047 | 0.61046981 | 7.392839 | 3E-11 | 7018.014. | NM_001063.1 | AX147483.1 | GENBANK_PATENT | 1 |
| 781 | 2335.032.1-D_at | -0.610251 | 0.61025134 | 7.388623 | 3E-11 | 2335.032. | NM_212482.1 | DA647475.1 | EST | 1 |
| 782 | 3866.002.1-C_at | -0.61025 | 0.61024968 | 7.388591 | 3E-11 | 3866.002. | NM_002275.2 | BG990007.1 | EST | 1 |
| 783 | 57447.043.1-T_at | -0.61025 | 0.61024544 | 7.388509 | 3E-11 | 57447.043 | NM_201535.1 | DA829299.1 | EST | 1 |
| 784 | 51201.005.1-D_at | -0.61021 | 0.61021006 | 7.387827 | 3E-11 | 51201.005 | NM_016353.2 | DA655803.1 | EST | 1 |
| 785 | 51203.003.1-T_at | -0.610008 | 0.61000819 | 7.383934 | 3E-11 | 51203.003 | NM_016359.2 | BP283628.1 | EST | 1 |
| 786 | 9493.001.1-F_at | -0.609767 | 0.60976675 | 7.379281 | 3E-11 | 9493.001. | NM_138555.1 | BC051826.1 | mRNA | 1 |
| 787 | 57447.024.1-B_at | -0.60944 | 0.60943797 | 7.37295 | 3E-11 | 57447.024 | NM_201535.1 | DA566498.1 | EST | 1 |
| 788 | 80034.003.4-B_at | -0.60942 | 0.6094211 | 7.372625 | 4E-11 | 80034.003 | NM_024969.2 | CQ733306.1 | GENBANK_PATENT | 1 |
| 789 | 7170.016.3-C_at | -0.609237 | 0.60923665 | 7.369076 | 4E-11 | 7170.016. | NM_153649.2 | BF575596.1 | EST | 1 |
| 790 | 65983.003.1-T_at | -0.60914 | 0.60913896 | 7.367198 | 4E-11 | 65983.003 | NM_023927.1 | BP292708.1 | EST | 1 |
| 791 | 57447.026.1-T_at | -0.60891 | 0.60891356 | 7.362865 | 4E-11 | 57447.026 | NM_201535.1 | BP196338.1 | EST | 4 |
| 792 | 440421.001.1-F | -0.60867 | 0.6086702 | 7.35819 | 4E-11 | 440421.00 | XM_496202.2 | XM_934894.1 | REFSEQ | 2 |
| 793 | 301.008.1-D_at | -0.60853 | 0.60852747 | 7.355449 | 4E-11 | 301.008.1 | NM_000700.1 | CD688703.1 | EST | 1 |
| 794 | 80034.002.2-T_at | -0.60832 | 0.60831755 | 7.351421 | 4E-11 | 80034.002 | NM_024969.2 | DA769284.1 | EST | 1 |
| 795 | 7153.002.5-B_at | -0.608304 | 0.60830361 | 7.351154 | 4E-11 | 7153.002. | NM_001067.2 | CQ735949.1 | GENBANK_PATENT | 114 |
| 796 | 3852.008.2-F_at | -0.60821 | 0.60820967 | 7.349352 | 4E-11 | 3852.008. | NM_000424.2 | BG681715.1 | EST | 1 |
| 797 | 4288.006.2-T_at | -0.60812 | 0.60812437 | 7.347716 | 4E-11 | 4288.006. | NM_002417.2 | BP363635.1 | EST | 1 |
| 798 | 8404.013.1-F_at | -0.60779 | 0.60778896 | 7.341289 | 4E-11 | 8404.013. | NM_004684.2 | BP376616.1 | EST | 9 |
| 799 | 2.018.1-C_at | -0.60773 | 0.60772913 | 7.340143 | 4E-11 | 2.018.1 | NM_000014.4 | DB090657.1 | mRNA | 141 |
| 800 | 10124.003.1-B_at | -0.60757 | 0.60757027 | 7.337101 | 4E-11 | 10124.003 | NM_001037164. | BU664973.1 | EST | 1 |
| 801 | 3852.008.2-F_at | -0.60743 | 0.60743897 | 7.334588 | 4E-11 | 3852.008. | NM_000424.2 | BG675837.1 | EST | 1 |
| 802 | 8404.026.1-C_at | -0.60743 | 0.60742535 | 7.334327 | 4E-11 | 8404.026. | NM_004684.2 | BX647713.1 | mRNA | 1 |
| 803 | 23650.019.1-C_at | -0.6074 | 0.6073959 | 7.333764 | 4E-11 | 23650.019 | NM_058193.1 | BI224541.1 | EST | 1 |
| 804 | 7170.027.1-T_at | -0.607197 | 0.60719709 | 7.329961 | 5E-11 | 7170.027. | NM_153649.2 | BQ959117.1 | EST | 1 |
| 805 | 54928.003.1-E_at | -0.60719 | 0.60719005 | 7.329827 | 5E-11 | 54928.003 | NM_017813.2 | DB283344.1 | EST | 1 |
| 806 | 2335.025.1-B_at | -0.607111 | 0.60711088 | 7.328313 | 5E-11 | 2335.025. | NM_212482.1 | CQ715726.1 | GENBANK_PATENT | 3 |
| 807 | 3084.010.1-T_at | -0.60698 | 0.60697967 | 7.325805 | 5E-11 | 3084.010. | NM_013957.1 | BC007675.2 | mRNA | 7 |
| 808 | 57447.051.1-T_at | -0.60697 | 0.60697421 | 7.325701 | 5E-11 | 57447.051 | NM_201535.1 | BX460053.2 | EST | 1 |
| 809 | 80034.003.4-T_at | -0.60692 | 0.6069173 | 7.324613 | 5E-11 | 80034.003 | NM_024969.2 | CQ733306.1 | GENBANK_PATENT | 1 |
| 810 | 2568.005.1-D_at | -0.60678 | 0.6067777 | 7.321947 | 5E-11 | 2568.005. | NM_014211.1 | AK055205.1 | mRNA | 11 |
| 811 | 8404.032.1-F_at | -0.60677 | 0.60676941 | 7.321788 | 5E-11 | 8404.032. | NM_004684.2 | CQ498058.1 | GENBANK_PATENT | 1 |
| 812 | 2115.003.1-E_at | -0.60663 | 0.60662753 | 7.319079 | 5E-11 | 2115.003. | NM_004956.3 | DA128833.1 | EST | 1 |
| 813 | 57447.035.1-T_at | -0.60656 | 0.60656033 | 7.317796 | 5E-11 | 57447.035 | NM_201535.1 | BQ636638.1 | EST | 1 |
| 814 | 8404.009.1-T_at | -0.60613 | 0.60612981 | 7.309584 | 5E-11 | 8404.009. | NM_004684.2 | BP258993.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 815 | 8404.028.3-B_at | −0.60565 | 0.6056493939 | 7.300432 | 5E−11 | 8404.028. | NM_004684.2 | CQ727530.1 | GENBANK_PATENT | 1 |
| 816 | 6289.003.1-B_at | −0.60525 | 0.60524909 | 7.292816 | 5E−11 | 6289.003. | NM_030754.2 | R83510.1 | EST | 1 |
| 817 | 7170.025.1-F_at | 0.604985 | 0.6049846 | 7.287789 | 5E−11 | 7170.025. | NM_153649.2 | BE208737.1 | EST | 1 |
| 818 | 8404.030.1-D_at | −0.60498 | 0.60498368 | 7.287771 | 5E−11 | 8404.030. | NM_004684.2 | CD357736.1 | EST | 1 |
| 819 | 8404.009.1-F_at | −0.60494 | 0.6049439 | 7.287016 | 5E−11 | 8404.009. | NM_004684.2 | BP258993.1 | EST | 1 |
| 820 | 2335.009.1-T_at | 0.604716 | 0.60471597 | 7.282687 | 5E−11 | 2335.009. | NM_212482.1 | BG927121.1 | EST | 51 |
| 821 | 22974.007.1-F_at | 0.604647 | 0.60464714 | 7.28138 | 5E−11 | 22974.007 | NM_012112.4 | AF287265.1 | mRNA | 213 |
| 822 | 3426.002.1-B_at | −0.6044 | 0.60439543 | 7.276604 | 5E−11 | 3426.002. | NM_000204.1 | CQ718881.1 | GENBANK_PATENT | 1 |
| 823 | 4638.003.1-D_at | −0.60438 | 0.60437577 | 7.276231 | 5E−11 | 4638.003. | NM_053025.2 | BP289609.1 | EST | 1 |
| 824 | 4147.011.1-T_at | −0.6043 | 0.60430187 | 7.274829 | 6E−11 | 4147.011. | NM_002380.3 | BI559593.1 | EST | 2 |
| 825 | 6876.016.2-T_at | −0.60425 | 0.60425392 | 7.27392 | 6E−11 | 6876.016. | NM_0011001522. | AB209555.1 | mRNA | 2 |
| 826 | 23650.003.1-F_at | −0.60408 | 0.60408338 | 7.270687 | 6E−11 | 23650.003 | NM_058193.1 | BI333387.1 | EST | 1 |
| 827 | 4744.004.1-E_at | 0.60408 | 0.6040798 | 7.270619 | 6E−11 | 4744.004. | NM_021076.2 | BQ636126.1 | EST | 1 |
| 828 | 64168.010.1-F_at | −0.60405 | 0.60404978 | 7.270051 | 6E−11 | 64168.010 | NM_022351.2 | BM985162.1 | EST | 1 |
| 829 | 9073.001.1-F_at | −0.60404 | 0.60404345 | 7.269931 | 6E−11 | 9073.001. | NM_199328.1 | BC020866.1 | mRNA | 1 |
| 830 | 5288.001.3-B_at | −0.60399 | 0.60398504 | 7.268824 | 6E−11 | 5288.001. | NM_004570.2 | CQ720591.1 | GENBANK_PATENT | 1 |
| 831 | 3866.005.1-D_at | −0.60384 | 0.60383806 | 7.26604 | 6E−11 | 3866.005. | NM_002275.2 | AL832226.1 | mRNA | 37 |
| 832 | 8404.021.1-T_at | −0.6038 | 0.60380179 | 7.265353 | 6E−11 | 8404.021. | NM_004684.2 | DA291834.1 | EST | 1 |
| 833 | 25925.011.1-E_at | −0.60378 | 0.6037774 | 7.264891 | 6E−11 | 25925.011 | NM_015461.1 | DA105762.1 | EST | 1 |
| 834 | 23266.001.3-F_at | −0.60352 | 0.60352263 | 7.260069 | 6E−11 | 23266.001 | NM_012302.2 | AK123422.1 | mRNA | 2 |
| 835 | 9232.004.1-F_at | 0.603479 | 0.60347894 | 7.259242 | 6E−11 | 9232.004. | NM_004219.2 | BF983295.1 | EST | 1 |
| 836 | 4147.005.2-F_at | −0.60347 | 0.60346555 | 7.258989 | 6E−11 | 4147.005. | NM_002380.3 | CQ716197.1 | EST | 1 |
| 837 | 2335.025.3-B_at | 0.603394 | 0.60339429 | 7.257641 | 6E−11 | 2335.025. | NM_212482.1 | CQ715726.1 | GENBANK_PATENT | 3 |
| 838 | 4638.0061-C_at | −0.60335 | 0.60335253 | 7.256851 | 6E−11 | 4638.006. | NM_053025.2 | BC005817.1 | EST | 2 |
| 839 | 147804.004.1-T | 0.603318 | 0.60331792 | 7.256196 | 6E−11 | 147804.00 | NM_001010856. | DA204897.1 | GENBANK_PATENT | 1 |
| 840 | 81704.013.1-D_at | −0.60318 | 0.60318333 | 7.253652 | 6E−11 | 81704.013 | NM_203447.1 | CQ723361.1 | GENBANK_PATENT | 1 |
| 841 | 54443.013.1-B_at | −0.60317 | 0.60317758 | 7.253543 | 6E−11 | 54443.013 | NM_018685.2 | BX410228.2 | EST | 1 |
| 842 | 1410.005.1-T_at | −0.60301 | 0.60300785 | 7.250335 | 6E−11 | 1410.005. | NM_001885.1 | BM702557.1 | EST | 1 |
| 843 | 25925.009.1-T_at | −0.60288 | 0.60287704 | 7.247864 | 7E−11 | 25925.009 | NM_015461.1 | DB064380.1 | EST | 1 |
| 844 | 3204.001.1-T_at | −0.60272 | 0.60272058 | 7.24491 | 7E−11 | 3204.001. | NM_006896.3 | BX104300.1 | EST | 1 |
| 845 | 29997.012.1-F_at | −0.60268 | 0.60268472 | 7.244233 | 7E−11 | 29997.012 | NM_015710.3 | BG746448.1 | EST | 1 |
| 846 | 2.005.1-C_at | −0.60255 | 0.60254732 | 7.24164 | 7E−11 | 2.005.1 | NM_000014.4 | BI493707.1 | EST | 1 |
| 847 | 140885.011.1-F | −0.60254 | 0.60254281 | 7.241555 | 7E−11 | 140885.01 | NM_080792.2 | BM041242.1 | EST | 1 |
| 848 | 7153.002.3-F_at | 0.602528 | 0.60252816 | 7.241278 | 7E−11 | 7153.002. | NM_011067.2 | CQ735949.1 | GENBANK_PATENT | 114 |
| 849 | 1063.002.1-F_at | 0.602485 | 0.60248476 | 7.24046 | 7E−11 | 1063.002. | NM_016343.3 | CQ728087.1 | GENBANK_PATENT | 1 |
| 850 | 10144.021.1-F_at | −0.60221 | 0.60221389 | 7.235351 | 7E−11 | 10144.021 | NM_014883.2 | BG434219.1 | EST | 1 |
| 851 | 8404.025.1-E_at | −0.60217 | 0.60217399 | 7.234599 | 7E−11 | 8404.025. | NM_004684.2 | DB086831.1 | EST | 1 |
| 852 | 6876.020.1-B_at | −0.60216 | 0.60215903 | 7.234317 | 7E−11 | 6876.020. | NM_0011001522. | BM921237.1 | EST | 1 |
| 853 | 7170.006.1-C_at | 0.601994 | 0.6019941 | 7.231209 | 7E−11 | 7170.006. | NM_153649.2 | DB003864.1 | EST | 1 |
| 854 | 10051.016.1-T_at | 0.601783 | 0.60178293 | 7.227232 | 7E−11 | 10051.016 | NM_001002799. | DB062440.1 | GENBANK_PATENT | 1 |
| 855 | 5288.001.1-D_at | −0.60173 | 0.6017334 | 7.2263 | 7E−11 | 5288.001. | NM_004570.2 | CQ720591.1 | GENBANK_PATENT | 1 |
| 856 | 7018.029.1-T_at | −0.60153 | 0.60152604 | 7.222397 | 7E−11 | 7018.029. | NM_001063.2 | AV656085.1 | EST | 1 |
| 857 | 5627.002.1-B_at | −0.60134 | 0.6013408 | 7.218913 | 7E−11 | 5627.002. | NM_000313.1 | CQ731592.1 | GENBANK_PATENT | 1 |
| 858 | 57447.037.1-F_at | −0.60118 | 0.60117663 | 7.215826 | 7E−11 | 57447.037 | NM_201535.1 | BF793156.1 | EST | 1 |
| 859 | 4147.005.2-D_at | −0.60084 | 0.60084391 | 7.209576 | 8E−11 | 4147.005. | NM_002380.3 | CQ716197.1 | GENBANK_PATENT | 1 |
| 860 | 8404.023.1-T_at | −0.60074 | 0.6007351 | 7.207533 | 8E−11 | 8404.023. | NM_004684.2 | BX463355.2 | EST | 1 |
| 861 | 3872.006.1-D_at | −0.60063 | 0.60063372 | 7.20563 | 8E−11 | 3872.006. | NM_000422.1 | BM017443.1 | EST | 1 |
| 862 | 399687.001.1-C | −0.60061 | 0.60060752 | 7.205138 | 8E−11 | 399687.00 | NM_078471.3 | BM922301.1 | EST | 2 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 863 | 3815.002.4-D_at | −0.60047 | 0.6004748 | 7.202648 | 8E-11 | 3815.002. | NM_000222.1 | CQ719901.1 | GENBANK_PATENT | 1 |
| 864 | 59.034.2-B_at | −0.60033 | 0.60033475 | 7.200021 | 8E-11 | 59.034.2 | — | — | — | 1 |
| 865 | 8404.035.1-T_at | −0.60027 | 0.60026583 | 7.198729 | 8E-11 | 8404.035. | NM_004684.2 | BG716198.1 | EST | 1 |
| 866 | 8404.030.1-T_at | −0.60022 | 0.60021743 | 7.197822 | 8E-11 | 8404.030. | NM_004684.2 | CD357736.1 | EST | 1 |
| 867 | 54997.002.2-T_at | −0.60016 | 0.60015635 | 7.196677 | 8E-11 | 54997.002 | NM_017899.1 | CQ729176.1 | GENBANK_PATENT | 1 |
| 868 | 57561.001.1-F_at | −0.6001 | 0.60010368 | 7.19569 | 8E-11 | 57561.001 | NM_020801.1 | BQ428039.1 | EST | 1 |
| 869 | 8404.031.1-T_at | −0.6 | 0.59999606 | 7.193674 | 8E-11 | 8404.031. | NM_004684.2 | BP327616.1 | EST | 1 |
| 870 | 2.025.1-E_at | 0.599999 | 0.59998752 | 7.193514 | 8E-11 | 2.025.1 | NM_000014.4 | DB288732.1 | EST | 1 |
| 871 | 699.002.1-F_at | 0.599982 | 0.59998236 | 7.193417 | 8E-11 | 699.002.1 | NM_004336.2 | CQ715813.1 | GENBANK_PATENT | 1 |
| 872 | 57447.041.1-F_at | −0.59992 | 0.59999151 | 7.192157 | 8E-11 | 57447.041 | NM_201535.1 | DA295124.1 | EST | 1 |
| 873 | 9055.013.1-D_at | 0.59986 | 0.59986038 | 7.191132 | 8E-11 | 9055.013. | NM_003981.2 | CN348395.1 | EST | 1 |
| 874 | 8404.008.1-D_at | −0.59979 | 0.5997907 | 7.189828 | 8E-11 | 8404.008. | NM_004684.2 | DA342341.1 | EST | 1 |
| 875 | 7018.028.1-T_at | −0.59975 | 0.59975341 | 7.189129 | 8E-11 | 7018.028. | NM_001063.2 | BX537660.1 | mRNA | 1 |
| 876 | 2568.005.1-T_at | −0.59968 | 0.59967705 | 7.1877 | 8E-11 | 2568.005. | NM_014211.1 | AK055205.1 | mRNA | 11 |
| 877 | 10051.005.3-T_at | −0.59953 | 0.59953164 | 7.184979 | 8E-11 | 10051.005 | NM_001002799. | BU183025.1 | EST | 1 |
| 878 | 2568.002.2-T_at | −0.59944 | 0.59943802 | 7.183228 | 9E-11 | 2568.002. | NM_014211.1 | DB235581.1 | EST | 1 |
| 879 | 4147.004.1-F_at | −0.59921 | 0.59921316 | 7.179023 | 9E-11 | 4147.004. | NM_002380.3 | AX675291.1 | GENBANK_PATENT | 1 |
| 880 | 2938.001.1-T_at | −0.59919 | 0.59919321 | 7.17865 | 9E-11 | 2938.001. | NM_145740.2 | AV683456.1 | EST | 1 |
| 881 | 1308.007.1-E_at | −0.59902 | 0.59902115 | 7.175435 | 9E-11 | 1308.007. | NM_130778.1 | BF916393.1 | EST | 1 |
| 882 | 2982.012.1-T_at | −0.59882 | 0.59881603 | 7.171604 | 1E-10 | 2982.012. | NM_000856.2 | BC012627.1 | mRNA | 2 |
| 883 | 8404.028.1-D_at | −0.59877 | 0.5987733 | 7.170806 | 1E-10 | 8404.028. | NM_004684.2 | CQ727530.1 | GENBANK_PATENT | 1 |
| 884 | 7373.001.2-B_at | −0.5986 | 0.598602 | 7.167609 | 1E-10 | 7373.001. | NM_021110.1 | DB089175.1 | EST | 1 |
| 885 | 2893.002.2-B_at | −0.59834 | 0.59834456 | 7.162807 | 1E-10 | 2893.002. | NM_000829.1 | DA365406.1 | EST | 1 |
| 886 | 116369.006.4-C | −0.59832 | 0.59831944 | 7.162338 | 1E-10 | 116369.00 | NM_052961.2 | AX480884.1 | GENBANK_PATENT | 1 |
| 887 | 6304.007.1-T_at | −0.59819 | 0.59819347 | 7.15999 | 1E-10 | 6304.007. | NM_002971.2 | DB141052.1 | EST | 1 |
| 888 | 2335.035.1-T_at | 0.597963 | 0.5979628 | 7.155692 | 1E-10 | 2335.035. | NM_212482.1 | CX755647.1 | EST | 1 |
| 889 | 4751.002.1-T_at | 0.597837 | 0.59783662 | 7.153342 | 1E-10 | 4751.002. | NM_002497.2 | BI464450.1 | EST | 1 |
| 890 | 64151.001.2-T_at | 0.597704 | 0.59770416 | 7.150876 | 1E-10 | 64151.001 | NM_022346.3 | CQ729716.1 | GENBANK_PATENT | 2 |
| 891 | 29089.003.1-T_at | 0.597695 | 0.59769515 | 7.150708 | 1E-10 | 29089.003 | NM_014176.1 | AV740591.1 | EST | 1 |
| 892 | 59.031.1-B_at | −0.59762 | 0.59761835 | 7.149279 | 1E-10 | 59.031.1 | NM_001613.1 | BG197213.1 | EST | 19 |
| 893 | 7018.025.1-T_at | −0.59758 | 0.59757801 | 7.148528 | 1E-10 | 7018.025. | NM_001063.2 | BE971065.1 | EST | 1 |
| 894 | 3860.008.1-T_at | −0.59747 | 0.5974712 | 7.146341 | 1E-10 | 3860.008. | NM_153490.1 | DA668693.1 | EST | 1 |
| 895 | 5858.003.3-F_at | −0.59734 | 0.5973382 | 7.144067 | 1E-10 | 5858.003. | NM_002864.1 | AX512279.1 | GENBANK_PATENT | 2 |
| 896 | 8404.009.1-C_at | −0.59725 | 0.59725088 | 7.142444 | 1E-10 | 8404.009. | NM_004684.2 | BP258993.1 | EST | 1 |
| 897 | 7169.022.1-T_at | −0.59719 | 0.59718906 | 7.141295 | 1E-10 | 7169.022. | NM_213674.1 | BG385598.1 | EST | 1 |
| 898 | 25925.006.1-T_at | 0.597714 | 0.59714283 | 7.140436 | 1E-10 | 25925.006 | NM_022346.3 | DB276803.1 | EST | 1 |
| 899 | 59.049.1-F_at | −0.59713 | 0.59712525 | 7.140109 | 1E-10 | 59.049.1 | — | — | — | — |
| 900 | 5284.003.1-T_at | −0.59709 | 0.59708796 | 7.139416 | 1E-10 | 5284.003. | NM_002644.2 | BP220016.1 | EST | 1 |
| 901 | 2982.002.1-F_at | −0.59705 | 0.59705092 | 7.138728 | 1E-10 | 2982.002. | NM_000856.2 | BP199345.1 | EST | 1 |
| 902 | 2568.002.1-T_at | −0.59693 | 0.59693461 | 7.136567 | 1E-10 | 2568.002. | NM_014211.1 | DB235581.1 | EST | 1 |
| 903 | 301.004.1-B_at | −0.59688 | 0.59688305 | 7.135609 | 1E-10 | 301.004.1 | NM_000700.1 | DB194639.1 | EST | 1 |
| 904 | 25925.011.1-F_at | −0.59665 | 0.59664856 | 7.131256 | 1E-10 | 25925.011 | NM_015461.1 | DA105762.1 | EST | 1 |
| 905 | 59.004.1-F_at | −0.59647 | 0.59647098 | 7.127961 | 1E-10 | 59.004.1 | NM_001613.1 | CQ696293.1 | GENBANK_PATENT | 1 |
| 906 | 6289.002.1-B_at | −0.59635 | 0.59634661 | 7.125655 | 1E-10 | 6289.002. | NM_030754.2 | AA345111.1 | EST | 1 |
| 907 | 244.003.1-C_at | −0.59612 | 0.59612161 | 7.121484 | 1E-10 | 244.003.1 | NM_001630.1 | BM809869.1 | EST | 1 |
| 908 | 11065.008.1-C_at | 0.595877 | 0.59587676 | 7.116948 | 1E-10 | 11065.008 | NM_181802.1 | NM_181800.1 | REFSEQ | 5 |
| 909 | 7091.006.1-T_at | −0.59586 | 0.59586302 | 7.116693 | 1E-10 | 7091.006. | NM_007005.3 | AK057236.1 | mRNA | 1 |
| 910 | 79608.009.1-F_at | −0.59581 | 0.59580998 | 7.115711 | 1E-10 | 79608.009 | NM_024557.2 | CA406619.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 911 | 9413.002.1-T_at | −0.5958 | 0.5958106 | 7.115546 | 1E−10 | 9413.002. | NM_004816.2 | AW779892.1 | EST | 1 |
| 912 | 7431.064.1-C_at | −0.59575 | 0.59575257 | 7.114648 | 1E−10 | 7431.064. | NM_003380.2 | BE728213.1 | EST | 1 |
| 913 | 8404.029.1-E_at | −0.5957 | 0.59569505 | 7.113583 | 1E−10 | 8404.029. | NM_004684.2 | AA384658.1 | EST | 1 |
| 914 | 6876.020.1-T_at | −0.59541 | 0.59541268 | 7.108359 | 1E−10 | 6876.020. | NM_001001522. | BM921237.1 | EST | 1 |
| 915 | 301.005.1-T_at | −0.59539 | 0.59538592 | 7.107864 | 1E−10 | 301.005.1 | NM_000700.1 | AU139656.1 | EST | 7 |
| 916 | 9055.014.1-T_at | −0.59529 | 0.59528897 | 7.106085 | 1E−10 | 9055.014. | NM_003981.2 | BE300335.1 | EST | 1 |
| 917 | 4281.023.1-T_at | −0.5952 | 0.59520125 | 7.104449 | 1E−10 | 4281.023. | NM_033290.1 | AY539976.1 | mRNA | 1 |
| 918 | 3868.005.1-D_at | −0.59519 | 0.59519189 | 7.104276 | 1E−10 | 3868.005. | NM_005557.2 | BG682632.1 | EST | 1 |
| 919 | 1062.001.6-B_at | 0.595002 | 0.59500239 | 7.100775 | 1E−10 | 1062.001. | NM_001813.2 | CQ715352.1 | GENBANK_PATENT | 1 |
| 920 | 5858.005.1-T_at | −0.59493 | 0.5949259 | 7.099362 | 1E−10 | 5858.005. | NM_002864.1 | DB040351.1 | EST | 1 |
| 921 | 51201.007.1-F_at | −0.59491 | 0.59490972 | 7.099063 | 1E−10 | 51201.007 | NM_016353.2 | BF541714.1 | EST | 1 |
| 922 | 4240.001.1-B_at | −0.59478 | 0.59477936 | 7.096655 | 1E−10 | 4240.001. | NM_005928.1 | BF525404.1 | EST | 1 |
| 923 | 8404.029.1-T_at | −0.59477 | 0.59477341 | 7.096546 | 1E−10 | 8404.029. | NM_004684.2 | AA384658.1 | EST | 1 |
| 924 | 9413.001.1-T_at | −0.59469 | 0.59468964 | 7.094999 | 1E−10 | 9413.001. | NM_004816.2 | DA824091.1 | EST | 1 |
| 925 | 9768.005.1-T_at | −0.59458 | 0.59458041 | 7.092983 | 1E−10 | 9768.005. | NM_014736.4 | BG529193.1 | EST | 13 |
| 926 | 11197.001.1-T_at | −0.59454 | 0.59454222 | 7.092279 | 1E−10 | 11197.001 | NM_007191.2 | W37154.1 | EST | 1 |
| 927 | 6285.002.1-T_at | −0.59451 | 0.59450684 | 7.091626 | 1E−10 | 6285.002. | NM_006272.1 | BQ435930.1 | EST | 1 |
| 928 | 2335.006.2-F_at | 0.594359 | 0.59435947 | 7.088907 | 1E−10 | 2335.006. | NM_212482.1 | CX785805.1 | EST | 1 |
| 929 | 7169.001.1-C_at | −0.59424 | 0.59424202 | 7.086742 | 1E−10 | 7169.001. | NM_213674.1 | BM809268.1 | EST | 4 |
| 930 | 9493.004.1-T_at | −0.59408 | 0.59410838 | 7.084278 | 1E−10 | 9493.004. | NM_138555.1 | BM792243.1 | EST | 1 |
| 931 | 4601.014.1-T_at | −0.59408 | 0.59408377 | 7.083825 | 1E−10 | 4601.014. | NM_130439.3 | AX885544.1 | GENBANK_PATENT | 1 |
| 932 | 51203.002.2-F_at | 0.593876 | 0.59387576 | 7.079993 | 1E−10 | 51203.002 | NM_016359.2 | AL561514.3 | EST | 1 |
| 933 | 7018.022.1-F_at | 0.59374 | 0.593741 | 7.077512 | 1E−10 | 7018.022. | NM_001063.2 | T74625.1 | EST | 1 |
| 934 | 4288.009.1-F_at | 0.593675 | 0.59367472 | 7.076291 | 1E−10 | 4288.009. | NM_002417.2 | BG106198.1 | EST | 1 |
| 935 | 8321.004.1-D_at | 0.59365 | 0.59365154 | 7.075865 | 1E−10 | 8321.004. | NM_003505.1 | AA249884.1 | EST | 1 |
| 936 | 8564.004.1-E_at | −0.59345 | 0.59344954 | 7.072148 | 1E−10 | 8564.004. | NM_003679.2 | AV646525.1 | EST | 3 |
| 937 | 7169.022.1-C_at | −0.59343 | 0.59343079 | 7.071803 | 1E−10 | 7169.022. | NM_213674.1 | BG385598.1 | EST | 1 |
| 938 | 29127.013.1-T_at | 0.593386 | 0.59338577 | 7.070975 | 1E−10 | 29127.013 | NM_013277.2 | DA812983.1 | EST | 1 |
| 939 | 2.018.1-B_at | −0.59317 | 0.59316746 | 7.066961 | 1E−10 | 2.018.1 | NM_000014.4 | DB090657.1 | EST | 1 |
| 940 | 2.005.1-D_at | −0.59314 | 0.59313787 | 7.066417 | 1E−10 | 2.005.1 | NM_000014.4 | BI493707.1 | EST | 1 |
| 941 | 1058.004.2-T_at | 0.5931 | 0.593110026 | 7.065726 | 2E−10 | 1058.004. | NM_001809.2 | AL555851.3 | EST | 1 |
| 942 | 2232.014.1-C_at | −0.59284 | 0.59284081 | 7.060959 | 2E−10 | 2232.014. | NM_044110.2 | DB052280.1 | EST | 1 |
| 943 | 23650.005.1-E_at | −0.59283 | 0.59282614 | 7.06069 | 2E−10 | 23650.005 | NM_058193.1 | DB116882.1 | EST | 1 |
| 944 | 5621.002.2-T_at | −0.59271 | 0.59270593 | 7.058482 | 2E−10 | 5621.002. | NM_000311.2 | DA151722.1 | EST | 1 |
| 945 | 51201.005.1-B_at | −0.5927 | 0.59270147 | 7.058401 | 2E−10 | 51201.005 | NM_016353.2 | DA655803.1 | EST | 1 |
| 946 | 667.022.1-F_at | −0.59265 | 0.59265274 | 7.057506 | 2E−10 | 667.022.1 | NM_183380.1 | AX683196.1 | GENBANK_PATENT | 1 |
| 947 | 54443.012.1-C_at | 0.592546 | 0.59254619 | 7.055551 | 2E−10 | 54443.012 | NM_018685.2 | BG167656.1 | EST | 1 |
| 948 | 25802.003.1-C_at | −0.59251 | 0.59250565 | 7.054807 | 2E−10 | 25802.003 | NM_012134.1 | BC001755.1 | mRNA | 1 |
| 949 | 3479.003.1-T_at | −0.59248 | 0.59247776 | 7.054295 | 2E−10 | 3479.003. | NM_000618.2 | U40870.1 | mRNA | 4 |
| 950 | 94274.003.1-D_at | −0.59243 | 0.59242603 | 7.053346 | 2E−10 | 94274.003 | NM_033256.1 | AB056509.1 | mRNA | 1 |
| 951 | 84668.003.1-T_at | −0.59229 | 0.5922945 | 7.050934 | 2E−10 | 84668.003 | NM_032581.2 | CQ727246.1 | GENBANK_PATENT | 1 |
| 952 | 22974.008.1-E_at | 0.592131 | 0.59213066 | 7.04793 | 2E−10 | 22974.008 | NM_012112.4 | CQ727779.1 | GENBANK_PATENT | 1 |
| 953 | 55656.007.3-B_at | 0.592104 | 0.59210361 | 7.047434 | 2E−10 | 55656.007 | NM_017864.2 | CQ715091.1 | GENBANK_PATENT | 1 |
| 954 | 29127.002.1-T_at | 0.591958 | 0.59195836 | 7.044773 | 2E−10 | 29127.002 | NM_013277.2 | AB030251.1 | mRNA | 44 |
| 955 | 4281.012.2-T_at | −0.59195 | 0.59194704 | 7.044565 | 2E−10 | 4281.012. | NM_033290.1 | CN298826.1 | EST | 1 |
| 956 | 2335.013.1-B_at | 0.591874 | 0.59187364 | 7.043221 | 2E−10 | 2335.013. | NM_212482.1 | AL551632.3 | EST | 2 |
| 957 | 79627.003.1-B_at | −0.59185 | 0.59184571 | 7.042709 | 2E−10 | 79627.003 | NM_024576.3 | CQ725357.1 | GENBANK_PATENT | 1 |
| 958 | 2982.014.1-T_at | −0.5918 | 0.5918033 | 7.041932 | 2E−10 | 2982.014. | NM_000856.2 | BM469193.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 959 | 2335.053.1-T_at | 0.591795 | 0.5917954 | 7.041788 | 2E-10 | 2335.053. | NM_212482.1 | BX380854.2 | EST | 1 |
| 960 | 667.001.1-F_at | -0.59167 | 0.5916653 | 7.039406 | 2E-10 | 667.001.1 | NM_183380.1 | BG387402.1 | EST | 2 |
| 961 | 8404.030.1-B_at | -0.59165 | 0.59165467 | 7.039211 | 2E-10 | 8404.030. | NM_004684.2 | CD357736.1 | EST | 1 |
| 962 | 2335.025.1-C_at | 0.591645 | 0.59164549 | 7.039043 | 2E-10 | 2335.025. | NM_212482.1 | CQ715726.1 | GENBANK_PATENT | 3 |
| 963 | 140885.010.3-D | -0.59164 | 0.59164248 | 7.038988 | 2E-10 | 140885.01 | NM_080792.2 | CQ728313.1 | GENBANK_PATENT | 1 |
| 964 | 55366.001.2-F_at | -0.59159 | 0.59158568 | 7.037948 | 2E-10 | 55366.001 | NM_018490.1 | CQ722924.1 | GENBANK_PATENT | 1 |
| 965 | 7169.015.1-D_at | 0.591548 | 0.59147642 | 7.035949 | 2E-10 | 7169.015. | NM_213674.1 | DB291177.1 | EST | 1 |
| 966 | 57447.002.1-B_at | -0.59141 | 0.59140949 | 7.034725 | 2E-10 | 57447.002 | NM_201535.1 | BF526188.1 | EST | 1 |
| 967 | 22974.008.1-T_at | 0.591372 | 0.59137204 | 7.034039 | 2E-10 | 22974.008 | NM_012112.4 | CQ727779.1 | GENBANK_PATENT | 1 |
| 968 | 6876.011.1-C_at | -0.59135 | 0.59135455 | 7.033719 | 2E-10 | 6876.011. | NM_001001522. | AW956430.1 | EST | 1 |
| 969 | 4281.008.2-D_at | -0.59123 | 0.591231 | 7.03146 | 2E-10 | 4281.008. | NM_033290.1 | AY539984.1 | mRNA | 1 |
| 970 | 59.008.1-T_at | -0.59118 | 0.59117565 | 7.030448 | 2E-10 | 59.008.1 | NM_001613.1 | BP373197.1 | EST | 1 |
| 971 | 23266.008.1-F_at | -0.59109 | 0.59109236 | 7.028926 | 2E-10 | 23266.008 | NM_012302.2 | CQ799210.1 | GENBANK_PATENT | 1 |
| 972 | 2568.003.2-T_at | -0.59089 | 0.59089352 | 7.025292 | 2E-10 | 2568.003. | NM_014211.1 | CD696885.1 | EST | 1 |
| 973 | 5311.003.1-T_at | -0.59073 | 0.59073163 | 7.022336 | 2E-10 | 5311.003. | NM_000297.2 | DA153606.1 | EST | 1 |
| 974 | 6304.011.1-T_at | -0.59052 | 0.59052216 | 7.018512 | 2E-10 | 6304.011. | NM_002971.2 | BP359118.1 | EST | 1 |
| 975 | 3861.008.1-B_at | -0.59048 | 0.59048159 | 7.017772 | 2E-10 | 3861.008. | NM_000526.3 | BE184532.1 | EST | 1 |
| 976 | 7018.013.1-B_at | -0.59035 | 0.59035214 | 7.01541 | 2E-10 | 7018.013. | NM_001063.2 | AX147484.1 | GENBANK_PATENT | 1 |
| 977 | 8404.005.1-F_at | -0.59023 | 0.59022734 | 7.013134 | 2E-10 | 8404.005. | NM_004684.2 | DA763956.1 | EST | 1 |
| 978 | 7170.027.1-C_at | 0.590216 | 0.59021624 | 7.012932 | 2E-10 | 7170.027. | NM_153649.2 | BQ959117.1 | EST | 1 |
| 979 | 8404.023.1-C_at | -0.59009 | 0.59009089 | 7.010646 | 2E-10 | 8404.023. | NM_004684.2 | BX463355.2 | EST | 1 |
| 980 | 7373.007.1-C_at | -0.59009 | 0.59009037 | 7.010637 | 2E-10 | 7373.007. | NM_021110.1 | Y11710.1 | mRNA | 2 |
| 981 | 1410.009.1-T_at | -0.5899 | 0.5898986 | 7.007142 | 2E-10 | 1410.009. | NM_001885. | BQ437433.1 | EST | 3 |
| 982 | 79745.004.3-D_at | -0.58947 | 0.58947272 | 6.999388 | 2E-10 | 79745.004 | NM_024692.3 | AK057267.1 | mRNA | 1 |
| 983 | 24137.004.1-T_at | -0.58944 | 0.5894492 | 6.99896 | 2E-10 | 24137.004 | NM_012310.2 | BQ055679.1 | EST | 1 |
| 984 | 6241.013.1-B_at | -0.58941 | 0.58941768 | 6.998387 | 2E-10 | 6241.013. | NM_001034.1 | BG261296.1 | EST | 1 |
| 985 | 1410.001.1-T_at | -0.5894 | 0.58939515 | 6.997977 | 2E-10 | 1410.001. | NM_001885. | W40377.1 | EST | 1 |
| 986 | 4781.015.2-B_at | -0.58938 | 0.5893752 | 6.997614 | 2E-10 | 4781.015. | NM_005596.1 | DN995118.1 | EST | 1 |
| 987 | 72.002.1-T_at | -0.58937 | 0.58936787 | 6.99748 | 2E-10 | 72.002.1 | NM_001615.3 | BP372072.1 | EST | 2 |
| 988 | 4833.004.1-D_at | 0.589279 | 0.58927851 | 6.995855 | 2E-10 | 4833.004. | NM_005009.2 | BG478602.1 | EST | 8 |
| 989 | 57447.024.1-D_at | -0.58924 | 0.58924443 | 6.995235 | 2E-10 | 57447.024 | NM_201535.1 | DA566498.1 | EST | 1 |
| 990 | 2982.013.2-T_at | -0.5892 | 0.58920321 | 6.994486 | 2E-10 | 2982.013. | NM_000856.2 | CF594362.1 | EST | 1 |
| 991 | 79971.012.1-T_at | -0.58907 | 0.5890694 | 6.992053 | 2E-10 | 79971.012 | NM_001002292. | BG702604.1 | EST | 1 |
| 992 | 8404.028.3-C_at | -0.589 | 0.58899948 | 6.990782 | 2E-10 | 8404.028. | NM_004684.2 | CQ727530.1 | GENBANK_PATENT | 1 |
| 993 | 4638.011.1-E_at | -0.58897 | 0.58897325 | 6.990305 | 2E-10 | 4638.011. | NM_053025.2 | DB267860.1 | EST | 1 |
| 994 | 7169.004.1-C_at | -0.58895 | 0.58894617 | 6.989813 | 2E-10 | 7169.004. | NM_213674.1 | BG027526.1 | EST | 1 |
| 995 | 4288.004.1-F_at | -0.58788 | 0.58878813 | 6.986942 | 2E-10 | 4288.004. | NM_002417.2 | BP232141.1 | EST | 1 |
| 996 | 59.012.2-C_at | -0.58875 | 0.58875113 | 6.98627 | 2E-10 | 59.012.2 | NM_001613.1 | AL546033.3 | EST | 1 |
| 997 | 301.008.1-B_at | -0.5887 | 0.58869814 | 6.985308 | 2E-10 | 301.008.1 | NM_000700.1 | CD688703.1 | EST | 1 |
| 998 | 4281.012.1-T_at | -0.58864 | 0.58863805 | 6.984217 | 2E-10 | 4281.012. | NM_033290.1 | CN298826.1 | EST | 1 |
| 999 | 2335.016.1-F_at | 0.58863 | 0.58863031 | 6.984076 | 2E-10 | 2335.016. | NM_212482.1 | CQ875357.1 | GENBANK_PATENT | 281 |
| 1000 | 259266.003.1-C | 0.588552 | 0.58855227 | 6.98266 | 2E-10 | 259266.00 | NM_018136.2 | CB217235.1 | EST | 1 |
| 1001 | 9055.020.1-T_at | 0.588545 | 0.58854487 | 6.982525 | 2E-10 | 9055.020. | NM_003981.2 | BP363287.1 | EST | 1 |
| 1002 | 7091.016.1-T_at | -0.58837 | 0.58836788 | 6.979313 | 2E-10 | 7091.016. | NM_007005.3 | DA323941.1 | EST | 1 |
| 1003 | 59.023.1-T_at | -0.5882 | 0.58819673 | 6.976209 | 2E-10 | 59.023.1 | NM_001613.1 | DB248573.1 | EST | 1 |
| 1004 | 57162.010.1-B_at | -0.58814 | 0.58813698 | 6.975125 | 2E-10 | 57162.010 | NM_020651.2 | DB241492.1 | EST | 1 |
| 1005 | 4781.002.2-D_at | -0.58809 | 0.58808634 | 6.974207 | 2E-10 | 4781.002. | NM_005596.1 | BF688131.1 | EST | 2 |
| 1006 | 6122.037.1-T_at | -0.58806 | 0.58805933 | 6.973718 | 2E-10 | 6122.037. | NM_000967.3 | BP417473.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 1007 | 4240.015.1-B_at | −0.58803 | 0.58803047 | 6.973195 | 2E-10 | 4240.015. | NM_005928.1 | AA021047.1 | EST | 1 |
| 1008 | 59.034.1-T_at | −0.58783 | 0.58782732 | 6.969513 | 2E-10 | 59.034.1 | — | — | — | — |
| 1009 | 8404.004.2-D_at | −0.58782 | 0.58782345 | 6.969443 | 2E-10 | 8404.004. | NM_004684.2 | DA589023.1 | EST | 1 |
| 1010 | 9413.001.2-T_at | −0.58777 | 0.5877726 | 6.968522 | 2E-10 | 9413.001. | NM_004816.2 | DA824091.1 | EST | 1 |
| 1011 | 2.005.1-F_at | −0.58772 | 0.58771984 | 6.967566 | 2E-10 | 2.005.1 | NM_000014.4 | BI493707.1 | EST | 1 |
| 1012 | 6304.002.1-T_at | −0.58771 | 0.58770553 | 6.967307 | 2E-10 | 6304.002. | NM_002971.2 | BC001744.1 | mRNA | 33 |
| 1013 | 3852.005.1-C_at | −0.58768 | 0.58768033 | 6.966851 | 2E-10 | 3852.005. | NM_000424.2 | R47851.1 | EST | 1 |
| 1014 | 7170.027.1-B_at | −0.587642 | 0.58764175 | 6.966152 | 2E-10 | 7170.027. | NM_153649.2 | BQ959117.1 | EST | 1 |
| 1015 | 301.013.1-T_at | −0.5873 | 0.58729565 | 6.959888 | 2E-10 | 301.013.1 | NM_000700.1 | BF130804.1 | EST | 1 |
| 1016 | 6304.012.1-F_at | −0.58724 | 0.58724193 | 6.958916 | 2E-10 | 6304.012. | NM_002971.2 | BP359502.1 | EST | 1 |
| 1017 | 57447.051.2-T_at | −0.58722 | 0.58721828 | 6.958489 | 2E-10 | 57447.051 | NM_201535.1 | BX460053.2 | GENBANK_PATENT | 1 |
| 1018 | 11065.005.1-C_at | −0.587192 | 0.58719194 | 6.958012 | 2E-10 | 11065.005 | NM_181802.1 | CS138820.1 | GENBANK_PATENT | 2 |
| 1019 | 6422.002.1-F_at | −0.58719 | 0.58719017 | 6.95798 | 2E-10 | 6422.002. | NM_003012.3 | AX565729.1 | GENBANK_PATENT | 3 |
| 1020 | 6241.013.1-F_at | −0.587043 | 0.58704329 | 6.955324 | 3E-10 | 6241.013. | NM_001034.1 | BG261296.1 | EST | 1 |
| 1021 | 2335.032.1-T_at | −0.58699 | 0.58699048 | 6.95437 | 3E-10 | 2335.032. | NM_212482.1 | DA647475.1 | EST | 1 |
| 1022 | 11065.005.2-T_at | −0.586925 | 0.5869248 | 6.953183 | 3E-10 | 11065.005 | NM_181802.1 | CS138820.1 | GENBANK_PATENT | 2 |
| 1023 | 2335.028.1-D_at | −0.586789 | 0.58678853 | 6.95072 | 3E-10 | 2335.028. | NM_212482.1 | AJ320525.1 | mRNA | 1 |
| 1024 | 29997.016.1-F_at | −0.58672 | 0.58671564 | 6.949404 | 3E-10 | 29997.016 | NM_015710.3 | BF686243.1 | EST | 1 |
| 1025 | 7018.014.1-T_at | −0.58659 | 0.58658835 | 6.947105 | 3E-10 | 7018.014. | NM_001063.3 | AX147483.1 | GENBANK_PATENT | 1 |
| 1026 | 1410.011.1-E_at | −0.58657 | 0.58657023 | 6.946778 | 3E-10 | 1410.011. | NM_001885.1 | BI561839.1 | EST | 1 |
| 1027 | 7170.040.1-E_at | −0.586568 | 0.58656826 | 6.946742 | 3E-10 | 7170.040. | NM_153649.2 | BG283654.1 | EST | 1 |
| 1028 | 6289.002.2-F_at | −0.5864 | 0.58639668 | 6.943645 | 3E-10 | 6289.002. | NM_030754.2 | AA345111.1 | EST | 1 |
| 1029 | 7373.003.4-C_at | −0.58637 | 0.58636622 | 6.943095 | 3E-10 | 7373.003. | NM_021110.1 | CQ716670.1 | GENBANK_PATENT | 1 |
| 1030 | 7170.041.1-F_at | −0.58605 | 0.58604991 | 6.93739 | 3E-10 | 7170.041. | NM_153649.2 | BF967161.1 | EST | 4 |
| 1031 | 128553.003.1-B | −0.586 | 0.58599544 | 6.936408 | 3E-10 | 128553.00 | NM_173485.2 | BP394387.1 | EST | 1 |
| 1032 | 4094.002.1-D_at | −0.58596 | 0.58595549 | 6.935688 | 3E-10 | 4094.002. | NM_001031804. | BI458211.1 | EST | 1 |
| 1033 | 7113.011.1-T_at | −0.5859 | 0.58589757 | 6.934644 | 3E-10 | 7113.011. | NM_056656.2 | DA868984.1 | EST | 2 |
| 1034 | 7170.002.1-C_at | −0.585876 | 0.58587638 | 6.934262 | 3E-10 | 7170.002. | NM_153649.2 | AL547448.3 | EST | 2 |
| 1035 | 8404.017.2-T_at | −0.58585 | 0.58584564 | 6.933708 | 3E-10 | 8404.017. | NM_004684.2 | CD001002.1 | EST | 1 |
| 1036 | 59.029.1-T_at | −0.58564 | 0.58563959 | 6.929996 | 3E-10 | 59.029.1 | NM_001613.1 | AL540709.3 | EST | 1 |
| 1037 | 29089.001.1-T_at | −0.585601 | 0.58560082 | 6.929298 | 3E-10 | 29089.001 | NM_014176.1 | CA495294.1 | EST | 2 |
| 1038 | 358.012.1-T_at | −0.5856 | 0.58559702 | 6.929229 | 3E-10 | 358.012.1 | NM_198098.1 | AX397685.1 | GENBANK_PATENT | 1 |
| 1039 | 9134.001.1-B_at | 0.585561 | 0.58556099 | 6.92858 | 3E-10 | 9134.001. | NM_057749.1 | BC007015.1 | mRNA | 1 |
| 1040 | 2335.013.1-C_at | 0.583476 | 0.58547585 | 6.927047 | 3E-10 | 2335.013. | NM_212482.1 | AL551632.3 | EST | 2 |
| 1041 | 1410.010.1-F_at | −0.58543 | 0.58542981 | 6.926219 | 3E-10 | 1410.010. | NM_001885.1 | AJ710474.1 | EST | 2 |
| 1042 | 2327.003.4-F_at | −0.58542 | 0.58541593 | 6.925969 | 3E-10 | 2327.003. | NM_001460.2 | AI223310.1 | EST | 1 |
| 1043 | 59.042.1-T_at | −0.58536 | 0.58536256 | 6.925008 | 3E-10 | 59.042.1 | NM_001613.1 | EH_001613.8 | PREDICTED | 1 |
| 1044 | 6304.007.2-T_at | −0.58518 | 0.58517695 | 6.921669 | 3E-10 | 6304.007. | NM_002971.2 | DB141052.1 | EST | 1 |
| 1045 | 8404.031.1-B_at | −0.58502 | 0.5850183 | 6.918815 | 3E-10 | 8404.031. | NM_004684.2 | BP327616.1 | EST | 1 |
| 1046 | 6289.001.1-F_at | −0.58499 | 0.58499281 | 6.918357 | 3E-10 | 6289.001. | NM_030754.2 | CR744712.1 | EST | 1 |
| 1047 | 1410.006.1-T_at | −0.58487 | 0.58487369 | 6.916216 | 3E-10 | 1410.006. | NM_001885.1 | BF670917.1 | EST | 1 |
| 1048 | 80034.004.1-T_at | −0.58483 | 0.58482793 | 6.915393 | 3E-10 | 80034.004 | NM_024969.2 | DA786544.1 | EST | 1 |
| 1049 | 1410.008.1-T_at | −0.58477 | 0.58476949 | 6.914343 | 3E-10 | 1410.008. | NM_001885.1 | R68496.1 | EST | 1 |
| 1050 | 57447.051.2-D_at | −0.5847 | 0.58469568 | 6.913017 | 3E-10 | 57447.051 | NM_201535.1 | BX460053.2 | GENBANK_PATENT | 1 |
| 1051 | 7170.016.3-B_at | 0.58466 | 0.58466041 | 6.912384 | 3E-10 | 7170.016. | NM_153649.2 | BF575596.1 | EST | 1 |
| 1052 | 4240.001.1-C_at | −0.58464 | 0.58463983 | 6.912014 | 3E-10 | 4240.001. | NM_005928.1 | BF525404.1 | EST | 1 |
| 1053 | 6288.001.1-T_at | −0.58463 | 0.58462773 | 6.911797 | 3E-10 | 6288.001. | NM_199161.1 | AX899121.1 | GENBANK_PATENT | 2 |
| 1054 | 7018.014.1-C_at | −0.58462 | 0.58461793 | 6.911621 | 3E-10 | 7018.014. | NM_001063.2 | AX147483.1 | GENBANK_PATENT | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 1055 | 8404.020.1-T_at | −0.58456 | 0.58455592 | 6.910507 | 3E-10 | 8404.020. | NM_004684.2 | DA298626.1 | EST | 1 |
| 1056 | 6289.001.2-F_at | −0.58442 | 0.58441549 | 6.907986 | 3E-10 | 6289.001. | NM_030754.2 | CR744712.1 | EST | 1 |
| 1057 | 6876.011.1-F_at | −0.58434 | 0.58433766 | 6.906588 | 3E-10 | 6876.011. | NM_001001522. | AW956430.1 | EST | 1 |
| 1058 | 8404.031.1-C_at | −0.5841 | 0.58410499 | 6.902414 | 3E-10 | 8404.031. | NM_004684.2 | BP327616.1 | EST | 1 |
| 1059 | 57447.010.1-T_at | −0.58408 | 0.5840791 | 6.90195 | 3E-10 | 57447.010 | NM_201535.1 | BP349691.1 | EST | 1 |
| 1060 | 1410.007.2-C_at | −0.58404 | 0.58404076 | 6.901262 | 3E-10 | 1410.007. | NM_001885.1 | BI548180.1 | EST | 1 |
| 1061 | 59.012.2-B_at | −0.58397 | 0.58396561 | 6.899914 | 3E-10 | 59.012.2 | NM_001613.1 | AL546033.3 | EST | 1 |
| 1062 | 3459.005.1-T_at | −0.58389 | 0.58388527 | 6.898474 | 3E-10 | 3459.005. | NM_000416.1 | BP259682.1 | EST | 1 |
| 1063 | 301.013.1-C_at | −0.58378 | 0.58377547 | 6.896506 | 3E-10 | 301.013.1 | NM_000700.1 | BF130804.1 | EST | 1 |
| 1064 | 83539.001.1-D_at | −0.58353 | 0.58353306 | 6.892163 | 3E-10 | 83539.001 | NM_031422.1 | BM919514.1 | EST | 3 |
| 1065 | 6288.004.1-F_at | −0.58351 | 0.58351232 | 6.891792 | 3E-10 | 6288.004. | NM_199161.1 | BG367754.1 | EST | 1 |
| 1066 | 4781.016.1-E_at | −0.58347 | 0.58347336 | 6.891094 | 3E-10 | 4781.016. | NM_005596.1 | DA518562.1 | EST | 1 |
| 1067 | 29997.012.1-E_at | −0.58343 | 0.58343189 | 6.890351 | 3E-10 | 29997.012 | NM_015710.3 | BG746448.1 | EST | 1 |
| 1068 | 57447.021.1-T_at | −0.5834 | 0.58339709 | 6.889728 | 3E-10 | 57447.021 | NM_201535.1 | BQ954948.1 | EST | 28 |
| 1069 | 3426.002.1-C_at | −0.58304 | 0.58304119 | 6.88336 | 3E-10 | 3426.002. | NM_000204.1 | CQ718881.1 | GENBANK_PATENT | 1 |
| 1070 | 53829.001.2-T_at | −0.58296 | 0.58295977 | 6.881904 | 4E-10 | 53829.001 | NM_023914.2 | NM_176894.1 | REFSEQ | 12 |
| 1071 | 2115.001.2-B_at | −0.58274 | 0.58274226 | 6.878015 | 4E-10 | 2115.001. | NM_004956.3 | X87175.1 | mRNA | 1 |
| 1072 | 10051.008.1-T_at | −0.58274 | 0.58274024 | 6.877979 | 4E-10 | 10051.008 | NM_001002799. | DA436898.1 | EST | 1 |
| 1073 | 1033.002.1-T_at | 0.582723 | 0.58272336 | 6.877677 | 4E-10 | 1033.002. | NM_005192.2 | BG771524.1 | EST | 1 |
| 1074 | 2335.005.1-D_at | 0.582597 | 0.58259651 | 6.875411 | 4E-10 | 2335.005. | NM_212482.1 | BX417388.2 | EST | 1 |
| 1075 | 7113.009.1-T_at | −0.58253 | 0.58252547 | 6.874142 | 4E-10 | 7113.009. | NM_005656.2 | DA873416.1 | EST | 1 |
| 1076 | 3866.002.1-B_at | −0.58251 | 0.58251356 | 6.873929 | 4E-10 | 3866.002. | NM_002275.2 | BG990007.1 | EST | 1 |
| 1077 | 140885.014.1-D | −0.58226 | 0.58225938 | 6.869391 | 4E-10 | 140885.01 | NM_080792.2 | DR423079.1 | EST | 1 |
| 1078 | 7168.003.1-T_at | −0.58216 | 0.58215776 | 6.867577 | 4E-10 | 7168.003. | NM_001018020. | AK092051.1 | mRNA | 25 |
| 1079 | 79608.001.1-F_at | −0.58215 | 0.58214776 | 6.867399 | 4E-10 | 79608.001 | NM_024557.2 | CQ739424.1 | GENBANK_PATENT | 1 |
| 1080 | 79608.008.2-F_at | −0.58205 | 0.58205249 | 6.865699 | 4E-10 | 79608.008 | NM_024557.2 | DA748988.1 | EST | 2 |
| 1081 | 1410.001.1-B_at | −0.58186 | 0.58185842 | 6.862238 | 4E-10 | 1410.001. | NM_001885.1 | W40377.1 | EST | 1 |
| 1082 | 7113.010.1-T_at | −0.5816 | 0.5816021 | 6.857669 | 4E-10 | 7113.010. | NM_005656.2 | DA460061.1 | EST | 1 |
| 1083 | 4781.014.2-B_at | −0.5816 | 0.58160201 | 6.857667 | 4E-10 | 4781.014. | NM_005596.1 | DN918235.1 | EST | 1 |
| 1084 | 2335.016.1-E_at | 0.581544 | 0.58154398 | 6.856633 | 4E-10 | 2335.016. | NM_212482.1 | CQ875357.1 | GENBANK_PATENT | 281 |
| 1085 | 11065.003.1-F_at | 0.581391 | 0.58139079 | 6.853905 | 4E-10 | 11065.003 | NM_181802.1 | CS138819.1 | GENBANK_PATENT | 5 |
| 1086 | 3872.006.1-T_at | −0.58132 | 0.58131729 | 6.852596 | 4E-10 | 3872.006. | NM_000422.1 | BM017443.1 | EST | 1 |
| 1087 | 3084.005.1-F_at | −0.58129 | 0.58128817 | 6.852078 | 4E-10 | 3084.005. | NM_013957.1 | NM_013960.1 | REFSEQ | 2 |
| 1088 | 6285.003.1-E_at | −0.5812 | 0.58120469 | 6.850591 | 4E-10 | 6285.003. | NM_006272.1 | BG765453.1 | EST | 2 |
| 1089 | 6876.016.2-F_at | −0.58101 | 0.58100573 | 6.847051 | 4E-10 | 6876.016. | NM_001001522. | AB209555.1 | EST | 2 |
| 1090 | 8404.004.1-T_at | −0.58099 | 0.58098676 | 6.846714 | 4E-10 | 8404.004. | NM_004684.2 | DA589023.1 | EST | 1 |
| 1091 | 54829.001.1-F_at | 0.580792 | 0.58079186 | 6.843247 | 4E-10 | 54829.001 | NM_017680.3 | AK027359.1 | mRNA | 4 |
| 1092 | 8404.001.1-T_at | 0.58046 | 0.58046456 | 6.83743 | 4E-10 | 8404.001. | NM_004684.2 | DA132781.1 | EST | 1 |
| 1093 | 9055.011.1-E_at | 0.580443 | 0.58044278 | 6.837043 | 4E-10 | 9055.011. | NM_003681.1 | CX868839.1 | EST | 1 |
| 1094 | 6289.003.2-F_at | −0.58043 | 0.58043238 | 6.836859 | 4E-10 | 6289.003. | NM_030754.2 | R835510.1 | EST | 1 |
| 1095 | 22974.007.1-T_at | 0.580276 | 0.5802757 | 6.834076 | 4E-10 | 22974.007 | NM_122112.4 | AF287265.1 | mRNA | 213 |
| 1096 | 59.023.2-T_at | 0.58018 | 0.58017715 | 6.832326 | 4E-10 | 59.023.2 | NM_001613.1 | DB248573.1 | EST | 1 |
| 1097 | 7169.015.1-T_at | 0.58013 | 0.58013361 | 6.831554 | 4E-10 | 7169.015. | NM_213674.1 | DB291177.1 | EST | 1 |
| 1098 | 6289.002.1-F_at | −0.58009 | 0.58008892 | 6.83076 | 4E-10 | 6289.002. | NM_030754.2 | AA345111.1 | EST | 1 |
| 1099 | 4288.008.1-B_at | 0.580029 | 0.58002917 | 6.8297 | 4E-10 | 4288.008. | NM_002417.2 | BP235232.1 | EST | 1 |
| 1100 | 4781.007.1-B_at | −0.5799 | 0.57989557 | 6.82733 | 5E-10 | 4781.007. | NM_005596.1 | BP350370.1 | EST | 1 |
| 1101 | 6876.023.1-T_at | −0.57988 | 0.57988374 | 6.82712 | 5E-10 | 6876.023. | NM_001001522. | CN482091.1 | EST | 1 |
| 1102 | 9055.017.1-F_at | 0.579678 | 0.57967782 | 6.823468 | 5E-10 | 9055.017. | NM_003981.2 | DB031145.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 1103 | 7170.018.2-D_at | 0.579645 | 0.5796446 | 6.822879 | 5E-10 | 7170.018. | NM_153649.2 | DB037267.1 | EST | 1 |
| 1104 | 4781.014.2-D_at | -0.57948 | 0.57948256 | 6.820008 | 5E-10 | 4781.014. | NM_005596.1 | DN918235.1 | EST | 1 |
| 1105 | 7170.025.1-T_at | -0.579385 | 0.5793851 | 6.818281 | 5E-10 | 7170.025. | NM_153649.2 | BE208737.1 | EST | 1 |
| 1106 | 7018.025.1-B_at | -0.57934 | 0.57934031 | 6.817488 | 5E-10 | 7018.025. | NM_001063.2 | BE971065.1 | EST | 1 |
| 1107 | 10253.003.1-T_at | -0.57928 | 0.5792786 | 6.816395 | 5E-10 | 10253.003 | NM_005842.2 | DA345721.1 | EST | 1 |
| 1108 | 57447.039.1-D_at | -0.57924 | 0.57923531 | 6.815628 | 5E-10 | 57447.039 | NM_201535.1 | DA356658.1 | EST | 1 |
| 1109 | 59.022.1-T_at | -0.5792 | 0.57920027 | 6.815007 | 5E-10 | 59.022.1 | NM_001613.1 | BQ881176.1 | EST | 6 |
| 1110 | 2982.015.1-F_at | -0.57917 | 0.57917337 | 6.814531 | 5E-10 | 2982.015. | NM_000856.2 | CB049566.1 | EST | 1 |
| 1111 | 10124.004.2-F_at | -0.57893 | 0.57892871 | 6.810201 | 5E-10 | 10124.004 | NM_001037164. | BU661374.1 | EST | 12 |
| 1112 | 6289.001.1-B_at | -0.57871 | 0.57871022 | 6.806336 | 5E-10 | 6289.001. | NM_030754.2 | CR744712.1 | EST | 1 |
| 1113 | 7091.005.1-F_at | -0.57865 | 0.57864807 | 6.805237 | 5E-10 | 7091.005. | NM_007005.3 | BC059405.1 | mRNA | 1 |
| 1114 | 501.006.1-B_at | -0.57847 | 0.57847445 | 6.802168 | 5E-10 | 501.006.1 | NM_001182.2 | AI142140.1 | EST | 1 |
| 1115 | 1410.001.1-C_at | -0.57836 | 0.57835697 | 6.800092 | 5E-10 | 1410.001. | NM_001885.1 | W40377.1 | EST | 1 |
| 1116 | 57447.021.1-C_at | -0.57826 | 0.57825824 | 6.798348 | 5E-10 | 57447.021 | NM_201535.1 | BQ954948.1 | EST | 28 |
| 1117 | 244.012.1-B_at | -0.57821 | 0.57821349 | 6.797558 | 5E-10 | 244.012.1 | NM_001630.1 | DA445163.1 | EST | 1 |
| 1118 | 7018.026.1-F_at | -0.57794 | 0.57793533 | 6.792647 | 5E-10 | 7018.026. | NM_001063.2 | BM690655.1 | EST | 1 |
| 1119 | 3872.018.1-T_at | -0.57791 | 0.57790767 | 6.792159 | 5E-10 | 3872.018. | NM_000422.1 | BP226405.1 | EST | 1 |
| 1120 | 10144.017.3-T_at | -0.57781 | 0.57781025 | 6.79044 | 5E-10 | 10144.017 | NM_014883.2 | AX747234.1 | GENBANK_PATENT | 1 |
| 1121 | 11197.001.1-F_at | -0.57764 | 0.57763981 | 6.787434 | 5E-10 | 11197.001 | NM_007191.2 | W37154.1 | EST | 1 |
| 1122 | 29127.007.1-B_at | -0.577519 | 0.57751875 | 6.785299 | 6E-10 | 29127.007 | NM_013277.2 | DA362566.1 | EST | 1 |
| 1123 | 10010.004.1-F_at | -0.57745 | 0.57744716 | 6.784037 | 6E-10 | 10010.004 | NM_004180.2 | BM750784.1 | EST | 1 |
| 1124 | 81704.013.1-C_at | -0.57744 | 0.57744059 | 6.783922 | 6E-10 | 81704.013 | NM_203447.1 | CQ723361.1 | GENBANK_PATENT | 1 |
| 1125 | 4781.006.2-B_at | -0.57742 | 0.57742143 | 6.783584 | 6E-10 | 4781.006. | NM_005596.1 | AK131233.1 | mRNA | 2 |
| 1126 | 7373.003.1-F_at | -0.57736 | 0.57736415 | 6.782575 | 6E-10 | 7373.003. | NM_021110.1 | CQ716670.1 | GENBANK_PATENT | 1 |
| 1127 | 8404.009.1-D_at | -0.57736 | 0.57735822 | 6.78247 | 6E-10 | 8404.009. | NM_004684.2 | BP258993.1 | EST | 1 |
| 1128 | 23092.004.1-D_at | -0.57727 | 0.5772653 | 6.780833 | 6E-10 | 23092.004 | NM_015071.2 | DA211853.1 | EST | 1 |
| 1129 | 2335.002.1-F_at | 0.577229 | 0.57722889 | 6.780192 | 6E-10 | 2335.002. | NM_212482.1 | AU118498.1 | EST | 26 |
| 1130 | 8404.031.1-F_at | -0.5772 | 0.57720205 | 6.779719 | 6E-10 | 8404.031. | NM_004684.2 | BP327616.1 | EST | 1 |
| 1131 | 6304.006.2-T_at | -0.57715 | 0.57714631 | 6.778737 | 6E-10 | 6304.006. | NM_002971.2 | BI462843.1 | EST | 1 |
| 1132 | 1410.008.1-F_at | -0.57711 | 0.57710598 | 6.778027 | 6E-10 | 1410.008. | NM_001885.1 | R68496.1 | EST | 1 |
| 1133 | 9055.019.1-F_at | -0.57707 | 0.57707199 | 6.777428 | 6E-10 | 9055.019. | NM_003981.2 | AL079833.1 | EST | 1 |
| 1134 | 1398.001.1-D_at | -0.5772 | 0.577042 | 6.7769 | 6E-10 | 1398.001. | NM_016823.2 | BE898353.1 | EST | 1 |
| 1135 | 57447.051.1-E_at | -0.57704 | 0.57703991 | 6.776863 | 6E-10 | 57447.051 | NM_201535.1 | BX460053.2 | EST | 5 |
| 1136 | 339965.001.2-B | -0.57702 | 0.57701808 | 6.776479 | 6E-10 | 339965.00 | NM_178555.2 | BC086869.1 | mRNA | 1 |
| 1137 | 7113.001.1-C_at | -0.57697 | 0.57697321 | 6.775689 | 6E-10 | 7113.001. | NM_005656.2 | CQ976407.1 | GENBANK_PATENT | 2 |
| 1138 | 4240.009.1-D_at | -0.57692 | 0.57692271 | 6.7748 | 6E-10 | 4240.009. | NM_005928.1 | BG829936.1 | EST | 114 |
| 1139 | 7153.002.4-B_at | -0.576735 | 0.57673523 | 6.771501 | 6E-10 | 7153.002. | NM_001067.2 | CQ735949.1 | GENBANK_PATENT | 1 |
| 1140 | 7169.004.1-D_at | -0.57658 | 0.57658017 | 6.768774 | 6E-10 | 7169.004. | NM_213674.1 | BG027526.1 | EST | 1 |
| 1141 | 1410.001.1-D_at | -0.57648 | 0.57647869 | 6.766989 | 6E-10 | 1410.001. | NM_001885.1 | W40377.1 | EST | 1 |
| 1142 | 59.015.2-B_at | -0.57634 | 0.57634377 | 6.764618 | 6E-10 | 59.015.2 | NM_001613.1 | BP372009.1 | EST | 1 |
| 1143 | 4833.010.1-T_at | 0.576197 | 0.57619729 | 6.762044 | 6E-10 | 4833.010. | NM_005009.2 | BU532120.1 | EST | 1 |
| 1144 | 7169.022.1-B_at | -0.57611 | 0.57611084 | 6.760525 | 6E-10 | 7169.022. | NM_213674.1 | BG385598.1 | EST | 1 |
| 1145 | 11065.005.1-T_at | 0.576067 | 0.57606684 | 6.759752 | 6E-10 | 11065.005 | NM_181802.1 | CS138820.1 | GENBANK_PATENT | 2 |
| 1146 | 7170.018.2-T_at | -0.575994 | 0.57599361 | 6.758466 | 6E-10 | 7170.018. | NM_153649.2 | DB037267.1 | EST | 1 |
| 1147 | 79971.013.2-F_at | -0.57599 | 0.57598932 | 6.758391 | 6E-10 | 79971.013 | NM_001002292. | DA878291.1 | EST | 1 |
| 1148 | 152015.005.2-F | -0.5759 | 0.57589713 | 6.756772 | 6E-10 | 152015.00 | NM_001012337. | CQ732372.1 | GENBANK_PATENT | 1 |
| 1149 | 4288.005.1-D_at | 0.577849 | 0.57584855 | 6.75592 | 6E-10 | 4288.005. | NM_002417.2 | BM455229.1 | EST | 1 |
| 1150 | 8404.002.1-T_at | -0.57584 | 0.57584028 | 6.755774 | 6E-10 | 8404.002. | NM_004684.2 | BP383384.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 1151 | 6441.004.1-E_at | −0.57578 | 0.5757767 | 6.754659 | 6E−10 | 6441.004. | NM_003019.4 | BG542824.1 | EST | 1 |
| 1152 | 6122.046.1-B_at | −0.57577 | 0.57577128 | 6.754563 | 6E−10 | 6122.046. | NM_000967.3 | BM019962.1 | EST | 1 |
| 1153 | 115908.002.1-T | 0.575641 | 0.57564097 | 6.752277 | 6E−10 | 115908.00 | NM_138455.2 | AF395488.1 | mRNA | 1 |
| 1154 | 9481.001.1-F_at | −0.57564 | 0.5756408 | 6.752274 | 6E−10 | 9481.001. | NM_004277.2 | BC033091.1 | mRNA | 2 |
| 1155 | 8404.008.1-T_at | −0.57561 | 0.57561259 | 6.751779 | 6E−10 | 8404.008. | NM_004684.2 | DA342341.1 | EST | 1 |
| 1156 | 1410.007.1-D_at | −0.57559 | 0.57559279 | 6.751432 | 6E−10 | 1410.007. | NM_001885.1 | BI548180.1 | EST | 1 |
| 1157 | 8404.030.1-C_at | −0.57555 | 0.57554678 | 6.750625 | 6E−10 | 8404.030. | NM_004684.2 | CD357736.1 | EST | 1 |
| 1158 | 57447.039.1-T_at | −0.57552 | 0.57551972 | 6.75015 | 6E−10 | 57447.039 | NM_201535.1 | DA356658.1 | EST | 1 |
| 1159 | 4147.004.1-E_at | −0.57546 | 0.57545554 | 6.749025 | 7E−10 | 4147.004. | NM_002380.3 | AX675291.1 | GENBANK_PATENT | 1 |
| 1160 | 2335.024.2-F_at | 0.575372 | 0.57537228 | 6.747565 | 7E−10 | 2335.024. | NM_212482.1 | CQ731573.1 | GENBANK_PATENT | 1 |
| 1161 | 891.007.1-F_at | 0.575369 | 0.57536931 | 6.747513 | 7E−10 | 891.007.1 | NM_031966.2 | BT020128.1 | mRNA | 1 |
| 1162 | 2335.002.1-T_at | 0.575308 | 0.57530785 | 6.746436 | 7E−10 | 2335.002. | NM_212482.1 | AU118498.1 | EST | 26 |
| 1163 | 8404.017.1-T_at | −0.57528 | 0.5752762 | 6.745881 | 7E−10 | 8404.017. | NM_004684.2 | CD001002.1 | EST | 1 |
| 1164 | 57451.004.1-B_at | −0.57522 | 0.57521923 | 6.744883 | 7E−10 | 57451.004 | XM_931456.1 | AK056053.1 | mRNA | 5 |
| 1165 | 8404.001.1-F_at | −0.57518 | 0.57517525 | 6.744112 | 7E−10 | 8404.001. | NM_004684.2 | DA132781.1 | EST | 1 |
| 1166 | 8626.006.2-B_at | −0.57508 | 0.57507892 | 6.742424 | 7E−10 | 8626.006. | NM_003722.3 | CB049427.1 | EST | 1 |
| 1167 | 2335.025.1-T_at | 0.575019 | 0.5750189 | 6.741373 | 7E−10 | 2335.025. | NM_212482.1 | CQ715726.1 | GENBANK_PATENT | 3 |
| 1168 | 6286.001.1-T_at | 0.574986 | 0.57498586 | 6.740794 | 7E−10 | 6286.001. | NM_005980.2 | BM850288.1 | EST | 1 |
| 1169 | 10580.012.1-C_at | 0.57498 | 0.57497814 | 6.740659 | 7E−10 | 10580.012 | NM_015385.2 | AX879149.1 | GENBANK_PATENT | 1 |
| 1170 | 23321.014.1-T_at | 0.57485 | 0.57484627 | 6.73835 | 7E−10 | 23321.014 | NM_015271.2 | CQ723480.1 | GENBANK_PATENT | 1 |
| 1171 | 2824.001.2-B_at | 0.57481 | 0.57480725 | 6.737667 | 7E−10 | 2824.001. | NM_001001994. | CQ717842.1 | GENBANK_PATENT | 1 |
| 1172 | 29127.022.1-T_at | 0.574796 | 0.57479644 | 6.737478 | 7E−10 | 29127.022 | NM_013277.2 | DB065206.1 | EST | 1 |
| 1173 | 6289.003.1-F_at | 0.57455 | 0.57455392 | 6.733234 | 7E−10 | 6289.003. | NM_030754.2 | R83510.1 | EST | 1 |
| 1174 | 7170.005.2-B_at | 0.574471 | 0.57447114 | 6.731785 | 7E−10 | 7170.005. | NM_153649.2 | DA762962.1 | EST | 1 |
| 1175 | 54443.011.1-F_at | 0.574461 | 0.57446085 | 6.731605 | 7E−10 | 54443.011 | NM_018685.2 | DA244113.1 | EST | 1 |
| 1176 | 29127.019.1-T_at | 0.574322 | 0.57432168 | 6.729172 | 7E−10 | 29127.019 | NM_013277.2 | DA779708.1 | EST | 1 |
| 1177 | 6288.004.1-T_at | 0.57432 | 0.57432014 | 6.729145 | 7E−10 | 6288.004. | NM_199161.1 | BG567754.1 | EST | 3 |
| 1178 | 29997.008.1-C_at | 0.57411 | 0.57411065 | 6.725483 | 7E−10 | 29997.008 | NM_015710.3 | BI871613.1 | EST | 1 |
| 1179 | 57447.039.1-B_at | −0.57407 | 0.57406597 | 6.724703 | 7E−10 | 57447.039 | NM_201535.1 | DA356658.1 | EST | 1 |
| 1180 | 3872.007.1-B_at | −0.57388 | 0.573875 | 6.721367 | 7E−10 | 3872.007. | NM_000422.1 | BU155457.1 | EST | 1 |
| 1181 | 57561.002.1-T_at | −0.57383 | 0.57383005 | 6.720582 | 7E−10 | 57561.002 | NM_020801.1 | DB094913.1 | EST | 1 |
| 1182 | 57451.002.3-B_at | 0.57383 | 0.57382775 | 6.720542 | 7E−10 | 57451.002 | XM_931456.1 | AX133821.1 | GENBANK_PATENT | 1 |
| 1183 | 5213.024.1-B_at | −0.57376 | 0.57376229 | 6.719399 | 7E−10 | 5213.024. | NM_000289.3 | CQ723196.1 | GENBANK_PATENT | 1 |
| 1184 | 2.005.1-T_at | −0.57371 | 0.57370601 | 6.718416 | 8E−10 | 2.005.1 | NM_000014.4 | BI493707.1 | EST | 1 |
| 1185 | 11065.004.1-C_at | 0.573605 | 0.57360463 | 6.716647 | 8E−10 | 11065.004 | NM_181803.1 | NM_181803.1 | REFSEQ | 3 |
| 1186 | 1410.006.1-C_at | −0.57357 | 0.57356845 | 6.716015 | 8E−10 | 1410.006. | NM_001885.1 | BF670917.1 | EST | 1 |
| 1187 | 6289.006.1-T_at | −0.57356 | 0.5735557 | 6.715793 | 8E−10 | 6289.006. | NM_030754.2 | BG618255.1 | EST | 3 |
| 1188 | 55366.001.1-T_at | −0.57354 | 0.57353923 | 6.715506 | 8E−10 | 55366.001 | NM_018490.1 | CQ722924.1 | GENBANK_PATENT | 1 |
| 1189 | 23284.007.1-F_at | −0.57343 | 0.57342883 | 6.71358 | 8E−10 | 23284.007 | NM_015236.3 | CX868514.1 | EST | 1 |
| 1190 | 79971.009.1-T_at | −0.57327 | 0.573273 | 6.710862 | 8E−10 | 79971.009 | NM_001002292. | DA264864.1 | EST | 3 |
| 1191 | 6288.004.1-E_at | 0.57316 | 0.57316396 | 6.708961 | 8E−10 | 6288.004. | NM_199161.1 | BG567754.1 | EST | 3 |
| 1192 | 11065.004.1-T_at | 0.573162 | 0.57316172 | 6.708922 | 8E−10 | 11065.004 | NM_181802.1 | NM_181803.1 | REFSEQ | 3 |
| 1193 | 51203.009.1-T_at | −0.57286 | 0.57286422 | 6.703738 | 8E−10 | 51203.009 | NM_016359.2 | AV714397.1 | EST | 1 |
| 1194 | 1410.010.1-E_at | −0.57282 | 0.57282236 | 6.703009 | 8E−10 | 1410.010. | NM_001885.1 | AJ710474.1 | EST | 2 |
| 1195 | 57447.030.1-D_at | −0.57277 | 0.57277435 | 6.702173 | 8E−10 | 57447.030 | NM_201535.1 | BM783465.1 | EST | 5 |
| 1196 | 1308.002.1-T_at | −0.57253 | 0.57252742 | 6.697874 | 8E−10 | 1308.002. | NM_130778.1 | BX117940.1 | EST | 2 |
| 1197 | 4288.007.1-C_at | 0.572423 | 0.57242333 | 6.696062 | 8E−10 | 4288.007. | NM_002417.2 | BE840921.1 | EST | 1 |
| 1198 | 244.011.1-T_at | −0.5724 | 0.57240479 | 6.69574 | 8E−10 | 244.011.1 | NM_001630.1 | BX399166.2 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 1199 | 94274.003.1-B_at | −0.57238 | 0.57238283 | 6.695358 | 8E-10 | 94274.003 | NM_033256.1 | AB056509.1 | mRNA | 1 |
| 1200 | 3178.003.1-E_at | −0.57235 | 0.5723545 | 6.694865 | 8E-10 | 3178.003. | NM_031157.2 | DA761057.1 | EST | 1 |
| 1201 | 7153.002.4-T_at | 0.572294 | 0.57229362 | 6.693806 | 8E-10 | 7153.002. | NM_001067.2 | CQ735949.1 | GENBANK_PATENT | 114 |
| 1202 | 9055.012.1-D_at | 0.57223 | 0.57222967 | 6.692694 | 8E-10 | 9055.012. | NM_003981.2 | BE298728.1 | EST | 1 |
| 1203 | 9232.001.1-F_at | 0.572158 | 0.57215824 | 6.691452 | 8E-10 | 9232.001. | NM_004219.2 | CN285866.1 | EST | 1 |
| 1204 | 79068.011.2-B_at | −0.57201 | 0.57200741 | 6.68883 | 9E-10 | 79068.011 | XM_051200.8 | CQ733443.1 | GENBANK_PATENT | 1 |
| 1205 | 120.005.2-F_at | −0.57195 | 0.57194991 | 6.687831 | 9E-10 | 120.005.2 | NM_019903.3 | AK223270.1 | mRNA | 78 |
| 1206 | 7534.001.1-C_at | −0.571947 | 0.57194717 | 6.687783 | 9E-10 | 7534.001. | NM_003406.2 | CB051503.1 | EST | 1 |
| 1207 | 120.005.2-T_at | −0.57189 | 0.57188711 | 6.686739 | 9E-10 | 120.005.2 | NM_019903.3 | AK223270.1 | mRNA | 78 |
| 1208 | 7373.003.3-C_at | −0.57177 | 0.57177348 | 6.684765 | 9E-10 | 7373.003. | NM_021170.1 | CQ716670.1 | GENBANK_PATENT | 1 |
| 1209 | 57447.004.2-D_at | −0.57171 | 0.57171371 | 6.683727 | 9E-10 | 57447.004 | NM_201535.1 | CD515320.1 | EST | 2 |
| 1210 | 2568.005.1-F_at | −0.57162 | 0.57161693 | 6.682047 | 9E-10 | 2568.005. | NM_014211.1 | AK055205.1 | mRNA | 11 |
| 1211 | 1308.001.1-E_at | −0.57152 | 0.5715167 | 6.680307 | 9E-10 | 1308.001. | NM_130778.1 | BM773425.1 | EST | 1 |
| 1212 | 6876.020.1-F_at | −0.57133 | 0.5713288 | 6.677046 | 9E-10 | 6876.020. | NM_001001522. | BM921237.1 | EST | 1 |
| 1213 | 79971.014.1-D_at | −0.57124 | 0.57124451 | 6.675583 | 9E-10 | 79971.014 | NM_001002292. | DA776805.1 | EST | 1 |
| 1214 | 5621.008.1-D_at | −0.57121 | 0.57120843 | 6.674957 | 9E-10 | 5621.008. | NM_000311.2 | DA648110.1 | EST | 1 |
| 1215 | 55732.003.2-T_at | 0.571055 | 0.57105463 | 6.67229 | 9E-10 | 55732.003 | NM_018186.2 | DA733233.1 | EST | 2 |
| 1216 | 221120.006.1-D | −0.57094 | 0.57093826 | 6.670273 | 9E-10 | 221120.00 | NM_139178.1 | BE892721.1 | EST | 1 |
| 1217 | 23266.008.1-T_at | −0.57077 | 0.57076776 | 6.667318 | 9E-10 | 23266.008 | NM_012302.2 | CQ799210.1 | GENBANK_PATENT | 1 |
| 1218 | 2335.045.1-F_at | 0.570754 | 0.57075398 | 6.66708 | 1E-09 | 2335.045. | NM_212482.1 | DA989523.1 | EST | 1 |
| 1219 | 7170.007.1-F_at | 0.570733 | 0.57073264 | 6.66671 | 1E-09 | 7170.007. | NM_153649.2 | DA684242.1 | EST | 1 |
| 1220 | 10461.002.1-B_at | −0.57071 | 0.57071065 | 6.666329 | 1E-09 | 10461.002 | NM_006343.2 | CQ725500.1 | GENBANK_PATENT | 1 |
| 1221 | 59.031.2-F_at | −0.57071 | 0.57070847 | 6.666291 | 1E-09 | 59.031.2 | NM_001613.2 | BG197213.1 | EST | 19 |
| 1222 | 9055.010.1-T_at | 0.570674 | 0.5706743 | 6.665699 | 1E-09 | 9055.010. | NM_003981.2 | BU164001.1 | EST | 1 |
| 1223 | 58499.005.2-F_at | 0.5706 | 0.5706034 | 6.664471 | 1E-09 | 58499.005 | NM_021224.3 | BI461756.1 | EST | 1 |
| 1224 | 54443.006.2-F_at | 0.570459 | 0.57045888 | 6.661969 | 1E-09 | 54443.006 | NM_018685.2 | CQ716589.1 | GENBANK_PATENT | 1 |
| 1225 | 59.016.1-B_at | −0.57036 | 0.57035643 | 6.660196 | 1E-09 | 59.016.1 | — | — | — | |
| 1226 | 4288.004.1-C_at | 0.570301 | 0.5703013 | 6.659241 | 1E-09 | 4288.004. | NM_002417.2 | BP232141.1 | EST | 1 |
| 1227 | 7170.014.1-C_at | 0.570269 | 0.57026859 | 6.658675 | 1E-09 | 7170.014. | NM_153649.2 | DA690776.1 | EST | 1 |
| 1228 | 7170.007.1-D_at | 0.570241 | 0.57024107 | 6.658199 | 1E-09 | 7170.007. | NM_153649.2 | DA684242.1 | EST | 1 |
| 1229 | 244.004.2-B_at | 0.56972 | 0.56971798 | 6.649154 | 1E-09 | 244.004.2 | NM_001630.1 | CB115047.1 | EST | 1 |
| 1230 | 59.015.2-D_at | 0.56961 | 0.56961045 | 6.647297 | 1E-09 | 59.015.2 | NM_001613.1 | BP372009.1 | EST | 1 |
| 1231 | 2327.002.1-B_at | −0.56956 | 0.56955941 | 6.646415 | 1E-09 | 2327.002. | NM_001460.2 | CD684429.1 | EST | 1 |
| 1232 | 79068.011.2-C_at | −0.56954 | 0.5695389 | 6.646061 | 1E-09 | 79068.011 | XM_051200.8 | CQ733443.1 | GENBANK_PATENT | 1 |
| 1233 | 23266.006.1-T_at | −0.56936 | 0.56936191 | 6.643005 | 1E-09 | 23266.006 | NM_012302.2 | DR005890.1 | EST | 1 |
| 1234 | 4288.007.1-B_at | 0.56932 | 0.56931985 | 6.642278 | 1E-09 | 4288.007. | NM_002417.2 | BE840921.1 | EST | 1 |
| 1235 | 301.008.1-T_at | 0.5693 | 0.56929536 | 6.641856 | 1E-09 | 301.008.1 | NM_000700.1 | CD68703.1 | EST | 1 |
| 1236 | 5156.003.1-T_at | 0.56918 | 0.56918229 | 6.639904 | 1E-09 | 5156.003. | NM_006206.3 | BP321319.1 | EST | 1 |
| 1237 | 4781.001.1-F_at | 0.56917 | 0.56917015 | 6.639695 | 1E-09 | 4781.001. | NM_005596.1 | BF541662.1 | EST | 1 |
| 1238 | 4281.016.1-E_at | 0.56916 | 0.56915511 | 6.639435 | 1E-09 | 4281.016. | NM_033290.1 | AY540010.1 | mRNA | 1 |
| 1239 | 72.004.1-T_at | 0.5691 | 0.56910279 | 6.638533 | 1E-09 | 72.004.1 | NM_001615.3 | BF680547.1 | EST | 1 |
| 1240 | 57447.029.1-B_at | −0.56896 | 0.56895732 | 6.636023 | 1E-09 | 57447.029 | NM_201535.1 | BX354120.2 | EST | 6 |
| 1241 | 79971.006.2-T_at | −0.56871 | 0.56870809 | 6.631726 | 1E-09 | 79971.006 | NM_001002292. | DA048370.1 | EST | 1 |
| 1242 | 2327.003.2-F_at | −0.56867 | 0.56866928 | 6.631058 | 1E-09 | 2327.003. | NM_001460.2 | AI223310.1 | EST | 1 |
| 1243 | 166824.001.2-F | −0.56859 | 0.56858745 | 6.629647 | 1E-09 | 166824.00 | NM_201431.1 | CQ492114.1 | GENBANK_PATENT | 4 |
| 1244 | 29997.010.1-F_at | −0.56857 | 0.56856635 | 6.629284 | 1E-09 | 29997.010 | NM_015710.3 | BG120545.1 | EST | 1 |
| 1245 | 57447.024.1-C_at | −0.56853 | 0.56852805 | 6.628624 | 1E-09 | 57447.024 | NM_201535.1 | DA566498.1 | EST | 1 |
| 1246 | 4781.007.1-F_at | −0.56839 | 0.56838621 | 6.626181 | 1E-09 | 4781.007. | NM_005596.1 | BP350370.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 1247 | 4306.001.1-C_at | −0.5682 | 0.56819649 | 6.622914 | 1E−09 | 4306.001. | NM_000901.1 | AJ315514.1 | mRNA | 5 |
| 1248 | 137682.002.2-T | 0.568182 | 0.56818211 | 6.622667 | 1E−09 | 137682.00 | NM_152416.1 | BX375940.2 | EST | 1 |
| 1249 | 24137.002.1-F_at | 0.568153 | 0.56815265 | 6.62216 | 1E−09 | 24137.002 | NM_012310.2 | BC050548.1 | mRNA | 1 |
| 1250 | 79971.006.1-T_at | −0.56815 | 0.5681458 | 6.622042 | 1E−09 | 79971.006 | NM_001002292. | DA048370.1 | EST | 3 |
| 1251 | 7168.004.1-F_at | −0.56797 | 0.56796804 | 6.618983 | 1E−09 | 7168.004. | NM_001018020. | BX438993.2 | EST | 1 |
| 1252 | 79068.011.1-T_at | −0.56789 | 0.56788757 | 6.617599 | 1E−09 | 79068.011 | XM_051200.8 | CQ733443.1 | GENBANK_PATENT | 1 |
| 1253 | 4781.009.1-T_at | −0.56772 | 0.56772333 | 6.614775 | 1E−09 | 4781.009. | NM_005596.1 | CQ732556.1 | GENBANK_PATENT | 1 |
| 1254 | 5608.003.1-T_at | −0.56753 | 0.56752894 | 6.611433 | 1E−09 | 5608.003. | NM_002758.2 | BP220368.1 | EST | 1 |
| 1255 | 9055.014.1-D_at | −0.56752 | 0.56752001 | 6.61128 | 1E−09 | 9055.014. | NM_003981.2 | BE300335.1 | EST | 1 |
| 1256 | 5156.009.1-F_at | −0.56751 | 0.56750707 | 6.611058 | 1E−09 | 5156.009. | NM_006206.3 | L25829.1 | mRNA | 3 |
| 1257 | 9055.018.2-F_at | 0.567502 | 0.56750204 | 6.610971 | 1E−09 | 9055.018. | NM_003981.2 | DA033856.1 | EST | 1 |
| 1258 | 92241.002.1-D_at | −0.5675 | 0.56749779 | 6.610898 | 1E−09 | 92241.002 | NM_052862.2 | CQ730679.1 | GENBANK_PATENT | 5 |
| 1259 | 5010.007.1-B_at | −0.56735 | 0.56734864 | 6.608336 | 1E−09 | 5010.007. | NM_005602.4 | BQ067107.1 | EST | 1 |
| 1260 | 25862.005.1-E_at | 0.567345 | 0.56734544 | 6.608281 | 1E−09 | 25862.005 | NM_212482.1 | AJ320525.1 | mRNA | 1 |
| 1261 | 7113.006.1-E_at | −0.56728 | 0.56728076 | 6.60717 | 1E−09 | 7113.006. | NM_005656.2 | DA874671.1 | EST | 1 |
| 1262 | 1756.024.1-B_at | −0.56726 | 0.5672562 | 6.606748 | 1E−09 | 1756.024. | NM_000109.2 | CD299688.1 | EST | 1 |
| 1263 | 79971.008.2-T_at | −0.56716 | 0.56716259 | 6.605141 | 1E−09 | 79971.008 | NM_001002292. | DA711278.1 | EST | 1 |
| 1264 | 7169.001.1-F_at | −0.56705 | 0.56704888 | 6.603189 | 1E−09 | 7169.001. | NM_213674.1 | BM809268.1 | EST | 4 |
| 1265 | 2.022.1-D_at | −0.56703 | 0.56702777 | 6.602826 | 1E−09 | 2.022.1 | NM_000014.4 | BP343424.1 | EST | 1 |
| 1266 | 6876.020.1-D_at | −0.56697 | 0.56697169 | 6.601864 | 1E−09 | 6876.020. | NM_001001522. | BM921237.1 | EST | 1 |
| 1267 | 301.011.1-T_at | −0.56692 | 0.56691975 | 6.600973 | 1E−09 | 301.011.1 | NM_000700.1 | BG435248.1 | EST | 5 |
| 1268 | 25862.005.1-E_at | −0.56682 | 0.5668213 | 6.599284 | 1E−09 | 25862.005 | NM_018561.3 | DR003626.1 | EST | 1 |
| 1269 | 7170.047.2-D_at | 0.566775 | 0.56677489 | 6.598488 | 1E−09 | 7170.047. | NM_153649.2 | BF693459.1 | EST | 1 |
| 1270 | 4281.0101.1-T_at | −0.56677 | 0.56677057 | 6.598413 | 1E−09 | 4281.010. | NM_033290.1 | AY540016.1 | mRNA | 5 |
| 1271 | 57447.020.1-T_at | −0.56666 | 0.56665556 | 6.596441 | 1E−09 | 57447.020 | NM_201535.1 | BX461883.2 | EST | 1 |
| 1272 | 7170.035.2-D_at | 0.566638 | 0.5666377 | 6.596136 | 1E−09 | 7170.035. | NM_153649.2 | BF575164.1 | EST | 1 |
| 1273 | 10124.005.1-T_at | −0.56646 | 0.56645955 | 6.593081 | 1E−09 | 10124.005 | NM_001037164. | BU661565.1 | EST | 1 |
| 1274 | 9055.018.1-C_at | 0.566425 | 0.56642488 | 6.592487 | 1E−09 | 9055.018. | NM_003981.2 | DA033856.1 | EST | 1 |
| 1275 | 59.038.1-T_at | −0.56631 | 0.5663098 | 6.590515 | 1E−09 | 59.038.1 | NM_001613.1 | EH_001613.2 | PREDICTED | 1 |
| 1276 | 4288.009.1-B_at | 0.566296 | 0.56629606 | 6.59028 | 1E−09 | 4288.009. | NM_002417.2 | BG106198.1 | EST | 1 |
| 1277 | 57561.004.1-E_at | −0.5662 | 0.56620405 | 6.588704 | 1E−09 | 57561.004 | NM_020801.1 | DB046772.1 | EST | 1 |
| 1278 | 2568.003.2-B_at | −0.56616 | 0.56615719 | 6.587901 | 1E−09 | 2568.003. | NM_014211.1 | CD696885.1 | EST | 1 |
| 1279 | 55713.004.1-T_at | −0.56607 | 0.56607498 | 6.586493 | 1E−09 | 55713.004 | NM_018102.3 | AL833936.1 | mRNA | 1 |
| 1280 | 2335.026.3-F_at | 0.565913 | 0.56591326 | 6.583725 | 1E−09 | 2335.026. | NM_212482.1 | BX641150.1 | mRNA | 43 |
| 1281 | 7168.010.1-C_at | −0.56585 | 0.56585375 | 6.582706 | 1E−09 | 7168.010. | NM_001018020. | CD556048.1 | EST | 1 |
| 1282 | 1959.002.1-T_at | −0.56583 | 0.56583226 | 6.582339 | 1E−09 | 1959.002. | NM_000399.2 | DB264199.1 | EST | 5 |
| 1283 | 259266.002.2-F | 0.565786 | 0.56578622 | 6.581551 | 1E−09 | 259266.00 | NM_018136.2 | CQ729660.1 | GENBANK_PATENT | 1 |
| 1284 | 57447.010.3-C_at | −0.56578 | 0.56578285 | 6.581493 | 1E−09 | 57447.010 | NM_201535.1 | BP349691.1 | EST | 1 |
| 1285 | 59.026.2-D_at | −0.56573 | 0.56573398 | 6.580657 | 1E−09 | 59.026.2 | — | — | — | |
| 1286 | 5156.002.1-B_at | −0.56572 | 0.56571946 | 6.580409 | 1E−09 | 5156.002. | NM_006206.3 | DB259428.1 | EST | 1 |
| 1287 | 10124.003.1-F_at | −0.56572 | 0.56571682 | 6.580364 | 1E−09 | 10124.003 | NM_001037164. | BU664973.1 | EST | 1 |
| 1288 | 4240.007.1-T_at | −0.56557 | 0.56556799 | 6.577818 | 1E−09 | 4240.007. | NM_005928.1 | CN485231.1 | EST | 1 |
| 1289 | 4931.007.1-F_at | 0.565418 | 0.56541793 | 6.575252 | 1E−09 | 4931.007. | NM_002533.2 | CQ731324.1 | GENBANK_PATENT | 1 |
| 1290 | 57447.039.1-C_at | −0.5653 | 0.56530385 | 6.573303 | 1E−09 | 57447.039 | NM_201535.1 | DA356658.1 | EST | 1 |
| 1291 | 57561.001.1-T_at | −0.56529 | 0.56529076 | 6.573079 | 1E−09 | 57561.001 | NM_020801.1 | BQ428339.1 | EST | 1 |
| 1292 | 57447.002.1-D_at | −0.56527 | 0.56526525 | 6.572643 | 1E−09 | 57447.002 | NM_201535.1 | BF526188.1 | EST | 1 |
| 1293 | 4094.001. | −0.56526 | 0.56525669 | 6.572497 | 1E−09 | 4094.001. | NM_001031804. | NM_005360.3 | REFSEQ | 17 |
| 1294 | 59.041.2-T_at | −0.56524 | 0.56524383 | 6.572277 | 1E−09 | 59.041.2 | NM_001613.1 | AL540709.3 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 1295 | 137682.004.2-T | 0.565172 | 0.56517245 | 6.571058 | 1E-09 | 137682.00 | NM_152416.1 | BI670491.1 | EST | 1 |
| 1296 | 4931.011.2-T_at | 0.565117 | 0.56511747 | 6.570118 | 1E-09 | 4931.011. | NM_002533.2 | BU170621.1 | EST | 1 |
| 1297 | 79971.010.2-T_at | -0.56505 | 0.56505357 | 6.569027 | 1E-09 | 79971.010 | NM_001002292. | CB368343.1 | EST | 1 |
| 1298 | 29127.009.1-T_at | 0.564971 | 0.56497093 | 6.567616 | 1E-09 | 29127.009 | NM_013277.2 | BX421176.2 | EST | 1 |
| 1299 | 2770.004.1-T_at | 0.56473 | 0.56473004 | 6.563504 | 2E-09 | 2770.004. | NM_002069.4 | DA801873.1 | EST | 1 |
| 1300 | 59.015.2-F_at | -0.56468 | 0.56468244 | 6.562692 | 2E-09 | 59.015.2 | NM_001613.1 | BP372009.1 | EST | 1 |
| 1301 | 2335.032.1-B_at | 0.564674 | 0.56467386 | 6.562545 | 2E-09 | 2335.032. | NM_212482.1 | DA647475.1 | EST | 1 |
| 1302 | 1410.006.1-B_at | -0.56446 | 0.56446046 | 6.558905 | 2E-09 | 1410.006. | NM_001885.1 | BF670917.1 | EST | 1 |
| 1303 | 79971.004.1-B_at | -0.56442 | 0.56442019 | 6.558218 | 2E-09 | 79971.004 | NM_001002292. | BX648748.1 | mRNA | 2 |
| 1304 | 94274.003.1-T_at | -0.56432 | 0.56432491 | 6.556594 | 2E-09 | 94274.003 | NM_033256.1 | AB056509.1 | mRNA | 1 |
| 1305 | 2335.005.1-T_at | 0.564117 | 0.5641167 | 6.553045 | 2E-09 | 2335.005. | NM_212482.1 | BX417388.2 | EST | 3 |
| 1306 | 966.004.2-B_at | -0.56412 | 0.56411646 | 6.553041 | 2E-09 | 966.004.2 | NM_203330.1 | AU117114.1 | EST | 1 |
| 1307 | 79780.006.1-B_at | -0.56406 | 0.5640582 | 6.552049 | 2E-09 | 79780.006 | NM_024725.2 | BG570666.1 | EST | 1 |
| 1308 | 57561.003.1-T_at | -0.56392 | 0.56392094 | 6.549711 | 2E-09 | 57561.003 | NM_020801.1 | DA797962.1 | EST | 1 |
| 1309 | 9073.002.1-B_at | 0.56389 | 0.56389001 | 6.549184 | 2E-09 | 9073.002. | NM_199328.1 | BP277133.1 | EST | 1 |
| 1310 | 55656.014.2-F_at | 0.56379 | 0.56378984 | 6.547479 | 2E-09 | 55656.014 | NM_017864.2 | BF770934.1 | EST | 1 |
| 1311 | 2335.035.1-B_at | 0.563724 | 0.56372399 | 6.546357 | 2E-09 | 2335.035. | NM_212482.1 | CX755647.1 | EST | 1 |
| 1312 | 3161.005.1-T_at | 0.563648 | 0.56364847 | 6.545072 | 2E-09 | 3161.005. | NM_012484.1 | AX675838.1 | GENBANK_PATENT | 1 |
| 1313 | 57451.006.1-B_at | -0.56362 | 0.56362219 | 6.544625 | 2E-09 | 57451.006 | XM_931456.1 | AL598057.1 | EST | 1 |
| 1314 | 2568.004.1-T_at | -0.56349 | 0.56348518 | 6.542294 | 2E-09 | 2568.004. | NM_014211.1 | BP342098.1 | EST | 1 |
| 1315 | 440073.003.1-E | -0.56329 | 0.56329195 | 6.539007 | 2E-09 | 440073.00 | NM_015232.1 | BX110676.1 | EST | 1 |
| 1316 | 2335.006.1-T_at | 0.563204 | 0.56320431 | 6.537517 | 2E-09 | 2335.006. | NM_212482.1 | CX785805.1 | EST | 1 |
| 1317 | 10051.011.2-T_at | 0.563182 | 0.56318212 | 6.53714 | 2E-09 | 10051.011 | NM_001002799, | BG776861.1 | EST | 4 |
| 1318 | 55784.003.1-T_at | -0.56304 | 0.56303549 | 6.534648 | 2E-09 | 55784.003 | NM_018349.2 | BC025708.1 | mRNA | 2 |
| 1319 | 3860.010.1-T_at | -0.56302 | 0.56302355 | 6.534445 | 2E-09 | 3860.010. | NM_153490.1 | DA441591.1 | EST | 1 |
| 1320 | 5284.001.1-B_at | -0.56297 | 0.56297106 | 6.533553 | 2E-09 | 5284.001. | NM_002644.2 | AX012182.1 | GENBANK_PATENT | 1 |
| 1321 | 301.003.1-T_at | -0.56291 | 0.56291408 | 6.532585 | 2E-09 | 301.003.1 | NM_000700.1 | CB124198.1 | EST | 1 |
| 1322 | 4240.007.1-F_at | -0.5629 | 0.56290348 | 6.532405 | 2E-09 | 4240.007. | NM_005928.1 | CN485231.1 | EST | 1 |
| 1323 | 4240.007.1-B_at | -0.56283 | 0.56283211 | 6.531193 | 2E-09 | 4240.007. | NM_005928.1 | CN485231.1 | EST | 1 |
| 1324 | 4781.015.2-D_at | -0.56272 | 0.56272205 | 6.529324 | 2E-09 | 4781.015. | NM_005596.1 | DN995118.1 | EST | 1 |
| 1325 | 10124.001.1-T_at | -0.56261 | 0.56260672 | 6.527366 | 2E-09 | 10124.001 | NM_001037164. | BX354322.2 | EST | 87 |
| 1326 | 57561.004.1-T_at | 0.56258 | 0.56258399 | 6.52698 | 2E-09 | 57561.004 | NM_020801.1 | DB046772.1 | EST | 1 |
| 1327 | 29127.022.2-T_at | 0.562515 | 0.56251532 | 6.525814 | 2E-09 | 29127.022 | NM_013277.2 | DB065206.1 | EST | 1 |
| 1328 | 10461.002.2-T_at | -0.56243 | 0.56242806 | 6.524333 | 2E-09 | 10461.002 | NM_006343.2 | CQ725500.1 | GENBANK_PATENT | 1 |
| 1329 | 7168.039.1-B_at | -0.56237 | 0.56236838 | 6.523321 | 2E-09 | 7168.039. | NM_001018020. | AA096317.1 | EST | 1 |
| 1330 | 90293.004.2-T_at | 0.56231 | 0.56231454 | 6.522407 | 2E-09 | 90293.004 | NM_033495.2 | AL591986.1 | mRNA | 38 |
| 1331 | 1410.006.1-D_at | -0.56207 | 0.56206646 | 6.518201 | 2E-09 | 1410.006. | NM_001885.1 | BF670917.1 | EST | 1 |
| 1332 | 7113.010.1-E_at | -0.56205 | 0.56205065 | 6.517933 | 2E-09 | 7113.010. | NM_005656.2 | DA460061.1 | EST | 1 |
| 1333 | 8404.025.1-T_at | -0.562 | 0.56200329 | 6.51713 | 2E-09 | 8404.025. | NM_004684.2 | DB086831.1 | EST | 1 |
| 1334 | 79971.008.1-T_at | 0.56198 | 0.56198359 | 6.516796 | 2E-09 | 79971.008 | NM_001002292. | DA711278.1 | EST | 1 |
| 1335 | 4240.005.1-T_at | 0.56194 | 0.5619438 | 6.516122 | 2E-09 | 4240.005. | NM_005928.1 | BX341151.2 | EST | 1 |
| 1336 | 10051.007.1-T_at | 0.561888 | 0.56188758 | 6.515169 | 2E-09 | 10051.007 | NM_001002799. | CS161896.1 | GENBANK_PATENT | 13 |
| 1337 | 2.002.1-F_at | -0.56186 | 0.56185527 | 6.51462 | 2E-09 | 2.002.1 | NM_000014.4 | CQ672194.1 | GENBANK_PATENT | 1 |
| 1338 | 29997.021.1-E_at | -0.56185 | 0.56185259 | 6.514576 | 2E-09 | 29997.021 | NM_015710.3 | CN353870.1 | EST | 1 |
| 1339 | 1410.011.1-T_at | -0.56169 | 0.56168682 | 6.511768 | 2E-09 | 1410.011. | NM_001885.1 | BI561839.1 | EST | 1 |
| 1340 | 4601.009.2-F_at | -0.56154 | 0.5615434 | 6.509339 | 2E-09 | 4601.009. | NM_130439.3 | BE789186.1 | EST | 1 |
| 1341 | 1959.001.1-T_at | -0.56154 | 0.56153623 | 6.509218 | 2E-09 | 1959.001. | NM_000399.2 | DB086600.1 | EST | 1 |
| 1342 | 2335.026.3-T_at | 0.561472 | 0.56147179 | 6.508127 | 2E-09 | 2335.026. | NM_212482.1 | BX641150.1 | mRNA | 43 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 1343 | 55107.001.1-F_at | -0.56145 | 0.56144879 | 6.507738 | 2E-09 | 55107.001 | NM_018043.4 | AY728143.1 | mRNA | 30 |
| 1344 | 1062.001.1-B_at | 0.561342 | 0.56134161 | 6.505924 | 2E-09 | 1062.001. | NM_001813.2 | CQ715352.1 | GENBANK_PATENT | 1 |
| 1345 | 6876.002.1-B_at | -0.56132 | 0.56132281 | 6.505606 | 2E-09 | 6876.002. | NM_001001522. | DB262921.1 | EST | 1 |
| 1346 | 358.018.1-D_at | -0.56116 | 0.56116002 | 6.502851 | 2E-09 | 358.018.1 | NM_198098.1 | BI765065.1 | EST | 1 |
| 1347 | 4781.004.1-F_at | -0.5611 | 0.56110421 | 6.501907 | 2E-09 | 4781.004. | NM_005596.1 | BG742798.1 | EST | 4 |
| 1348 | 8404.028.3-F_at | -0.56107 | 0.56107051 | 6.501338 | 2E-09 | 8404.028. | NM_004684.2 | CQ727530.1 | GENBANK_PATENT | 1 |
| 1349 | 11130.004.1-T_at | 0.561027 | 0.56102703 | 6.500602 | 2E-09 | 11130.004 | NM_001005414. | BQ065119.1 | EST | 1 |
| 1350 | 2568.002.2-B_at | 0.56101 | 0.56100825 | 6.500285 | 2E-09 | 2568.002. | NM_014211.1 | DB235581.1 | EST | 1 |
| 1351 | 29089.004.1-T_at | 0.560878 | 0.56087834 | 6.498089 | 2E-09 | 29089.004 | NM_014176.1 | AV727151.1 | EST | 1 |
| 1352 | 57685.005.1-B_at | -0.5608 | 0.56079992 | 6.496763 | 2E-09 | 57685.005 | NM_020925.1 | CQ721664.1 | GENBANK_PATENT | 1 |
| 1353 | 7170.016.3-T_at | 0.560753 | 0.56075324 | 6.495974 | 2E-09 | 7170.016. | NM_153649.2 | BF575596.1 | EST | 1 |
| 1354 | 10440.003.1-T_at | 0.560736 | 0.56073635 | 6.495689 | 2E-09 | 10440.003 | NM_066335.1 | BG449850.1 | EST | 1 |
| 1355 | 2335.017.1-F_at | 0.560696 | 0.56069643 | 6.495015 | 2E-09 | 2335.017. | NM_212482.1 | CQ896577.1 | GENBANK_PATENT | 4 |
| 1356 | 2.002.1-D_at | -0.56056 | 0.56056211 | 6.492745 | 2E-09 | 2.002.1 | NM_000014.4 | CQ672194.1 | GENBANK_PATENT | 1 |
| 1357 | 9055.018.1-D_at | 0.56056 | 0.56056001 | 6.49271 | 2E-09 | 9055.018. | NM_003981.2 | DA033856.1 | EST | 1 |
| 1358 | 64151.003.1-T_at | 0.56055 | 0.56055011 | 6.492543 | 2E-09 | 64151.003 | NM_022346.3 | BG202075.1 | EST | 1 |
| 1359 | 59342.002.1-B_at | 0.56049 | 0.56049557 | 6.491622 | 2E-09 | 59342.002 | NM_021626.1 | BP338281.1 | EST | 1 |
| 1360 | 7169.007.1-F_at | -0.56034 | 0.56033824 | 6.488965 | 2E-09 | 7169.007. | NM_213674.1 | BQ923578.1 | EST | 67 |
| 1361 | 7170.026.1-C_at | 0.560224 | 0.5602241 | 6.487039 | 2E-09 | 7170.026. | NM_153649.2 | BQ933569.1 | EST | 1 |
| 1362 | 667.010.1-B_at | -0.56012 | 0.56011837 | 6.485255 | 2E-09 | 667.010.1 | NM_183380.1 | DA361412.1 | EST | 1 |
| 1363 | 4781.010.1-F_at | -0.56006 | 0.56006097 | 6.484286 | 2E-09 | 4781.010. | NM_005596.1 | BX648845.1 | mRNA | 3 |
| 1364 | 10051.001.1-T_at | 0.560051 | 0.56005099 | 6.484118 | 2E-09 | 10051.001 | NM_001002799. | BC106033.1 | mRNA | 52 |
| 1365 | 7113.004.1-C_at | -0.56001 | 0.56001252 | 6.483469 | 2E-09 | 7113.004. | NM_005656.2 | CQ976405.1 | GENBANK_PATENT | 2 |
| 1366 | 140885.010.2-F | -0.55988 | 0.55988455 | 6.481311 | 2E-09 | 140885.01 | NM_080792.2 | CQ728313.1 | GENBANK_PATENT | 1 |
| 1367 | 29997.019.1-F_at | -0.55983 | 0.55982573 | 6.480319 | 2E-09 | 29997.019 | NM_015710.3 | BF771953.1 | EST | 1 |
| 1368 | 2335.013.1-T_at | -0.55975 | 0.55975189 | 6.479074 | 2E-09 | 2335.013. | NM_212482.1 | AL551632.3 | EST | 2 |
| 1369 | 7170.017.1-D_at | 0.55967 | 0.55967009 | 6.477696 | 2E-09 | 7170.017. | NM_153649.2 | BF574676.1 | EST | 1 |
| 1370 | 219972.004.1-F | -0.55958 | 0.55957847 | 6.476152 | 2E-09 | 219972.00 | XM_166227.6 | DA946058.1 | EST | 1 |
| 1371 | 22974.010.1-E_at | 0.559421 | 0.55942061 | 6.473493 | 2E-09 | 22974.010 | NM_012112.4 | DB096591.1 | EST | 1 |
| 1372 | 2982.011.1-T_at | -0.55932 | 0.55932229 | 6.471837 | 2E-09 | 2982.011. | NM_000856.2 | BX649180.1 | mRNA | 10 |
| 1373 | 152015.005.1-F | -0.55929 | 0.55929021 | 6.471297 | 2E-09 | 152015.00 | NM_001012337. | CQ732372.1 | GENBANK_PATENT | 1 |
| 1374 | 3914.001.1-C_at | -0.5592 | 0.55919902 | 6.469761 | 2E-09 | 3914.001. | NM_000228.2 | CQ921791.1 | GENBANK_PATENT | 2 |
| 1375 | 7168.012.2-B_at | -0.55912 | 0.55911961 | 6.468425 | 2E-09 | 7168.012. | NM_001018020. | AK129882.1 | mRNA | 2 |
| 1376 | 1938.024.1-C_at | -0.55904 | 0.55903817 | 6.467054 | 2E-09 | 1938.024. | NM_001961.3 | BE747136.1 | EST | 1 |
| 1377 | 10051.004.1-T_at | 0.559001 | 0.55900072 | 6.466424 | 2E-09 | 10051.004 | NM_001002799. | DB144219.1 | EST | 1 |
| 1378 | 2335.006.1-B_at | 0.55897 | 0.55897034 | 6.465913 | 2E-09 | 2335.006. | NM_212482.1 | CX785805.1 | EST | 1 |
| 1379 | 57447.028.1-E_at | -0.55892 | 0.55891938 | 6.465056 | 2E-09 | 57447.028 | NM_2015355.1 | DA205446.1 | EST | 1 |
| 1380 | 2893.001.1-T_at | 0.5589 | 0.55890095 | 6.464746 | 2E-09 | 2893.001. | NM_000829.1 | DA258118.1 | EST | 1 |
| 1381 | 4288.005.1-F_at | 0.558883 | 0.55888308 | 6.464445 | 2E-09 | 4288.005. | NM_002417.2 | BM455229.1 | EST | 1 |
| 1382 | 2938.007.1-T_at | -0.55888 | 0.55887858 | 6.464369 | 2E-09 | 2938.007. | NM_145740.2 | AX477713.1 | GENBANK_PATENT | 1 |
| 1383 | 29127.020.1-T_at | -0.55848 | 0.55884819 | 6.463858 | 2E-09 | 29127.020 | NM_013277.2 | DB089267.1 | EST | 1 |
| 1384 | 154810.002.1-T | -0.55861 | 0.55861375 | 6.459916 | 2E-09 | 154810.00 | NM_130847.1 | AX886249.1 | GENBANK_PATENT | 1 |
| 1385 | 9232.001.1-T_at | 0.558605 | 0.55860527 | 6.459774 | 2E-09 | 9232.001. | NM_004219.2 | CN285866.1 | EST | 1 |
| 1386 | 55214.004.1-T_at | -0.55803 | 0.55802814 | 6.450079 | 2E-09 | 55214.004 | NM_018192.2 | DA953365.1 | EST | 1 |
| 1387 | 79971.002.1-B_at | -0.55798 | 0.55797779 | 6.449236 | 3E-09 | 79971.002 | NM_001002292. | CQ720425.1 | GENBANK_PATENT | 1 |
| 1388 | 3977.002.1-T_at | -0.55793 | 0.55793279 | 6.448479 | 3E-09 | 3977.002. | NM_002310.3 | DR005799.1 | EST | 1 |
| 1389 | 7170.028.1-F_at | 0.557857 | 0.5578569 | 6.447206 | 3E-09 | 7170.028. | NM_153649.2 | BQ220396.1 | EST | 2 |
| 1390 | 1410.009.1-E_at | -0.55785 | 0.55784993 | 6.447089 | 3E-09 | 1410.009. | NM_001885.1 | BQ437433.1 | EST | 2 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 1391 | 4781.004.1-T_at | -0.55762 | 0.55762387 | 6.443297 | 3E-09 | 4781.004. | NM_005596.1 | BG742798.1 | EST | 4 |
| 1392 | 9413.002.2-T_at | -0.55755 | 0.5575481 | 6.442026 | 3E-09 | 9413.002. | NM_004816.2 | AW779892.1 | EST | 1 |
| 1393 | 25925.005.1-T_at | -0.55744 | 0.55744483 | 6.440295 | 3E-09 | 25925.005 | NM_015461.1 | DB285938.1 | EST | 1 |
| 1394 | 55366.002.1-T_at | -0.55743 | 0.55743398 | 6.440113 | 3E-09 | 55366.002 | NM_018490.1 | BC033039.2 | mRNA | 3 |
| 1395 | 6288.001.1-F_at | -0.55742 | 0.55742086 | 6.439893 | 3E-09 | 6288.001. | NM_199161.1 | AX899121.1 | GENBANK_PATENT | 2 |
| 1396 | 2335.025.2-C_at | 0.557411 | 0.55741092 | 6.439727 | 3E-09 | 2335.025. | NM_212482.1 | CQ715726.1 | GENBANK_PATENT | 3 |
| 1397 | 2335.004.1-F_at | 0.557345 | 0.55734468 | 6.438616 | 3E-09 | 2335.004. | NM_212482.1 | AU139388.1 | EST | 1 |
| 1398 | 7170.038.1-F_at | 0.557344 | 0.55734423 | 6.438609 | 3E-09 | 7170.038. | NM_153649.2 | BG425254.1 | EST | 2 |
| 1399 | 7373.003.3-B_at | -0.55728 | 0.55728249 | 6.437574 | 3E-09 | 7373.003. | NM_021110.1 | CQ716670.1 | GENBANK_PATENT | 1 |
| 1400 | 5744.003.2-B_at | -0.55713 | 0.55713472 | 6.435099 | 3E-09 | 5744.003. | NM_198955.1 | BG680355.1 | EST | 1 |
| 1401 | 1164.001.1-F_at | 0.556978 | 0.5569777 | 6.432469 | 3E-09 | 1164.001. | NM_001827.1 | AX971617.1 | GENBANK_PATENT | 1 |
| 1402 | 23266.005.1-T_at | -0.55685 | 0.55685184 | 6.430362 | 3E-09 | 23266.005 | NM_012302.2 | DA764511.1 | EST | 1 |
| 1403 | 4601.015.2-F_at | -0.55673 | 0.55673111 | 6.428342 | 3E-09 | 4601.015. | NM_130439.3 | DA279837.1 | EST | 1 |
| 1404 | 23092.009.1-D_at | -0.55669 | 0.55668653 | 6.427596 | 3E-09 | 23092.009 | NM_015071.2 | BM045740.1 | EST | 1 |
| 1405 | 83699.004.1-T_at | -0.55668 | 0.55667613 | 6.427422 | 3E-09 | 83699.004 | NM_031469.1 | AX980231.1 | GENBANK_PATENT | 1 |
| 1406 | 2982.013.1-T_at | -0.55666 | 0.55665713 | 6.427104 | 3E-09 | 2982.013. | NM_000856.2 | CF594362.1 | EST | 1 |
| 1407 | 26289.013.1-F_at | -0.55662 | 0.55662356 | 6.426543 | 3E-09 | 26289.013 | NM_174858.1 | CK024190.1 | EST | 1 |
| 1408 | 7113.003.1-F_at | -0.55657 | 0.5565676 | 6.425607 | 3E-09 | 7113.003. | NM_005656.2 | CQ976404.1 | GENBANK_PATENT | 2 |
| 1409 | 390.003.1-T_at | -0.55648 | 0.55648155 | 6.424167 | 3E-09 | 390.003.1 | NM_005168.3 | DA532407.1 | EST | 1 |
| 1410 | 6304.002.2-T_at | -0.55641 | 0.55641323 | 6.423025 | 3E-09 | 6304.002. | NM_002971.2 | BC001744.1 | mRNA | 33 |
| 1411 | 6304.009.2-T_at | -0.55633 | 0.55633335 | 6.42169 | 3E-09 | 6304.009. | NM_002971.2 | DA497369.1 | EST | 1 |
| 1412 | 3872.017.1-T_at | -0.55631 | 0.55631309 | 6.421351 | 3E-09 | 3872.017. | NM_000422.1 | BX378477.2 | EST | 1 |
| 1413 | 2335.013.1-D_at | 0.556298 | 0.55629818 | 6.421102 | 3E-09 | 2335.013. | NM_212482.1 | AL551632.3 | EST | 2 |
| 1414 | 6790.001.1-T_at | -0.55629 | 0.55629311 | 6.421017 | 3E-09 | 6790.001. | NM_198436.1 | D84212.1 | mRNA | 8 |
| 1415 | 51201.007.1-B_at | -0.55615 | 0.55614867 | 6.418603 | 3E-09 | 51201.007 | NM_016353.2 | BF541714.1 | EST | 1 |
| 1416 | 54443.009.1-T_at | -0.55614 | 0.5561397 | 6.418453 | 3E-09 | 54443.009 | NM_018685.2 | DA242046.1 | EST | 1 |
| 1417 | 54443.012.1-T_at | 0.556003 | 0.55600288 | 6.416167 | 3E-09 | 54443.012 | NM_018685.2 | BG167656.1 | EST | 1 |
| 1418 | 5608.003.1-D_at | -0.55592 | 0.55592463 | 6.41486 | 3E-09 | 5608.003. | NM_002758.2 | BP220368.1 | EST | 1 |
| 1419 | 2.005.1-B_at | -0.55591 | 0.55590928 | 6.414604 | 3E-09 | 2.005.1 | NM_000014.4 | BI493707.1 | REFSEQ | 1 |
| 1420 | 23015.010.2-F_at | -0.55591 | 0.55590628 | 6.414554 | 3E-09 | 23015.010 | NM_181076.2 | XM_497449.1 | GENBANK_PATENT | 114 |
| 1421 | 25925.010.1-T_at | -0.55586 | 0.55586644 | 6.413722 | 3E-09 | 25925.010 | NM_015461.1 | DA215395.1 | EST | 1 |
| 1422 | 79745.002.2-T_at | -0.55584 | 0.55584433 | 6.413519 | 3E-09 | 79745.002 | NM_024692.3 | DB034631.1 | EST | 2 |
| 1423 | 23650.007.1-E_at | -0.55581 | 0.55580568 | 6.412874 | 3E-09 | 23650.007 | NM_058193.1 | BX395679.2 | EST | 1 |
| 1424 | 953.013.1-B_at | -0.55579 | 0.55578981 | 6.412609 | 3E-09 | 953.013.1 | NM_001776.3 | CQ721824.1 | GENBANK_PATENT | 1 |
| 1425 | 7153.002.5-C_at | -0.55574 | 0.55574323 | 6.411832 | 3E-09 | 7153.002. | NM_001067.2 | CQ735949.1 | GENBANK_PATENT | 1 |
| 1426 | 4240.001.1-T_at | -0.55574 | 0.55573744 | 6.411735 | 3E-09 | 4240.001. | NM_005928.1 | BF525404.1 | EST | 1 |
| 1427 | 58499.005.1-T_at | -0.55571 | 0.55571242 | 6.411317 | 3E-09 | 58499.005 | NM_021224.3 | BI461756.1 | EST | 1 |
| 1428 | 7168.026.1-C_at | -0.55559 | 0.55558644 | 6.409271 | 3E-09 | 7168.026. | NM_001018020. | CV810859.1 | EST | 1 |
| 1429 | 8404.026.1-T_at | -0.55559 | 0.55558982 | 6.406658 | 3E-09 | 8404.026. | NM_004684.2 | BX647713.1 | mRNA | 141 |
| 1430 | 94274.002.1-D_at | -0.55558 | 0.55558292 | 6.409156 | 3E-09 | 94274.002 | NM_033256.1 | CQ730829.1 | GENBANK_PATENT | 1 |
| 1431 | 301.008.1-C_at | -0.55557 | 0.55557226 | 6.408978 | 3E-09 | 301.008.1 | NM_000700.1 | CD688703.1 | EST | 1 |
| 1432 | 3426.001.1-C_at | -0.55554 | 0.55553521 | 6.40836 | 3E-09 | 3426.001. | NM_000204.1 | BC020718.1 | mRNA | 165 |
| 1433 | 2938.007.2-B_at | -0.55549 | 0.55548513 | 6.407525 | 3E-09 | 2938.007. | NM_145740.2 | AX477713.1 | GENBANK_PATENT | 1 |
| 1434 | 7373.003.5-C_at | -0.55543 | 0.55543318 | 6.406658 | 3E-09 | 7373.003. | NM_021110.1 | CQ716670.1 | GENBANK_PATENT | 1 |
| 1435 | 7169.001.2-F_at | -0.55538 | 0.55537917 | 6.405757 | 3E-09 | 7169.001. | NM_213674.1 | BM809268.1 | mRNA | 4 |
| 1436 | 2119.007.1-F_at | -0.55536 | 0.55535866 | 6.405415 | 3E-09 | 2119.007. | NM_004454.1 | BE408130.1 | EST | 1 |
|      |              | -0.55522 | 0.5552225  | 6.403145 |        |          |                                  |                                |                                |            |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 1437 | 1959.001.2-T_at | −0.55498 | 0.55498357 | 6.399162 | 3E-09 | 1959.001. | NM_000399.2 | DB086600.1 | EST | 1 |
| 1438 | 9824.006.1-T_at | 0.55476 | 0.55475962 | 6.395432 | 3E-09 | 9824.006. | NM_014783.2 | CK903028.1 | EST | 2 |
| 1439 | 301.013.1-B_at | −0.55475 | 0.55475105 | 6.395289 | 3E-09 | 301.013.1 | NM_000700.1 | BF130804.1 | EST | 1 |
| 1440 | 10124.004.1-B_at | −0.55458 | 0.55458304 | 6.392491 | 3E-09 | 10124.004 | NM_001037164. | BU61374.1 | EST | 12 |
| 1441 | 140885.010.3-F | −0.55438 | 0.55438483 | 6.389193 | 3E-09 | 140885.01 | NM_080792.2 | CQ728313.1 | GENBANK_PATENT | 1 |
| 1442 | 54443.012.1-B_at | 0.554381 | 0.5543815 | 6.389137 | 3E-09 | 54443.012 | NM_018685.2 | BG167656.1 | EST | 1 |
| 1443 | 29997.008.1-F_at | −0.55437 | 0.554365 | 6.388863 | 3E-09 | 29997.008 | NM_015710.3 | BI871613.1 | EST | 1 |
| 1444 | 23092.002.1-T_at | −0.55436 | 0.55435963 | 6.388774 | 3E-09 | 23092.002 | NM_015071.2 | CQ732129.1 | GENBANK_PATENT | 1 |
| 1445 | 1308.009.1-E_at | −0.55427 | 0.55427197 | 6.387315 | 3E-09 | 1308.009. | NM_130778.1 | DA425187.1 | EST | 1 |
| 1446 | 1308.004.1-C_at | −0.55418 | 0.55418499 | 6.385868 | 3E-09 | 1308.004. | NM_130778.1 | BE615666.1 | EST | 1 |
| 1447 | 59342.003.1-B_at | −0.55416 | 0.55416164 | 6.38548 | 3E-09 | 59342.003 | NM_021626.1 | DA821057.1 | EST | 1 |
| 1448 | 2119.006.1-F_at | −0.55414 | 0.55413804 | 6.385088 | 3E-09 | 2119.006. | NM_004454.1 | DB094869.1 | EST | 1 |
| 1449 | 6304.011.2-T_at | −0.55412 | 0.55411832 | 6.38476 | 3E-09 | 6304.011. | NM_002971.2 | BP359118.1 | EST | 1 |
| 1450 | 4288.006.2-D_at | 0.553943 | 0.5539433 | 6.38185 | 3E-09 | 4288.006. | NM_002417.2 | BP363635.1 | EST | 1 |
| 1451 | 358.017.1-D_at | −0.55393 | 0.5539341 | 6.381697 | 3E-09 | 358.017.1 | NM_198098.1 | AY312580.1 | mRNA | 1 |
| 1452 | 29994.009.1-D_at | −0.55389 | 0.55388615 | 6.380901 | 4E-09 | 29994.009 | NM_013450.1 | DA218896.1 | EST | 1 |
| 1453 | 23650.006.1-T_at | −0.55388 | 0.55387924 | 6.380786 | 4E-09 | 23650.006 | NM_058193.1 | BE304682.1 | EST | 1 |
| 1454 | 3945.024.1-T_at | −0.5538 | 0.55379733 | 6.379425 | 4E-09 | 3945.024. | NM_002300.3 | BF127786.1 | EST | 1 |
| 1455 | 9073.003.1-T_at | −0.55367 | 0.55367412 | 6.377378 | 4E-09 | 9073.003. | NM_199328.1 | BP276390.1 | EST | 1 |
| 1456 | 55165.004.1-B_at | 0.553669 | 0.55366932 | 6.377298 | 4E-09 | 55165.004 | NM_018131.3 | BX416068.2 | EST | 1 |
| 1457 | 54928.003.1-C_at | −0.55352 | 0.55352466 | 6.374896 | 4E-09 | 54928.003 | NM_017813.2 | DB283344.1 | EST | 1 |
| 1458 | 489.006.1-T_at | −0.55341 | 0.55340971 | 6.372987 | 4E-09 | 489.006.1 | NM_174958.1 | CV379840.1 | EST | 1 |
| 1459 | 6122.030.1-F_at | −0.55337 | 0.55337311 | 6.37238 | 4E-09 | 6122.030. | NM_000967.3 | BF315041.1 | EST | 1 |
| 1460 | 4781.014.2-T_at | −0.55315 | 0.55315167 | 6.368705 | 4E-09 | 4781.014. | NM_005596.1 | DN918235.1 | EST | 1 |
| 1461 | 7168.014.3-B_at | −0.55307 | 0.55307042 | 6.367357 | 4E-09 | 7168.014. | NM_001018020. | BP257563.1 | EST | 1 |
| 1462 | 4147.003.1-F_at | −0.55281 | 0.55280885 | 6.36302 | 4E-09 | 4147.003. | NM_002380.3 | AY358895.1 | mRNA | 81 |
| 1463 | 57451.001.3-B_at | −0.55273 | 0.55273245 | 6.361754 | 4E-09 | 57451.001 | XM_931456.1 | CS188752.1 | GENBANK_PATENT | 1 |
| 1464 | 9055.018.1-T_at | 0.552521 | 0.55252074 | 6.358246 | 4E-09 | 9055.018. | NM_003981.2 | DA033856.1 | EST | 1 |
| 1465 | 4931.013.1-T_at | 0.552443 | 0.552443 | 6.356958 | 4E-09 | 4931.013. | NM_002533.2 | BG771162.1 | EST | 1 |
| 1466 | 7169.001.1-T_at | −0.55242 | 0.55241607 | 6.356513 | 4E-09 | 7169.001. | NM_213674.1 | BM809268.1 | EST | 4 |
| 1467 | 2568.005.1-B_at | −0.55241 | 0.55241426 | 6.356483 | 4E-09 | 2568.005. | NM_014211.1 | AK055205.1 | mRNA | 11 |
| 1468 | 4435.001.1-T_at | −0.5524 | 0.55240125 | 6.356267 | 4E-09 | 4435.001. | NM_004143.2 | AA317379.1 | EST | 1 |
| 1469 | 2335.006.1-F_at | 0.552355 | 0.55235498 | 6.355501 | 4E-09 | 2335.006. | NM_212482.1 | CX785805.1 | EST | 1 |
| 1470 | 55294.007.1-T_at | −0.55234 | 0.55234085 | 6.355267 | 4E-09 | 55294.007 | NM_033632.2 | BF380630.1 | EST | 1 |
| 1471 | 4288.006.2-B_at | 0.55233 | 0.55233026 | 6.355092 | 4E-09 | 4288.006. | NM_002417.2 | BP363635.1 | EST | 1 |
| 1472 | 29089.003.1-F_at | 0.552316 | 0.55231581 | 6.354852 | 4E-09 | 29089.003 | NM_014176.1 | AV740591.1 | EST | 1 |
| 1473 | 2335.032.1-F_at | 0.55229 | 0.55228962 | 6.354419 | 4E-09 | 2335.032. | NM_212482.1 | DA647475.1 | EST | 1 |
| 1474 | 57162.003.1-T_at | −0.55221 | 0.55220544 | 6.353025 | 4E-09 | 57162.003 | NM_020651.2 | BX380539.2 | EST | 3 |
| 1475 | 4288.005.1-B_at | 0.552168 | 0.5521684 | 6.352412 | 4E-09 | 4288.005. | NM_002417.2 | BM455229.1 | EST | 1 |
| 1476 | 3860.004.1-T_at | −0.55215 | 0.5521477 | 6.35207 | 4E-09 | 3860.004. | NM_153490.1 | DA763721.1 | EST | 1 |
| 1477 | 2.018.1-F_at | −0.55206 | 0.55205696 | 6.350568 | 4E-09 | 2.018.1 | NM_000014.4 | DB090657.1 | EST | 1 |
| 1478 | 23015.010.2-C_at | −0.55198 | 0.55198079 | 6.349308 | 4E-09 | 23015.010 | NM_181076.2 | XM_497449.1 | REFSEQ | 1 |
| 1479 | 6122.029.1-F_at | −0.55188 | 0.55188275 | 6.347686 | 4E-09 | 6122.029. | NM_009967.3 | BG547902.1 | EST | 1 |
| 1480 | 7113.007.1-E_at | −0.55181 | 0.55181118 | 6.346503 | 4E-09 | 7113.007. | NM_005656.2 | DR005196.1 | EST | 1 |
| 1481 | 2982.001.1-T_at | −0.55178 | 0.55177855 | 6.345963 | 4E-09 | 2982.001. | NM_000856.2 | DA793192.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 1482 | 56999.003.1-C_at | −0.55176 | 0.55175685 | 6.345604 | 4E-09 | 56999.003 | NM_182920.1 | CQ721254.1 | GENBANK_PATENT | 1 |
| 1483 | 152015.005.1-B | −0.55166 | 0.55165647 | 6.343945 | 4E-09 | 152015.00 | NM_001012337. | CQ732372.1 | GENBANK_PATENT | 1 |
| 1484 | 1410.002.1-T_at | −0.55165 | 0.55165464 | 6.343914 | 4E-09 | 1410.002. | NM_001885.1 | AX899073.1 | GENBANK_PATENT | 4 |
| 1485 | 7373.004.1-B_at | −0.55161 | 0.55160828 | 6.343148 | 4E-09 | 7373.004. | NM_021110.1 | M64109.1 | mRNA | 1 |
| 1486 | 492304.010.1-T | −0.5516 | 0.55160004 | 6.343012 | 4E-09 | 492304.01 | — | — | — | — |
| 1487 | 80034.003.2-T_at | −0.55149 | 0.55148932 | 6.341182 | 4E-09 | 80034.003 | NM_024969.2 | CQ733306.1 | GENBANK_PATENT | 1 |
| 1488 | 4281.009.1-F_at | −0.55134 | 0.55133895 | 6.338698 | 4E-09 | 4281.009. | NM_033290.1 | AY540014.1 | mRNA | |
| 1489 | 301.011.1-B_at | −0.5513 | 0.55130021 | 6.338058 | 4E-09 | 301.011.1 | NM_000700.1 | BG435248.1 | EST | 1 |
| 1490 | 90293.002.2-T_at | −0.55112 | 0.55112335 | 6.335138 | 4E-09 | 90293.002 | NM_033495.2 | BP360232.1 | EST | 1 |
| 1491 | 800.013.1-C_at | −0.55112 | 0.55112102 | 6.335099 | 4E-09 | 800.013.1 | NM_033138.2 | NM_033157.2 | REFSEQ | 151 |
| 1492 | 142.011.1-T_at | 0.550921 | 0.55092062 | 6.331791 | 4E-09 | 142.011.1 | NM_001618.2 | DA757025.1 | EST | 1 |
| 1493 | 6876.017.1-T_at | −0.55079 | 0.55078992 | 6.329635 | 4E-09 | 6876.017. | NM_001001522. | BX428130.2 | EST | 1 |
| 1494 | 825.021.1-D_at | −0.55076 | 0.55076446 | 6.329215 | 4E-09 | 825.021.1 | NM_212464.1 | AV645796.1 | EST | 1 |
| 1495 | 714.002.1-F_at | −0.5507 | 0.55069829 | 6.328124 | 4E-09 | 714.002.1 | NM_172369.2 | AX894785.1 | GENBANK_PATENT | 2 |
| 1496 | 2335.039.1-C_at | 0.550688 | 0.55068782 | 6.327951 | 4E-09 | 2335.039. | NM_212482.1 | BP288118.1 | EST | 1 |
| 1497 | 2.024.2-D_at | −0.55068 | 0.55068374 | 6.327884 | 4E-09 | 2.024.2 | NM_000014.4 | DB286897.1 | EST | 1 |
| 1498 | 9037.004.2-T_at | −0.55067 | 0.55066904 | 6.327641 | 4E-09 | 9037.004. | NM_003966.1 | BF923022.1 | EST | 1 |
| 1499 | 4781.006.2-D_at | −0.55052 | 0.55051889 | 6.325165 | 5E-09 | 4781.006. | NM_005596.1 | AK131233.1 | mRNA | 2 |
| 1500 | 4601.012.1-T_at | −0.55051 | 0.55051321 | 6.325072 | 5E-09 | 4601.012. | NM_130439.3 | DA746301.1 | EST | 1 |
| 1501 | 4781.009.2-B_at | −0.55048 | 0.55048372 | 6.324586 | 5E-09 | 4781.009. | NM_005596.1 | CQ733556.1 | GENBANK_PATENT | 1 |
| 1502 | 7169.004.1-F_at | −0.55041 | 0.55041381 | 6.323433 | 5E-09 | 7169.004. | NM_213674.1 | BG027526.1 | EST | 1 |
| 1503 | 54443.010.1-C_at | 0.550402 | 0.55040232 | 6.323244 | 5E-09 | 54443.010 | NM_018685.2 | DA196444.1 | EST | 1 |
| 1504 | 7818.023.1-F_at | 0.550382 | 0.55038162 | 6.322903 | 5E-09 | 7818.023. | NM_004632.2 | BQ424083.1 | EST | 1 |
| 1505 | 79971.009.2-T_at | −0.55036 | 0.5503562 | 6.322484 | 5E-09 | 79971.009 | NM_001002292. | DA264864.1 | EST | 1 |
| 1506 | 4601.007.1-T_at | −0.55036 | 0.5503552 | 6.322467 | 5E-09 | 4601.007. | NM_130439.3 | DA009519.1 | EST | 1 |
| 1507 | 7113.011.2-D_at | −0.55032 | 0.55031657 | 6.321831 | 5E-09 | 7113.011. | NM_005656.2 | DA868984.1 | EST | 1 |
| 1508 | 54443.008.1-B_at | 0.550158 | 0.5501582 | 6.319222 | 5E-09 | 54443.008 | NM_018685.2 | DB172145.1 | EST | 1 |
| 1509 | 23092.009.2-D_at | −0.55009 | 0.5500931 | 6.318149 | 5E-09 | 23092.009 | NM_015071.2 | BM045740.1 | EST | 1 |
| 1510 | 57447.006.1-E_at | −0.55005 | 0.55004557 | 6.317367 | 5E-09 | 57447.006 | NM_201535.1 | DA283861.1 | EST | 4 |
| 1511 | 7170.035.2-B_at | −0.54938 | 0.54938028 | 6.30642 | 5E-09 | 7170.035. | NM_153649.2 | BF575164.1 | EST | 1 |
| 1512 | 79971.010.1-T_at | −0.54937 | 0.54936792 | 6.306216 | 5E-09 | 79971.010 | NM_001002292. | CB268343.1 | EST | 1 |
| 1513 | 4288.004.1-T_at | −0.54933 | 0.54932704 | 6.305544 | 5E-09 | 4288.004. | NM_002417.2 | BP232141.1 | EST | 1 |
| 1514 | 59342.006.1-T_at | −0.54953 | 0.54953056 | 6.314367 | 5E-09 | 59342.006 | NM_021626.1 | BP196952.1 | EST | 1 |
| 1515 | 4781.017.1-B_at | 0.548993 | 0.54899327 | 6.30006 | 5E-09 | 4781.017. | NM_005596.1 | DR002043.1 | EST | 1 |
| 1516 | 4781.013.2-B_at | −0.54894 | 0.54894022 | 6.299188 | 5E-09 | 4781.013. | NM_005596.1 | DA750893.1 | EST | 1 |
| 1517 | 23015.010.3-E_at | −0.5488 | 0.54880253 | 6.296927 | 5E-09 | 23015.010 | NM_181076.2 | XM_497449.1 | REFSEQ | 1 |
| 1518 | 9055.013.1-B_at | 0.548622 | 0.54862189 | 6.293962 | 5E-09 | 9055.013. | NM_003981.2 | CN348395.1 | EST | 1 |
| 1519 | 5621.003.1-T_at | −0.54841 | 0.548412 | 6.290518 | 5E-09 | 5621.003. | NM_000311.2 | BP218622.1 | EST | 1 |
| 1520 | 2893.006.1-T_at | −0.54819 | 0.54819208 | 6.286911 | 5E-09 | 2893.006. | NM_000829.1 | BF669210.1 | EST | 1 |
| 1521 | 3161.007.1-F_at | −0.54812 | 0.54812393 | 6.285794 | 5E-09 | 3161.007. | NM_012484.1 | BG198860.1 | EST | 1 |
| 1522 | 55107.001.1-T_at | −0.54801 | 0.54801484 | 6.284006 | 5E-09 | 55107.001 | NM_018043.4 | AY728143.1 | mRNA | 30 |
| 1523 | 2327.002.1-C_at | −0.54819 | 0.54819208 | 6.286911 | 5E-09 | 2327.002. | NM_001460.2 | CD684429.1 | EST | 1 |
| 1524 | 3945.014.1-B_at | −0.54812 | 0.54812393 | 6.285794 | 5E-09 | 3945.014. | NM_002300.3 | BG402389.1 | EST | 1 |
| 1525 | 151438.003.1-C | −0.54801 | 0.54801484 | 6.284006 | 5E-09 | 151438.00 | AK058877.1 | DB124570.1 | EST | 2 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 1526 | 7113.013.1-F_at | −0.54795 | 0.54795303 | 6.282993 | 5E-09 | 7113.013. | NM_005656.2 | DA627080.1 | EST | 1 |
| 1527 | 441417.001.1-B | −0.54784 | 0.54783722 | 6.281095 | 5E-09 | 441417.00 | XM_497039.2 | XM_933326.1 | REFSEQ | 3 |
| 1528 | 2982.012.1-F_at | −0.54781 | 0.54781217 | 6.280685 | 6E-09 | 2982.012. | NM_000856.2 | BC012627.1 | mRNA | 2 |
| 1529 | 7168.005.3-E_at | −0.54767 | 0.54766942 | 6.278347 | 6E-09 | 7168.005. | NM_001018020. | BP373012.1 | EST | 1 |
| 1530 | 27338.001.1-B_at | 0.547668 | 0.54766773 | 6.27832 | 6E-09 | 27338.001 | NM_014501.1 | BI198504.1 | EST | 3 |
| 1531 | 8404.028.1-B_at | −0.54766 | 0.54766289 | 6.27824 | 6E-09 | 8404.028. | NM_004684.2 | CQ727530.1 | GENBANK_PATENT | 1 |
| 1532 | 4601.019.1-F_at | −0.54764 | 0.54764478 | 6.277944 | 6E-09 | 4601.019. | NM_130439.3 | BQ425277.1 | EST | 1 |
| 1533 | 8404.008.1-B_at | −0.54752 | 0.54751598 | 6.275835 | 6E-09 | 8404.008. | NM_004684.2 | DA342341.1 | EST | 1 |
| 1534 | 23266.008.3-F_at | −0.54739 | 0.54739477 | 6.273851 | 6E-09 | 23266.008 | NM_012302.2 | CQ799210.1 | GENBANK_PATENT | 1 |
| 1535 | 4931.012.1-F_at | 0.547302 | 0.54730211 | 6.272335 | 6E-09 | 4931.012. | NM_002533.2 | BQ930348.1 | EST | 1 |
| 1536 | 10010.007.1-E_at | −0.54712 | 0.54711818 | 6.269326 | 6E-09 | 10010.007 | NM_004180.2 | AI525053.1 | EST | 1 |
| 1537 | 11065.003.1-B_at | 0.54698 | 0.54697977 | 6.267063 | 6E-09 | 11065.003 | NM_181802.1 | CS138819.1 | GENBANK_PATENT | 5 |
| 1538 | 3925.016.1-C_at | 0.546859 | 0.5468594 | 6.265095 | 6E-09 | 3925.016. | NM_203399.1 | BE888426.1 | EST | 1 |
| 1539 | 7170.017.1-C_at | 0.546805 | 0.54680477 | 6.264203 | 6E-09 | 7170.017. | NM_153649.2 | BF574676.1 | EST | 1 |
| 1540 | 301.011.1-F_at | −0.54668 | 0.54668114 | 6.262183 | 6E-09 | 301.011.1. | NM_000700.1 | BG435248.1 | EST | 1 |
| 1541 | 57685.005.2-T_at | −0.54663 | 0.54663145 | 6.261371 | 6E-09 | 57685.005 | NM_020925.1 | CQ721664.1 | GENBANK_PATENT | 1 |
| 1542 | 23015.014.1-T_at | −0.54659 | 0.54658979 | 6.26069 | 6E-09 | 23015.014 | NM_181076.2 | DA928720.1 | EST | 1 |
| 1543 | 7153.002.3-T_at | 0.546559 | 0.54655896 | 6.260187 | 6E-09 | 7153.002. | NM_001067.2 | CQ735949.1 | GENBANK_PATENT | 114 |
| 1544 | 2568.005.2-D_at | −0.5465 | 0.5464996 | 6.259217 | 6E-09 | 2568.005. | NM_014211.1 | AK055205.1 | mRNA | 11 |
| 1545 | 2335.039.1-F_at | 0.546413 | 0.5464132 | 6.257806 | 6E-09 | 2335.039. | NM_212482.1 | BP288118.1 | EST | 1 |
| 1546 | 10124.002.1-F_at | −0.5464 | 0.54640453 | 6.257665 | 6E-09 | 10124.002 | NM_001037164. | BG178114.1 | EST | 6 |
| 1547 | 28299.003.1-D | −0.54611 | 0.54610398 | 6.252759 | 6E-09 | 28299.00 | XM_498506.1 | XM_932188.1 | REFSEQ | 1 |
| 1548 | 4781.013.1-T_at | −0.54585 | 0.54585341 | 6.248672 | 6E-09 | 4781.013. | NM_005596.1 | DA750893.1 | EST | 1 |
| 1549 | 7170.012.2-D_at | 0.545774 | 0.545774 | 6.247378 | 6E-09 | 7170.012. | NM_153649.2 | DA893534.1 | EST | 1 |
| 1550 | 667.014.1-T_at | −0.54573 | 0.54572906 | 6.246645 | 6E-09 | 667.014.1. | NM_183380.1 | CQ851391.1 | GENBANK_PATENT | 1 |
| 1551 | 4781.009.2-D_at | −0.54569 | 0.54568951 | 6.246 | 6E-09 | 4781.009. | NM_005596.1 | CQ732556.1 | GENBANK_PATENT | 1 |
| 1552 | 7169.001.1-D_at | −0.54565 | 0.54565203 | 6.24539 | 6E-09 | 7169.001. | NM_213674.1 | BM809268.1 | EST | 4 |
| 1553 | 2161.001.1-T_at | 0.545644 | 0.54564352 | 6.245251 | 6E-09 | 2161.001. | NM_000505.2 | AX147449.1 | GENBANK_PATENT | 30 |
| 1554 | 1308.001.1-F_at | −0.5456 | 0.54560226 | 6.244578 | 6E-09 | 1308.001. | NM_130778.1 | BM773425.1 | EST | 1 |
| 1555 | 7168.012.2-F_at | −0.54541 | 0.54540889 | 6.241428 | 7E-09 | 7168.012. | NM_001018020. | AK129882.1 | mRNA | 2 |
| 1556 | 10010.004.1-E_at | −0.54541 | 0.54540884 | 6.241427 | 7E-09 | 10010.004 | NM_004180.2 | BM750784.1 | EST | 1 |
| 1557 | 54443.009.1-D_at | 0.545394 | 0.54539371 | 6.241181 | 7E-09 | 54443.009 | NM_018685.2 | DA242046.1 | EST | 1 |
| 1558 | 7039.002.1-D_at | −0.54538 | 0.54537813 | 6.240927 | 7E-09 | 7039.002. | NM_003236.1 | AF149096.1 | mRNA | 2 |
| 1559 | 57447.041.1-B_at | −0.54524 | 0.54523712 | 6.23863 | 7E-09 | 57447.041 | NM_201535.1 | DA295124.1 | EST | 1 |
| 1560 | 4281.007.1-B_at | −0.54521 | 0.54521491 | 6.238269 | 7E-09 | 4281.007. | NM_033290.1 | AY540023.1 | mRNA | 1 |
| 1561 | 301.009.1-T_at | −0.54517 | 0.54516544 | 6.237463 | 7E-09 | 301.009.1. | NM_000700.1 | CD357777.1 | EST | 1 |
| 1562 | 9055.014.1-F_at | 0.545101 | 0.54510063 | 6.236408 | 7E-09 | 9055.014. | NM_003981.2 | BE300335.1 | EST | 2 |
| 1563 | 79971.013.1-C_at | −0.54495 | 0.54494911 | 6.233942 | 7E-09 | 79971.013 | NM_001002292. | DA878291.1 | EST | 1 |
| 1564 | 11065.003.2-T_at | 0.544945 | 0.5449453 | 6.23388 | 7E-09 | 11065.003 | NM_181802.1 | CS138819.1 | GENBANK_PATENT | 5 |
| 1565 | 7113.009.1-E_at | −0.54493 | 0.54493426 | 6.233701 | 7E-09 | 7113.009. | NM_005656.2 | DA873416.1 | EST | 1 |
| 1566 | 51203.002.2-T_at | 0.544867 | 0.54486653 | 6.232599 | 7E-09 | 51203.002 | NM_016359.2 | AL561514.3 | EST | 1 |
| 1567 | 7170.006.1-B_at | 0.54486 | 0.54486029 | 6.232497 | 7E-09 | 7170.006. | NM_153649.2 | DB003864.1 | EST | 2 |
| 1568 | 80034.002.1-T_at | 0.54484 | 0.54484345 | 6.232223 | 7E-09 | 80034.002 | NM_024969.2 | DA769284.1 | EST | 1 |
| 1569 | 1345.012.1-D_at | 0.544806 | 0.54480624 | 6.231618 | 7E-09 | 1345.012. | NM_004374.2 | DB564533.1 | EST | 1 |
| 1570 | 8321.004.1-T_at | −0.54478 | 0.54477916 | 6.231178 | 7E-09 | 8321.004. | NM_003505.1 | AA249884.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 1571 | 10461.001.1-T_at | -0.54469 | 0.54468608 | 6.229664 | 7E-09 | 10461.001 | NM_006343.2 | CQ760423.1 | GENBANK_PATENT | 4 |
| 1572 | 4601.010.1-T_at | -0.54466 | 0.54466418 | 6.229308 | 7E-09 | 4601.010. | NM_130439.3 | CS031066.1 | GENBANK_PATENT | 3 |
| 1573 | 3709.004.1-E_at | -0.54444 | 0.54444277 | 6.225708 | 7E-09 | 3709.004. | NM_002223.1 | BP364657.1 | EST | 1 |
| 1574 | 4781.017.2-T_at | -0.5444 | 0.5444035 | 6.225019 | 7E-09 | 4781.017. | NM_005596.1 | DR002043.1 | EST | 1 |
| 1575 | 5621.010.1-B_at | -0.54431 | 0.54431029 | 6.223555 | 7E-09 | 5621.010. | NM_000311.2 | DA174560.1 | EST | 1 |
| 1576 | 54763.001.1-T_at | -0.54431 | 0.54430594 | 6.223485 | 7E-09 | 54763.001 | NM_017578.2 | BI465233.1 | EST | 4 |
| 1577 | 306.003.1-B_at | -0.54429 | 0.54428587 | 6.223159 | 7E-09 | 306.003.1 | NM_005139.1 | CQ721707.1 | GENBANK_PATENT | 1 |
| 1578 | 2335.035.1-C_at | 0.544238 | 0.54423813 | 6.222383 | 7E-09 | 2335.035. | NM_212482.1 | CX755647.1 | EST | 1 |
| 1579 | 4601.015.1-T_at | -0.54414 | 0.54413917 | 6.220776 | 7E-09 | 4601.015. | NM_130439.3 | DA279837.1 | EST | 1 |
| 1580 | 7168.038.1-D_at | -0.54409 | 0.54408836 | 6.219951 | 7E-09 | 7168.038. | NM_001018020. | AK092573.1 | mRNA | 5 |
| 1581 | 55732.003.1-T_at | 0.543852 | 0.54385205 | 6.216114 | 7E-09 | 55732.003 | NM_018186.2 | DA733233.1 | EST | 2 |
| 1582 | 23266.001.1-T_at | -0.54381 | 0.54380864 | 6.21541 | 7E-09 | 23266.001 | NM_012302.2 | AK123422.1 | mRNA | 2 |
| 1583 | 4288.006.2-E_at | 0.543777 | 0.54377742 | 6.214903 | 7E-09 | 4288.006. | NM_002417.2 | BP363635.1 | EST | 1 |
| 1584 | 4781.013.2-D_at | -0.54375 | 0.54374747 | 6.214417 | 7E-09 | 4781.013. | NM_005596.1 | DA750893.1 | EST | 1 |
| 1585 | 259266.001.1-B | 0.543672 | 0.54367202 | 6.213193 | 7E-09 | 259266.00 | NM_018136.2 | BC034607.1 | mRNA | 7 |
| 1586 | 7170.029.1-F_at | 0.543574 | 0.54357435 | 6.211608 | 7E-09 | 7170.029. | NM_153649.2 | BM011010.1 | EST | 1 |
| 1587 | 51201.007.1-T_at | -0.54346 | 0.5434567 | 6.2097 | 8E-09 | 51201.007 | NM_016353.2 | BF541714.1 | EST | 1 |
| 1588 | 7169.002.1-F_at | -0.54328 | 0.54327991 | 6.206834 | 8E-09 | 7169.002. | NM_213674.1 | AL555921.3 | EST | 1 |
| 1589 | 8404.028.1-T_at | -0.54323 | 0.5432313 | 6.206046 | 8E-09 | 8404.028. | NM_004684.2 | CQ727530.1 | GENBANK_PATENT | 1 |
| 1590 | 4781.015.1-T_at | -0.54315 | 0.54314788 | 6.204695 | 8E-09 | 4781.015. | NM_005596.1 | DN995118.1 | EST | 1 |
| 1591 | 9055.012.1-T_at | 0.543077 | 0.54307679 | 6.203543 | 8E-09 | 9055.012. | NM_003981.2 | BE298728.1 | EST | 1 |
| 1592 | 2893.004.1-T_at | -0.5429 | 0.54289557 | 6.200829 | 8E-09 | 2893.004. | NM_000829.1 | DA066848.1 | EST | 1 |
| 1593 | 91653.015.1-T_at | -0.54284 | 0.54283984 | 6.199705 | 8E-09 | 91653.015 | NM_033254.2 | R75666.1 | EST | 1 |
| 1594 | 10010.001.1-T_at | -0.54281 | 0.54280637 | 6.199163 | 8E-09 | 10010.001 | NM_004180.2 | DA670701.1 | EST | 6 |
| 1595 | 1410.003.2-T_at | -0.54281 | 0.54280581 | 6.199154 | 8E-09 | 1410.003. | NM_001885.1 | AX899079.1 | GENBANK_PATENT | 1 |
| 1596 | 6595.013.1-B_at | -0.54268 | 0.54268082 | 6.19713 | 8E-09 | 6595.013. | NM_003070.3 | DA825858.1 | EST | 1 |
| 1597 | 4601.009.1-T_at | -0.54264 | 0.54264498 | 6.19655 | 8E-09 | 4601.009. | NM_130439.3 | BE789186.1 | EST | 1 |
| 1598 | 23015.009.1-E_at | 0.542456 | 0.5424498 | 6.193392 | 8E-09 | 23015.009 | NM_181076.2 | CA943083.1 | EST | 1 |
| 1599 | 2335.024.1-T_at | 0.542425 | 0.54242468 | 6.192986 | 8E-09 | 2335.024. | NM_212482.1 | CQ731573.1 | GENBANK_PATENT | 1 |
| 1600 | 23650.009.1-F_at | -0.54242 | 0.54242338 | 6.192965 | 8E-09 | 23650.009 | NM_058193.1 | BF836741.1 | EST | 1 |
| 1601 | 11254.001.1-F_at | -0.54238 | 0.54237719 | 6.192217 | 8E-09 | 11254.001 | NM_007231.1 | BE819593.1 | EST | 1 |
| 1602 | 7286.002.1-T_at | 0.542342 | 0.5423416 | 6.191642 | 8E-09 | 7286.002. | NM_020127.1 | BP315579.1 | EST | 1 |
| 1603 | 4931.004.1-T_at | 0.5424 | 0.54223963 | 6.189993 | 8E-09 | 4931.004. | NM_002533.2 | BM693264.1 | GENBANK_PATENT | 1 |
| 1604 | 7113.005.1-E_at | -0.54224 | 0.5422385 | 6.189974 | 8E-09 | 7113.005. | NM_005656.2 | DA865300.1 | EST | 1 |
| 1605 | 150572.009.1-F_at | -0.54223 | 0.54222998 | 6.189837 | 8E-09 | 150572.00 | NM_198274.2 | BF790590.1 | EST | 1 |
| 1606 | 57447.002.1-C_at | -0.54216 | 0.54215776 | 6.188669 | 8E-09 | 57447.002 | NM_201535.1 | BF526188.1 | EST | 1 |
| 1607 | 1410.002.2-T_at | -0.54199 | 0.54198899 | 6.185941 | 9E-09 | 1410.002. | NM_001885.1 | AX899073.1 | GENBANK_PATENT | 4 |
| 1608 | 4316.001.1-F_at | -0.54197 | 0.54197342 | 6.185689 | 9E-09 | 4316.001. | NM_002423.3 | CQ733055.1 | GENBANK_PATENT | 1 |
| 1609 | 254042.002.1-E | -0.54193 | 0.54192668 | 6.184934 | 9E-09 | 254042.00 | NM_199227.1 | AX188221.1 | GENBANK_PATENT | 7 |
| 1610 | 79971.006.2-B_at | -0.54193 | 0.54192511 | 6.184909 | 9E-09 | 79971.006 | NM_001002292. | DA048370.1 | EST | 1 |
| 1611 | 1396.001.1-T_at | 0.54189 | 0.54189009 | 6.184343 | 9E-09 | 1396.001. | NM_001311.3 | N46592.1 | EST | 2 |
| 1612 | 7153.002.3-D_at | 0.541626 | 0.54162631 | 6.180082 | 9E-09 | 7153.002. | NM_001067.2 | CQ735949.1 | GENBANK_PATENT | 114 |
| 1613 | 54443.001.1-F_at | 0.541435 | 0.54143463 | 6.176988 | 9E-09 | 54443.001 | NM_018685.2 | BC070066.1 | mRNA | 10 |
| 1614 | 142.012.1-F_at | 0.541335 | 0.54133459 | 6.175374 | 9E-09 | 142.012.1 | NM_001618.2 | BG900662.1 | EST | 1 |

TABLE 3-continued

Polynucleotides probe sets that harbor different values between malignant and benign tumors.

| No | Probeset_ID | correl | abs_correl | tstat | pvalue | Event_ID | reference_representative_accession | variant_representative_accession | variant_representative_database | variant nb |
|---|---|---|---|---|---|---|---|---|---|---|
| 1615 | 301.013.1-F_at | −0.54115 | 0.54115484 | 6.172474 | 9E-09 | 301.013.1 | NM_000700.1 | BF130804.1 | EST | 1 |
| 1616 | 152015.004.1-E | −0.54097 | 0.54096565 | 6.169423 | 9E-09 | 152015.00 | NM_001012337. | BC015413.1 | mRNA | 2 |
| 1617 | 8857.001.1-F_at | −0.54089 | 0.54089094 | 6.168218 | 9E-09 | 8857.001. | NM_003890.1 | CQ730859.1 | GENBANK_PATENT | 1 |
| 1618 | 6203.002.1-B_at | −0.54088 | 0.54087544 | 6.167968 | 9E-09 | 6203.002. | NM_001013.3 | AX969894.1 | GENBANK_PATENT | 1 |
| 1619 | 7168.010.1-D_at | −0.54079 | 0.54078858 | 6.166568 | 9E-09 | 7168.010. | NM_001018020. | CD556048.1 | EST | 1 |
| 1620 | 57447.051.2-C_at | −0.54076 | 0.54076391 | 6.166171 | 9E-09 | 57447.051 | NM_201535.1 | BX460053.2 | EST | 1 |
| 1621 | 4288.006.1-T_at | 0.540756 | 0.54075554 | 6.166036 | 9E-09 | 4288.006. | NM_002417.2 | BP363635.1 | EST | 1 |
| 1622 | 54443.013.1-T_at | 0.54066 | 0.54065959 | 6.16449 | 9E-09 | 54443.013 | NM_018685.2 | BX410228.2 | EST | 1 |
| 1623 | 9055.017.1-E_at | 0.540557 | 0.54055744 | 6.162844 | 9E-09 | 9055.017. | NM_003981.2 | DB031145.1 | EST | 1 |
| 1624 | 55732.004.1-T_at | 0.540487 | 0.54048721 | 6.161713 | 9E-09 | 55732.004 | NM_018186.2 | BF216714.1 | EST | 1 |
| 1625 | 9413.003.2-F_at | −0.54047 | 0.5404689 | 6.161418 | 9E-09 | 9413.003. | NM_004816.2 | BX641153.1 | mRNA | 10 |
| 1626 | 4629.015.1-B_at | −0.54046 | 0.5404569 | 6.161225 | 9E-09 | 4629.015. | NM_022844.1 | DB284318.1 | EST | 1 |
| 1627 | 84766.002.2-C_at | −0.54045 | 0.54045424 | 6.161182 | 9E-09 | 84766.002 | NM_032680.2 | XM_498532.1 | REFSEQ | 1 |
| 1628 | 11065.008.1-T_at | 0.540347 | 0.5403468 | 6.159452 | 9E-09 | 11065.008 | NM_181802.1 | NM_181800.1 | REFSEQ | 5 |
| 1629 | 81704.013.8-F_at | −0.54034 | 0.5403434 | 6.159398 | 9E-09 | 81704.013 | NM_203447.1 | CQ723361.1 | GENBANK_PATENT | 1 |
| 1630 | 667.016.1-T_at | −0.54033 | 0.54032607 | 6.159119 | 9E-09 | 667.016.1 | NM_183380.1 | DB013737.1 | EST | 1 |
| 1631 | 29997.004.1-F_at | 0.5403 | 0.54030048 | 6.158707 | 1E-08 | 29997.004 | NM_015710.3 | BU154441.1 | EST | 1 |
| 1632 | 2824.001.3-B_at | −0.5403 | 0.54029788 | 6.158665 | 1E-08 | 2824.001. | NM_001001994. | CQ717842.1 | GENBANK_PATENT | 1 |
| 1633 | 57447.004.1-B_at | −0.54026 | 0.54025744 | 6.158014 | 1E-08 | 57447.004 | NM_201535.1 | CD515320.1 | EST | 2 |
| 1634 | 2982.003.1-T_at | −0.54014 | 0.54014125 | 6.156144 | 1E-08 | 2982.003. | NM_000856.2 | DB179470.1 | EST | 1 |
| 1635 | 4288.005.1-T_at | 0.539862 | 0.53986198 | 6.151651 | 1E-08 | 4288.005. | NM_002417.2 | BM455229.1 | EST | 1 |
| 1636 | 10957.018.1-F_at | −0.53982 | 0.53982225 | 6.151012 | 1E-08 | 10957.018 | NM_006813.1 | AI547283.1 | EST | 1 |
| 1637 | 2568.006.2-B_at | −0.53981 | 0.53980996 | 6.150815 | 1E-08 | 2568.006. | NM_014211.1 | CD385249.1 | EST | 1 |
| 1638 | 10051.015.2-F_at | 0.539796 | 0.53979645 | 6.150597 | 1E-08 | 10051.015 | NM_001002799. | BM010546.1 | EST | 1 |
| 1639 | 2.007.1-F_at | −0.53972 | 0.53972151 | 6.149392 | 1E-08 | 2.007.1 | NM_000014.4 | BG547500.1 | EST | 1 |
| 1640 | 5803.003.1-T_at | −0.53965 | 0.53964973 | 6.148239 | 1E-08 | 5803.003. | NM_002851.1 | CD672822.1 | EST | 1 |

In order to find subsets of smaller amounts of polynucleotide probe sets to be used for classifying the benign or malignant status of tissues, prediction rules were constructed using the top 50, top 100, top 150 and top 200 polynucleotide probe sets of Table 4 (with identifiers no 1 to no 50, no 1 to no 100, no 1 to no 150 and no 1 to no 200). The estimated prediction accuracies by leave-one-out crossvalidation were as follows:

using the top 50 polynucleotide probe sets: 1 out of 24 patients with benign status were misclassified and 7 out of 70 patients with malignant status.
using the top 100 polynucleotide probe sets: 1 out of 24 patients with benign status were misclassified and 5 out of 70 patients with malignant status.
using the top 150 polynucleotide probe sets: 0 out of 24 patients with benign status were misclassified and 6 out of 70 patients with malignant status.
using the top 200 polynucleotide probe sets: 0 out of 24 patients with benign status were misclassified and 4 out of 70 patients with malignant status.

Table 5 contains the average profiles of the preferred 1,228 signature polynucleotide probe sets with $p<10e-9$ measured on the 24 benign and 70 malignant tissues of the training set.

Thus, the preferred set of probes to be used for predicting the malignant status of a tissue of a future patient is reported here.

An additional 100 patients referred at the Institut Gustave Roussy for a clinical or radiological breast lesion in 2006-2007 for which a FNA was performed to assess the diagnosis of the breast lesion has been analyzed by exon profiling. The prediction rule using the preferred 1228 signature polynucleotide probe sets has been applied to this independent validation set.

The inventors have developed an optimal prediction rule based on the methodology reported previously. The preferred p-value threshold for defining signature genes was $p<10e-9$. When using leave-one-out cross-validation to estimate the prediction accuracy of the prediction rule with this particular threshold, the inventors accurately classified all the samples as shown in FIG. 4. This corresponds to a sensitivity of 100% and a specificity of 100%. Table 5 contains the average profiles of the preferred 1228 signature probe sets with $p<10e-9$ measured on the 20 benign and 74 malignant tissues of the training set. The probes with positive correlation are those which have increased expression in malignant tissues, those with negative correlation have increased expression in the benign tissues.

TABLE 4

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 1 | 1756.022.2-C_at | DMD | NM_000109 | Xp21.2 | 1756.022.2 | 10010.002.1 | 1756.22 | 1756.22 |
| 2 | 1756.029.1-D_at | DMD | NM_000110 | Xp21.2 | 1756.029.1 | 10010.004.1 | 1756.29 | 1756.29 |
| 3 | 1756.026.1-C_at | DMD | NM_000111 | Xp21.2 | 1756.026.1 | 10051.005.3 | 1756.26 | 1756.26 |
| 4 | 1756.022.4-T_at | DMD | NM_000112 | Xp21.2 | 1756.022.4 | 10051.008.1 | 1756.22 | 1756.22 |
| 5 | 1756.011.1-B_at | DMD | NM_000113 | Xp21.2 | 1756.011.1 | 10051.016.1 | 1756.11 | 1756.11 |
| 6 | 1308.008.1-C_at | COL17A1 | NM_000494 | 10q24.3 | 1308.008.1 | 10124.002.1 | 1308.8 | 1308.8 |
| 7 | 1756.022.3-F_at | DMD | NM_000114 | Xp21.2 | 1756.022.3 | 10124.003.1 | 1756.22 | 3861.20 |
| 8 | 3861.020.1-D_at | KRT14 | NM_000526 | 17q12-q21 | 3861.020.1 | 10124.004.2 | 3861.20 | 4629.7 |
| 9 | 1756.011.1-F_at | DMD | NM_000115 | Xp21.2 | 1756.011.1 | 10144.017.3 | 1756.11 | 1756.24 |
| 10 | 4629.007.1-F_at | MYH11 | NM_001040113 | 16p13.11 | 4629.007.1 | 10144.020.2 | 4629.7 | 3861.19 |
| 11 | 1756.022.4-B_at | DMD | NM_000116 | Xp21.2 | 1756.022.4 | 10144.021.1 | 1756.22 | 3861.1 |
| 12 | 1756.024.1-F_at | DMD | NM_000117 | Xp21.2 | 1756.024.1 | 10253.001.1 | 1756.24 | 4629.20 |
| 13 | 3861.019.1-T_at | KRT14 | NM_000526 | 17q12-q21 | 3861.019.1 | 10253.003.1 | 3861.19 | 1756.27 |
| 14 | 1756.026.1-T_at | DMD | NM_000118 | Xp21.2 | 1756.026.1 | 10253.004.1 | 1756.26 | 3861.13 |
| 15 | 1756.022.1-B_at | DMD | NM_000119 | Xp21.2 | 1756.022.1 | 1033.002.1 | 1756.22 | 3861.22 |
| 16 | 3861.001.1-T_at | KRT14 | NM_000526 | 17q12-q21 | 3861.001.1 | 10461.002.1 | 3861.1 | 3868.4 |
| 17 | 1308.008.1-T_at | COL17A1 | NM_000495 | 10q24.3 | 1308.008.1 | 10461.002.2 | 1308.8 | 4629.15 |
| 18 | 4629.020.1-C_at | MYH11 | NM_001040114 | 16p13.11 | 4629.020.1 | 1058.004.2 | 4629.20 | 6422.2 |
| 19 | 1756.027.1-T_at | DMD | NM_000120 | Xp21.2 | 1756.027.1 | 10580.012.1 | 1756.27 | 1308.3 |
| 20 | 3861.013.1-T_at | KRT14 | NM_000526 | 17q12-q21 | 3861.013.1 | 1062.001.6 | 3861.13 | 3868.5 |
| 21 | 4629.020.1-F_at | MYH11 | NM_001040115 | 16p13.11 | 4629.020.1 | 1063.001.1 | 4629.20 | 1308.7 |
| 22 | 3861.001.1-B_at | KRT14 | NM_000526 | 17q12-q21 | 3861.001.1 | 1063.002.1 | 3861.1 | 1308.9 |
| 23 | 1756.022.4-F_at | DMD | NM_000121 | Xp21.2 | 1756.022.4 | 11065.003.1 | 1756.22 | 3861.7 |
| 24 | 1756.026.1-F_at | DMD | NM_000122 | Xp21.2 | 1756.026.1 | 11065.004.1 | 1756.26 | 4629.16 |
| 25 | 1756.022.2-T_at | DMD | NM_000123 | Xp21.2 | 1756.022.2 | 11065.005.1 | 1756.22 | 3084.7 |
| 26 | 1756.022.2-F_at | DMD | NM_000124 | Xp21.2 | 1756.022.2 | 11065.005.2 | 1756.22 | 26289.3 |
| 27 | 3861.022.1-B_at | KRT14 | NM_000526 | 17q12-q21 | 3861.022.1 | 11065.008.1 | 3861.22 | 1756.28 |
| 28 | 3868.004.1-D_at | KRT16 | NM_005557 | 17q12-q21 | 3868.004.1 | 11065.009.1 | 3868.4 | 4629.21 |
| 29 | 4629.015.1-C_at | MYH11 | NM_001040116 | 16p13.11 | 4629.015.1 | 11197.001.1 | 4629.15 | 5764.1 |
| 30 | 6422.002.1-E_at | SFRP1 | NM_003012 | 8p12-p11.1 | 6422.002.1 | 115207.002.1 | 6422.2 | 3815.2 |
| 31 | 3861.001.1-D_at | KRT14 | NM_000526 | 17q12-q21 | 3861.001.1 | 115908.002.1 | 3861.1 | 3852.20 |
| 32 | 1756.022.1-F_at | DMD | NM_000125 | Xp21.2 | 1756.022.1 | 116369.006.4 | 1756.22 | 128553.3 |
| 33 | 1308.003.1-T_at | COL17A1 | NM_000496 | 10q24.3 | 1308.003.1 | 120.005.2 | 1308.3 | 4629.5 |
| 34 | 3868.005.1-B_at | KRT16 | NM_005557 | 17q12-q21 | 3868.005.1 | 1264.003.1 | 3868.5 | 4629.10 |
| 35 | 1308.007.1-F_at | COL17A1 | NM_000497 | 10q24.3 | 1308.007.1 | 1264.006.1 | 1308.7 | 6422.1 |
| 36 | 1308.009.1-F_at | COL17A1 | NM_000498 | 10q24.3 | 1308.009.1 | 1264.007.1 | 1308.9 | 3861.8 |
| 37 | 3861.007.1-E_at | KRT14 | NM_000526 | 17q12-q21 | 3861.007.1 | 128553.003.1 | 3861.7 | 1756.30 |
| 38 | 4629.016.1-D_at | MYH11 | NM_001040117 | 16p13.11 | 4629.016.1 | 130497.001.2 | 4629.16 | 3084.9 |
| 39 | 3084.007.1-F_at | NRG1 | NM_004495 | 8p12 | 3084.007.1 | 1308.001.1 | 3084.7 | 26289.2 |
| 40 | 3861.007.1-F_at | KRT14 | NM_000526 | 17q12-q21 | 3861.007.1 | 1308.002.1 | 3861.7 | 23336.1 |
| 41 | 26289.003.1-E_at | AK5 | NM_012093 | 1p31 | 26289.003.1 | 1308.003.1 | 26289.3 | 3852.12 |
| 42 | 1756.028.1-T_at | DMD | NM_000126 | Xp21.2 | 1756.028.1 | 1308.004.1 | 1756.28 | 26289.12 |
| 43 | 4629.021.1-E_at | MYH11 | NM_001040118 | 16p13.11 | 4629.021.1 | 1308.007.1 | 4629.21 | 23336.3 |
| 44 | 4629.020.1-D_at | MYH11 | NM_001040119 | 16p13.11 | 4629.020.1 | 1308.008.1 | 4629.20 | 26289.7 |
| 45 | 5764.001.1-F_at | PTN | NM_002825 | 7q33-q34 | 5764.001.1 | 1308.009.1 | 5764.1 | 84417.1 |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 46 | 3815.002.3-F_at | KIT | NM_000222 | 4q11-q12 | 3815.002.3 | 1398.001.1 | 3815.2 | 3861.18 |
| 47 | 3852.020.1-T_at | KRT5 | NM_000424 | 12q12-q13 | 3852.020.1 | 140446.004.1 | 3852.20 | 3852.4 |
| 48 | 4629.007.1-E_at | MYH11 | NM_001040120 | 16p13.11 | 4629.007.1 | 140807.003.1 | 4629.7 | 90865.6 |
| 49 | 128553.003.1-F | TSHZ2 | NM_173485 | 20q13.2 | 128553.003.1 | 140885.010.1 | 128553.3 | 1264.3 |
| 50 | 26289.003.1-F_at | AK5 | NM_012094 | 1p31 | 26289.003.1 | 140885.010.2 | 26289.3 | 26289.10 |
| 51 | 3815.002.2-F_at | KIT | NM_000223 | 4q11-q12 | 3815.002.2 | 140885.010.3 | 3815.2 | 1908.2 |
| 52 | 1756.029.1-B_at | DMD | NM_000127 | Xp21.2 | 1756.029.1 | 140885.011.1 | 1756.29 | 3852.8 |
| 53 | 4629.005.1-E_at | MYH11 | NM_001040121 | 16p13.11 | 4629.005.1 | 140885.013.1 | 4629.5 | 4915.11 |
| 54 | 4629.010.1-B_at | MYH11 | NM_001040122 | 16p13.11 | 4629.010.1 | 140885.014.1 | 4629.10 | 5288.1 |
| 55 | 6422.001.1-T_at | SFRP1 | NM_003012 | 8p12-p11.1 | 6422.001.1 | 1410.001.1 | 6422.1 | 3852.6 |
| 56 | 5764.001.1-E_at | PTN | NM_002825 | 7q33-q34 | 5764.001.1 | 1410.002.2 | 5764.1 | 9413.3 |
| 57 | 3861.008.1-F_at | KRT14 | NM_000526 | 17q12-q21 | 3861.008.1 | 1410.003.2 | 3861.8 | 3815.1 |
| 58 | 1756.030.2-T_at | DMD | NM_000128 | Xp21.2 | 1756.030.2 | 1410.004.2 | 1756.30 | 79937.1 |
| 59 | 3084.009.1-B_at | NRG1 | NM_004496 | 8p12 | 3084.009.1 | 1410.005.1 | 3084.9 | 4915.12 |
| 60 | 26289.002.1-T_at | AK5 | NM_012095 | 1p31 | 26289.002.1 | 1410.006.1 | 26289.2 | 26289.5 |
| 61 | 1756.022.5-B_at | DMD | NM_000129 | Xp21.2 | 1756.022.5 | 1410.007.1 | 1756.22 | 4311.9 |
| 62 | 4629.007.1-D_at | MYH11 | NM_001040123 | 16p13.11 | 4629.007.1 | 1410.007.2 | 4629.7 | 26289.6 |
| 63 | 23336.001.1-C_at | DMN | NM_015286 | 15q26.3 | 23336.001.1 | 1410.008.1 | 23336.1 | 5288.3 |
| 64 | 1308.003.1-D_at | COL17A1 | NM_000499 | 10q24.3 | 1308.003.1 | 1410.009.1 | 1308.3 | 26289.4 |
| 65 | 1756.022.3-T_at | DMD | NM_000130 | Xp21.2 | 1756.022.3 | 1410.010.1 | 1756.22 | 79192.2 |
| 66 | 3861.020.1-T_at | KRT14 | NM_000526 | 17q12-q21 | 3861.020.1 | 1410.011.1 | 3861.20 | 4638.6 |
| 67 | 3861.022.1-C_at | KRT14 | NM_000526 | 17q12-q21 | 3861.022.1 | 147495.005.1 | 3861.22 | 3084.8 |
| 68 | 3852.012.2-B_at | KRT5 | NM_000424 | 12q12-q13 | 3852.012.2 | 147495.006.1 | 3852.12 | 4311.1 |
| 69 | 26289.012.1-E_at | AK5 | NM_012096 | 1p31 | 26289.012.1 | 147495.008.1 | 26289.12 | 3852.22 |
| 70 | 23336.003.1-T_at | DMN | NM_015287 | 15q26.3 | 23336.003.1 | 147495.009.1 | 23336.3 | 23194.3 |
| 71 | 26289.007.1-B_at | AK5 | NM_012097 | 1p31 | 26289.007.1 | 147804.004.1 | 26289.7 | 65983.9 |
| 72 | 84417.001.1-T_at | C2orf40 | NM_032411 | 2q12.2 | 84417.001.1 | 152015.004.1 | 84417.1 | 1410.7 |
| 73 | 3861.018.1-D_at | KRT14 | NM_000526 | 17q12-q21 | 3861.018.1 | 152015.005.2 | 3861.18 | 7373.3 |
| 74 | 3852.004.1-B_at | KRT5 | NM_000424 | 12q12-q13 | 3852.004.1 | 162605.001.4 | 3852.4 | 10010.2 |
| 75 | 90865.006.1-B_at | IL33 | NM_033439 | 9p24.1 | 90865.006.1 | 1717.007.1 | 90865.6 | 59.26 |
| 76 | 4629.021.1-F_at | MYH11 | NM_001040124 | 16p13.11 | 4629.021.1 | 1717.009.2 | 4629.21 | 3872.7 |
| 77 | 3861.018.1-T_at | KRT14 | NM_000526 | 17q12-q21 | 3861.018.1 | 1756.002.2 | 3861.18 | 84668.2 |
| 78 | 1756.022.1-T_at | DMD | NM_000131 | Xp21.2 | 1756.022.1 | 1756.003.1 | 1756.22 | 1756.2 |
| 79 | 1264.003.1-B_at | CNN1 | NM_001299 | 19p13.2-p13.1 | 1264.003.1 | 1756.009.1 | 1264.3 | 57447.33 |
| 80 | 26289.010.1-E_at | AK5 | NM_012098 | 1p31 | 26289.010.1 | 1756.011.1 | 26289.10 | 26289.9 |
| 81 | 3861.001.1-F_at | KRT14 | NM_000526 | 17q12-q21 | 3861.001.1 | 1756.013.1 | 3861.1 | 3872.6 |
| 82 | 1908.002.1-T_at | EDN3 | NM_001729 | 20q13.2-q13.3 | 1908.002.1 | 1756.022.1 | 1908.2 | 667.21 |
| 83 | 4629.007.1-C_at | MYH11 | NM_001040125 | 16p13.11 | 4629.007.1 | 1756.022.2 | 4629.7 | 57447.27 |
| 84 | 1756.022.5-T_at | DMD | NM_000132 | Xp21.2 | 1756.022.5 | 1756.022.3 | 1756.22 | 56477.1 |
| 85 | 3815.002.4-B_at | KIT | NM_000224 | 4q11-q12 | 3815.002.4 | 1756.022.4 | 3815.2 | 26289.8 |
| 86 | 1756.022.2-B_at | DMD | NM_000133 | Xp21.2 | 1756.022.2 | 1756.022.5 | 1756.22 | 59.24 |
| 87 | 1756.027.1-B_at | DMD | NM_000134 | Xp21.2 | 1756.027.1 | 1756.024.1 | 1756.27 | 3084.4 |
| 88 | 3852.008.2-T_at | KRT5 | NM_000424 | 12q12-q13 | 3852.008.2 | 1756.026.1 | 3852.8 | 27122.14 |
| 89 | 6422.001.1-E_at | SFRP1 | NM_003012 | 8p12-p11.1 | 6422.001.1 | 1756.027.1 | 6422.1 | 286887.3 |
| 90 | 3861.022.1-F_at | KRT14 | NM_000526 | 17q12-q21 | 3861.022.1 | 1756.028.1 | 3861.22 | 3872.9 |
| 91 | 4915.011.1-D_at | NTRK2 | NM_001007097 | 9q22.1 | 4915.011.1 | 1756.029.1 | 4915.11 | 59.14 |
| 92 | 5288.001.1-F_at | PIK3C2G | NM_004570 | 12p12 | 5288.001.1 | 1756.030.2 | 5288.1 | 403340.1 |
| 93 | 3861.007.1-F_at | KRT14 | NM_000526 | 17q12-q21 | 3861.007.1 | 1908.001.1 | 3861.7 | 3852.14 |
| 94 | 3852.006.1-C_at | KRT5 | NM_000424 | 12q12-q13 | 3852.006.1 | 1908.002.1 | 3852.6 | 27122.1 |
| 95 | 9413.003.1-T_at | C9orf61 | NM_004816 | 9q21 | 9413.003.1 | 1959.002.1 | 9413.3 | 8626.5 |
| 96 | 3861.020.1-C_at | KRT14 | NM_000526 | 17q12-q21 | 3861.020.1 | 1959.003.1 | 3861.20 | 84668.4 |
| 97 | 1308.008.1-D_at | COL17A1 | NM_000500 | 10q24.3 | 1308.008.1 | 2.002.1 | 1308.8 | 57447.31 |
| 98 | 23336.001.1-T_at | DMN | NM_015288 | 15q26.3 | 23336.001.1 | 2.005.1 | 23336.1 | 3084.12 |
| 99 | 3815.001.1-F_at | KIT | NM_000225 | 4q11-q12 | 3815.001.1 | 2.013.1 | 3815.1 | 3852.5 |
| 100 | 1756.022.5-F_at | DMD | NM_000135 | Xp21.2 | 1756.022.5 | 2.018.1 | 1756.22 | 3866.3 |
| 101 | 79937.001.1-T_at | CNTNAP3 | NM_033655 | 9p13.1 | 79937.001.1 | 2.022.1 | 79937.1 | 3866.8 |
| 102 | 4915.012.1-E_at | NTRK2 | NM_001007098 | 9q22.1 | 4915.012.1 | 2.024.1 | 4915.12 | 3852.9 |
| 103 | 3861.022.1-T_at | KRT14 | NM_000526 | 17q12-q21 | 3861.022.1 | 2.025.1 | 3861.22 | 59.15 |
| 104 | 26289.005.1-T_at | AK5 | NM_012099 | 1p31 | 26289.005.1 | 2115.001.2 | 26289.5 | 79937.2 |
| 105 | 3815.002.3-B_at | KIT | NM_000226 | 4q11-q12 | 3815.002.3 | 2115.003.1 | 3815.2 | 7153.2 |
| 106 | 4311.009.1-F_at | MME | NM_000902 | 3q25.1-q25.2 | 4311.009.1 | 2115.006.1 | 4311.9 | 4281.10 |
| 107 | 26289.006.1-T_at | AK5 | NM_012100 | 1p31 | 26289.006.1 | 2115.007.1 | 26289.6 | 59.8 |
| 108 | 5288.003.1-F_at | PIK3C2G | NM_004570 | 12p12 | 5288.003.1 | 2115.008.1 | 5288.3 | 1264.7 |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 109 | 4629.020.1-B_at | MYH11 | NM_001040126 | 16p13.11 | 4629.020.1 | 2115.011.1 | 4629.20 | 3084.2 |
| 110 | 26289.007.1-D_at | AK5 | NM_012101 | 1p31 | 26289.007.1 | 2115.012.1 | 26289.7 | 5137.4 |
| 111 | 3815.002.1-B_at | KIT | NM_000227 | 4q11-q12 | 3815.002.1 | 2115.014.1 | 3815.2 | 4629.22 |
| 112 | 26289.004.1-T_at | AK5 | NM_012102 | 1p31 | 26289.004.1 | 2115.015.1 | 26289.4 | 3852.13 |
| 113 | 79192.002.2-T_at | IRX1 | NM_024337 | 5p15.3 | 79192.002.2 | 2119.005.1 | 79192.2 | 59.12 |
| 114 | 4638.006.1-D_at | MYLK | NM_005965 | 3q21 | 4638.006.1 | 2119.006.1 | 4638.6 | 23336.2 |
| 115 | 3084.008.1-F_at | NRG1 | NM_004497 | 8p12 | 3084.008.1 | 221120.006.1 | 3084.8 | 3866.11 |
| 116 | 4311.001.2-T_at | MME | NM_000903 | 3q25.1-q25.2 | 4311.001.2 | 2232.014.1 | 4311.1 | 59.31 |
| 117 | 3815.002.1-D_at | KIT | NM_000228 | 4q11-q12 | 3815.002.1 | 22974.007.1 | 3815.2 | 57447.30 |
| 118 | 4629.020.1-T_at | MYH11 | NM_001040127 | 16p13.11 | 4629.020.1 | 22974.008.1 | 4629.20 | 1410.3 |
| 119 | 1756.026.1-B_at | DMD | NM_000136 | Xp21.2 | 1756.026.1 | 23092.004.1 | 1756.26 | 3866.9 |
| 120 | 3852.022.1-T_at | KRT5 | NM_000424 | 12q12-q13 | 3852.022.1 | 23194.003.1 | 3852.22 | 440421.1 |
| 121 | 4629.015.1-D_at | MYH11 | NM_001040128 | 16p13.11 | 4629.015.1 | 23266.001.3 | 4629.15 | 57447.41 |
| 122 | 26289.007.1-C_at | AK5 | NM_012103 | 1p31 | 26289.007.1 | 23266.008.1 | 26289.7 | 3872.10 |
| 123 | 23194.003.1-C_at | FBXL7 | NM_012304 | 5p15.1 | 23194.003.1 | 23266.008.2 | 23194.3 | 4629.6 |
| 124 | 3815.002.1-F_at | KIT | NM_000229 | 4q11-q12 | 3815.002.1 | 2327.002.1 | 3815.2 | 3866.12 |
| 125 | 26289.007.1-T_at | AK5 | NM_012104 | 1p31 | 26289.007.1 | 2327.002.2 | 26289.7 | 57447.21 |
| 126 | 65983.009.1-B_at | GRAMD3 | NM_023927 | 5q23.2 | 65983.009.1 | 2327.003.4 | 65983.9 | 8626.7 |
| 127 | 23336.001.1-F_at | DMN | NM_015289 | 15q26.3 | 23336.001.1 | 23284.007.1 | 23336.1 | 72.1 |
| 128 | 1410.007.2-B_at | CRYAB | NM_001885 | 11q22.3-q23.1 | 1410.007.2 | 23321.014.1 | 1410.7 | 3866.6 |
| 129 | 1756.029.1-F_at | DMD | NM_000137 | Xp21.2 | 1756.029.1 | 23336.001.1 | 1756.29 | 65983.8 |
| 130 | 7373.003.6-C_at | COL14A1 | NM_021110 | 8q23 | 7373.003.6 | 23336.002.1 | 7373.3 | 65983.13 |
| 131 | 10010.002.1-E_at | TANK | NM_004180 | 2q24-q31 | 10010.002.1 | 23336.003.1 | 10010.2 | 27122.7 |
| 132 | 59.026.1-B_at | ACTA2 | NM_001613 | 10q23.3 | 59.026.1 | 2335.002.1 | 59.26 | 59.9 |
| 133 | 4915.011.1-F_at | NTRK2 | NM_001007099 | 9q22.1 | 4915.011.1 | 2335.005.1 | 4915.11 | 59.23 |
| 134 | 3872.007.1-D_at | KRT17 | NM_000422 | 17q12-q21 | 3872.007.1 | 2335.006.1 | 3872.7 | 1908.1 |
| 135 | 26289.002.1-D_at | AK5 | NM_012105 | 1p31 | 26289.002.1 | 2335.006.2 | 26289.2 | 4915.8 |
| 136 | 84668.002.1-C_at | FAM126A | NM_032581 | 7p15.3 | 84668.002.1 | 2335.009.1 | 84668.2 | 57447.35 |
| 137 | 1756.002.2-T_at | DMD | NM_000138 | Xp21.2 | 1756.002.2 | 2335.013.1 | 1756.2 | 667.22 |
| 138 | 57447.033.1-C_at | NDRG2 | NM_016250 | 14q11.2 | 57447.033.1 | 2335.016.1 | 57447.33 | 2115.1 |
| 139 | 26289.009.1-E_at | AK5 | NM_012106 | 1p31 | 26289.009.1 | 2335.017.1 | 26289.9 | 27303.4 |
| 140 | 3872.006.1-F_at | KRT17 | NM_000422 | 17q12-q21 | 3872.006.1 | 2335.024.2 | 3872.6 | 59.3 |
| 141 | 3861.022.1-D_at | KRT14 | NM_000526 | 17q12-q21 | 3861.022.1 | 2335.025.1 | 3861.22 | 65983.4 |
| 142 | 3861.020.1-B_at | KRT14 | NM_000526 | 17q12-q21 | 3861.020.1 | 2335.025.3 | 3861.20 | 26289.13 |
| 143 | 667.021.1-B_at | DST | NM_001723 | 6p12.1 | 667.021.1 | 2335.027.1 | 667.21 | 3866.4 |
| 144 | 57447.027.1-F_at | NDRG2 | NM_016251 | 14q11.2 | 57447.027.1 | 2335.028.1 | 57447.27 | 57447.37 |
| 145 | 56477.001.1-D_at | CCL28 | NM_148672 | 5p12 | 56477.001.1 | 2335.032.1 | 56477.1 | 59.22 |
| 146 | 26289.008.1-F_at | AK5 | NM_012107 | 1p31 | 26289.008.1 | 2335.035.1 | 26289.8 | 147495.8 |
| 147 | 59.024.2-D_at | ACTA2 | NM_001613 | 10q23.3 | 59.024.2 | 2335.045.1 | 59.24 | 2.18 |
| 148 | 4629.005.1-T_at | MYH11 | NM_001040129 | 16p13.11 | 4629.005.1 | 2335.053.1 | 4629.5 | 140807.3 |
| 149 | 3815.002.1-T_at | KIT | NM_000230 | 4q11-q12 | 3815.002.1 | 23650.003.1 | 3815.2 | 2115.8 |
| 150 | 23336.001.1-B_at | DMN | NM_015290 | 15q26.3 | 23336.001.1 | 23650.005.1 | 23336.1 | 57447.34 |
| 151 | 3084.004.2-F_at | NRG1 | NM_004498 | 8p12 | 3084.004.2 | 23650.011.1 | 3084.4 | 3866.1 |
| 152 | 27122.014.2-T_at | DKK3 | NM_001018057 | 11p15.2 | 27122.014.2 | 23650.011.2 | 27122.14 | 1959.3 |
| 153 | 26289.008.1-C_at | AK5 | NM_012108 | 1p31 | 26289.008.1 | 23650.019.1 | 26289.8 | 389432.2 |
| 154 | 286887.003.2-B | KRT6C | NM_173086 | 12q13.13 | 286887.003.2 | 23650.020.1 | 286887.3 | 389734.1 |
| 155 | 4629.005.1-F_at | MYH11 | NM_001040130 | 16p13.11 | 4629.005.1 | 24137.004.1 | 4629.5 | 3855.1 |
| 156 | 3872.009.1-T_at | KRT17 | NM_000422 | 17q12-q21 | 3872.009.1 | 244.003.1 | 3872.9 | 3084.6 |
| 157 | 59.014.2-D_at | ACTA2 | NM_001613 | 10q23.3 | 59.014.2 | 244.011.1 | 59.14 | 2115.11 |
| 158 | 403340.001.2-B | MGC70870 | NM_203481 | — | 403340.001.2 | 244.012.1 | 403340.1 | 65983.5 |
| 159 | 3852.014.1-F_at | KRT5 | NM_000424 | 12q12-q13 | 3852.014.1 | 2487.001.1 | 3852.14 | 2119.6 |
| 160 | 27122.001.1-T_at | DKK3 | NM_001018058 | 11p15.2 | 27122.001.1 | 2568.001.1 | 27122.1 | 3866.7 |
| 161 | 3815.002.3-T_at | KIT | NM_000231 | 4q11-q12 | 3815.002.3 | 2568.001.2 | 3815.2 | 3866.13 |
| 162 | 3852.008.1-E_at | KRT5 | NM_000424 | 12q12-q13 | 3852.008.1 | 2568.002.1 | 3852.8 | 27122.13 |
| 163 | 26289.012.1-T_at | AK5 | NM_012109 | 1p31 | 26289.012.1 | 2568.002.2 | 26289.12 | 27122.6 |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 164 | 26289.007.1-F_at | AK5 | NM_012110 | 1p31 | 26289.007.1 | 2568.003.1 | 26289.7 | 4240.4 |
| 165 | 4638.006.1-T_at | MYLK | NM_005966 | 3q21 | 4638.006.1 | 2568.003.2 | 4638.6 | 3866.10 |
| 166 | 8626.005.1-B_at | TP63 | NM_003722 | 3q28 | 8626.005.1 | 2568.005.1 | 8626.5 | 7018.29 |
| 167 | 3815.002.4-T_at | KIT | NM_000232 | 4q11-q12 | 3815.002.4 | 2568.005.2 | 3815.2 | 1410.2 |
| 168 | 84668.004.1-F_at | FAM126A | NM_032581 | 7p15.3 | 84668.004.1 | 2568.006.1 | 84668.4 | 59.34 |
| 169 | 3872.007.1-F_at | KRT17 | NM_000422 | 17q12-q21 | 3872.007.1 | 25802.003.1 | 3872.7 | 27122.19 |
| 170 | 57447.031.1-E_at | NDRG2 | NM_016252 | 14q11.2 | 57447.031.1 | 25802.004.1 | 57447.31 | 5156.1 |
| 171 | 3084.012.3-T_at | NRG1 | NM_004499 | 8p12 | 3084.012.3 | 25802.008.1 | 3084.12 | 57447.10 |
| 172 | 3852.005.1-T_at | KRT5 | NM_000424 | 12q12-q13 | 3852.005.1 | 2582.007.2 | 3852.5 | 358.18 |
| 173 | 84417.001.2-T_at | C2orf40 | NM_032411 | 2q12.2 | 84417.001.2 | 25925.001.1 | 84417.1 | 7373.1 |
| 174 | 3866.003.2-T_at | KRT15 | NM_002275 | 17q21.2 | 3866.003.2 | 25925.006.1 | 3866.3 | 57447.29 |
| 175 | 3866.008.1-C_at | KRT15 | NM_002275 | 17q21.2 | 3866.008.1 | 25925.007.1 | 3866.8 | 79068.10 |
| 176 | 3852.009.1-F_at | KRT5 | NM_000424 | 12q12-q13 | 3852.009.1 | 25925.008.1 | 3852.9 | 59.4 |
| 177 | 59.015.1-B_at | ACTA2 | NM_001613 | 10q23.3 | 59.015.1 | 25925.009.1 | 59.15 | 2115.12 |
| 178 | 79937.002.1-F_at | CNTNAP3 | NM_033655 | 9p13.1 | 79937.002.1 | 25925.011.1 | 79937.2 | 2115.7 |
| 179 | 7153.002.6-F_at | TOP2A | NM_001067 | 17q21-q22 | 7153.002.6 | 259266.003.1 | 7153.2 | 59.40 |
| 180 | 4281.010.1-B_at | MID1 | NM_000381 | Xp22 | 4281.010.1 | 26289.002.1 | 4281.10 | 130497.1 |
| 181 | 59.008.1-B_at | ACTA2 | NM_001613 | 10q23.3 | 59.008.1 | 26289.003.1 | 59.8 | 140885.14 |
| 182 | 1264.007.1-T_at | CNN1 | NM_001299 | 19p13.2-p13.1 | 1264.007.1 | 26289.004.1 | 1264.7 | 3866.5 |
| 183 | 3868.004.1-T_at | KRT16 | NM_005557 | 17q12-q21 | 3868.004.1 | 26289.005.1 | 3868.4 | 8404.28 |
| 184 | 3084.002.1-F_at | NRG1 | NM_004500 | 8p12 | 3084.002.1 | 26289.006.1 | 3084.2 | 3860.7 |
| 185 | 5137.004.2-T_at | PDE1C | NM_005020 | 7p15.1-p14.3 | 5137.004.2 | 26289.007.1 | 5137.4 | 4638.3 |
| 186 | 4629.022.1-T_at | MYH11 | NM_001040131 | 16p13.11 | 4629.022.1 | 26289.008.1 | 4629.22 | 25925.8 |
| 187 | 4915.011.1-T_at | NTRK2 | NM_001007100 | 9q22.1 | 4915.011.1 | 26289.009.1 | 4915.11 | 23650.11 |
| 188 | 3852.013.1-E_at | KRT5 | NM_000424 | 12q12-q13 | 3852.013.1 | 26289.010.1 | 3852.13 | 3852.17 |
| 189 | 59.012.2-T_at | ACTA2 | NM_001613 | 10q23.3 | 59.012.2 | 26289.012.1 | 59.12 | 4915.5 |
| 190 | 59.015.1-F_at | ACTA2 | NM_001613 | 10q23.3 | 59.015.1 | 26289.013.1 | 59.15 | 1756.3 |
| 191 | 4638.006.2-T_at | MYLK | NM_005967 | 3q21 | 4638.006.2 | 2707.002.1 | 4638.6 | 4638.14 |
| 192 | 23336.002.1-B_at | DMN | NM_015291 | 15q26.3 | 23336.002.1 | 27122.001.1 | 23336.2 | 2707.2 |
| 193 | 3868.005.1-C_at | KRT16 | NM_005557 | 17q12-q21 | 3868.005.1 | 27122.002.1 | 3868.5 | 4638.11 |
| 194 | 3866.011.2-D_at | KRT15 | NM_002275 | 17q21.2 | 3866.011.2 | 27122.006.1 | 3866.11 | 7373.2 |
| 195 | 56477.001.1-T_at | CCL28 | NM_148672 | 5p12 | 56477.001.1 | 27122.006.2 | 56477.1 | 5608.2 |
| 196 | 3815.001.1-T_at | KIT | NM_000233 | 4q11-q12 | 3815.001.1 | 27122.007.1 | 3815.1 | 1756.13 |
| 197 | 4311.001.1-T_at | MME | NM_000904 | 3q25.1-q25.2 | 4311.001.1 | 27122.013.1 | 4311.1 | 2115.6 |
| 198 | 1264.003.1-D_at | CNN1 | NM_001299 | 19p13.2-p13.1 | 1264.003.1 | 27122.014.1 | 1264.3 | 6376.1 |
| 199 | 59.031.1-T_at | ACTA2 | NM_001613 | 10q23.3 | 59.031.1 | 27122.014.2 | 59.31 | 8404.2 |
| 200 | 57447.030.1-B_at | NDRG2 | NM_016253 | 14q11.2 | 57447.030.1 | 27122.016.1 | 57447.30 | 1264.6 |
| 201 | 1410.003.2-B_at | CRYAB | NM_001885 | 11q22.3-q23.1 | 1410.003.2 | 27122.017.1 | 1410.3 | 25925.1 |
| 202 | 3866.009.2-D_at | KRT15 | NM_002275 | 17q21.2 | 3866.009.2 | 27122.018.1 | 3866.9 | 8404.35 |
| 203 | 59.026.1-T_at | ACTA2 | NM_001613 | 10q23.3 | 59.026.1 | 27122.019.1 | 59.26 | 2.22 |
| 204 | 440421.001.1-T | | | | 440421.001.1 | 27303.004.1 | 440421.1 | 27122.16 |
| 205 | 1756.022.4-D_at | DMD | NM_000139 | Xp21.2 | 1756.022.4 | 2824.001.2 | 1756.22 | 57447.25 |
| 206 | 65983.009.1-D_at | GRAMD3 | NM_023927 | 5q23.2 | 65983.009.1 | 285203.001.2 | 65983.9 | 1717.7 |
| 207 | 57447.041.1-T_at | NDRG2 | NM_016254 | 14q11.2 | 57447.041.1 | 286887.003.2 | 57447.41 | 9768.4 |
| 208 | 3872.010.2-D_at | KRT17 | NM_000422 | 17q12-q21 | 3872.010.2 | 2893.002.2 | 3872.10 | 1410.4 |
| 209 | 4629.006.2-T_at | MYH11 | NM_001040132 | 16p13.11 | 4629.006.2 | 2893.006.2 | 4629.6 | 2327.2 |
| 210 | 3861.018.1-F_at | KRT14 | NM_000526 | 17q12-q21 | 3861.018.1 | 29089.001.1 | 3861.18 | 1308.4 |
| 211 | 3815.002.2-T_at | KIT | NM_000234 | 4q11-q12 | 3815.002.2 | 29089.003.1 | 3815.2 | 2568.5 |
| 212 | 3866.012.2-D_at | KRT15 | NM_002275 | 17q21.2 | 3866.012.2 | 29127.002.1 | 3866.12 | 2568.1 |
| 213 | 57447.021.1-D_at | NDRG2 | NM_016255 | 14q11.2 | 57447.021.1 | 29127.007.1 | 57447.21 | 2893.6 |
| 214 | 59.015.1-T_at | ACTA2 | NM_001613 | 10q23.3 | 59.015.1 | 29127.013.1 | 59.15 | 3872.16 |
| 215 | 8626.007.1-F_at | TP63 | NM_003722 | 3q28 | 8626.007.1 | 29127.019.1 | 8626.7 | 9413.6 |
| 216 | 5288.001.1-B_at | PIK3C2G | NM_004570 | 12p12 | 5288.001.1 | 29127.019.2 | 5288.1 | 72.5 |
| 217 | 72.001.1-B_at | ACTG2 | NM_001615 | 2p13.1 | 72.001.1 | 29127.022.1 | 72.1 | 27122.18 |
| 218 | 3866.006.2-D_at | KRT15 | NM_002275 | 17q21.2 | 3866.006.2 | 2938.001.1 | 3866.6 | 7153.5 |
| 219 | 3852.004.1-T_at | KRT5 | NM_000424 | 12q12-q13 | 3852.004.1 | 2982.002.1 | 3852.4 | 7018.26 |
| 220 | 4629.016.1-F_at | MYH11 | NM_001040133 | 16p13.11 | 4629.016.1 | 2982.012.1 | 4629.16 | 7402.14 |
| 221 | 4629.007.1-T_at | MYH11 | NM_001040134 | 16p13.11 | 4629.007.1 | 2982.013.2 | 4629.7 | 140446.4 |
| 222 | 65983.008.1-T_at | GRAMD3 | NM_023927 | 5q23.2 | 65983.008.1 | 2982.014.1 | 65983.8 | 59.38 |
| 223 | 65983.013.1-F_at | GRAMD3 | NM_023927 | 5q23.2 | 65983.013.1 | 2982.015.1 | 65983.13 | 4240.9 |
| 224 | 3084.004.1-F_at | NRG1 | NM_004501 | 8p12 | 3084.004.1 | 2995.001.1 | 3084.4 | 57447.8 |
| 225 | 27122.007.1-F_at | DKK3 | NM_001018059 | 11p15.2 | 27122.007.1 | 29997.008.1 | 27122.7 | 2582.7 |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 226 | 3866.008.1-D_at | KRT15 | NM_002275 | 17q21.2 | 3866.008.1 | 29997.012.1 | 3866.8 | 4638.9 |
| 227 | 26289.009.1-T_at | AK5 | NM_012111 | 1p31 | 26289.009.1 | 29997.016.1 | 26289.9 | 3861.23 |
| 228 | 59.009.1-B_at | ACTA2 | NM_001613 | 10q23.3 | 59.009.1 | 301.004.1 | 59.9 | 5858.3 |
| 229 | 4629.010.1-D_at | MYH11 | NM_001040135 | 16p13.11 | 4629.010.1 | 301.005.1 | 4629.10 | 147495.5 |
| 230 | 59.023.1-B_at | ACTA2 | NM_001613 | 10q23.3 | 59.023.1 | 301.008.1 | 59.23 | 4915.4 |
| 231 | 26289.002.1-F_at | AK5 | NM_012112 | 1p31 | 26289.002.1 | 301.013.1 | 26289.2 | 8626.2 |
| 232 | 1908.001.1-T_at | EDN3 | NM_001730 | 20q13.2-q13.3 | 1908.001.1 | 301.015.1 | 1908.1 | 59.42 |
| 233 | 4915.008.1-F_at | NTRK2 | NM_001007101 | 9q22.1 | 4915.008.1 | 3084.002.1 | 4915.8 | 4833.4 |
| 234 | 23336.002.1-T_at | DMN | NM_015292 | 15q26.3 | 23336.002.1 | 3084.004.1 | 23336.2 | 2568.6 |
| 235 | 3861.008.1-C_at | KRT14 | NM_000526 | 17q12-q21 | 3861.008.1 | 3084.004.2 | 3861.8 | 57447.4 |
| 236 | 3861.008.1-D_at | KRT14 | NM_000526 | 17q12-q21 | 3861.008.1 | 3084.005.1 | 3861.8 | 27122.17 |
| 237 | 57447.035.1-E_at | NDRG2 | NM_016256 | 14q11.2 | 57447.035.1 | 3084.006.1 | 57447.35 | 59.33 |
| 238 | 3861.018.1-C_at | KRT14 | NM_000526 | 17q12-q21 | 3861.018.1 | 3084.007.1 | 3861.18 | 27122.2 |
| 239 | 1308.003.1-B_at | COL17A1 | NM_000501 | 10q24.3 | 1308.003.1 | 3084.008.1 | 1308.3 | 3880.11 |
| 240 | 667.022.1-B_at | DST | NM_001724 | 6p12.1 | 667.022.1 | 3084.009.1 | 667.22 | 3872.14 |
| 241 | 3866.011.2-T_at | KRT15 | NM_002275 | 17q21.2 | 3866.011.2 | 3084.010.1 | 3866.11 | 162605.1 |
| 242 | 2115.001.2-F_at | ETV1 | NM_004956 | 7p21.3 | 2115.001.2 | 3084.011.1 | 2115.1 | 5858.1 |
| 243 | 3866.011.2-B_at | KRT15 | NM_002275 | 17q21.2 | 3866.011.2 | 3084.012.1 | 3866.11 | 65983.10 |
| 244 | 26289.010.1-T_at | AK5 | NM_012113 | 1p31 | 26289.010.1 | 3084.012.2 | 26289.10 | 8404.5 |
| 245 | 27303.004.1-E_at | RBMS3 | NM_001003792 | 3p24-p23 | 27303.004.1 | 3084.012.3 | 27303.4 | 2487.1 |
| 246 | 59.003.1-B_at | ACTA2 | NM_001613 | 10q23.3 | 59.003.1 | 3178.003.1 | 59.3 | 147495.9 |
| 247 | 4311.009.1-C_at | MME | NM_000905 | 3q25.1-q25.2 | 4311.009.1 | 3204.001.1 | 4311.9 | 65983.3 |
| 248 | 7373.003.6-B_at | COL14A1 | NM_021110 | 8q23 | 7373.003.6 | 338707.006.1 | 7373.3 | 1717.9 |
| 249 | 65983.004.1-T_at | GRAMD3 | NM_023927 | 5q23.2 | 65983.004.1 | 339965.001.2 | 65983.4 | 140885.11 |
| 250 | 26289.013.1-D_at | AK5 | NM_012114 | 1p31 | 26289.013.1 | 3426.001.1 | 26289.13 | 3832.2 |
| 251 | 3866.004.1-F_at | KRT15 | NM_002275 | 17q21.2 | 3866.004.1 | 3426.002.1 | 3866.4 | 3880.5 |
| 252 | 56477.001.1-F_at | CCL28 | NM_148672 | 5p12 | 56477.001.1 | 3426.002.2 | 56477.1 | 6595.12 |
| 253 | 57447.037.1-F_at | NDRG2 | NM_016257 | 14q11.2 | 57447.037.1 | 3459.005.1 | 57447.37 | 9768.5 |
| 254 | 59.022.2-T_at | ACTA2 | NM_001613 | 10q23.3 | 59.022.2 | 3479.003.1 | 59.22 | 285203.1 |
| 255 | 147495.008.1-F | APCDD1 | NM_153000 | 18p11.22 | 147495.008.1 | 358.012.1 | 147495.8 | 147495.6 |
| 256 | 2.018.1-T_at | A2M | NM_000014 | 12p13.3-p12.3 | 2.018.1 | 358.018.1 | 2.18 | 1959.2 |
| 257 | 140807.003.1-E | KRT72 | NM_080747 | 12q13.13 | 140807.003.1 | 3815.001.1 | 140807.3 | 7018.14 |
| 258 | 65983.009.1-T_at | GRAMD3 | NM_023927 | 5q23.2 | 65983.009.1 | 3815.002.1 | 65983.9 | 5858.4 |
| 259 | 84668.002.1-F_at | FAM126A | NM_032581 | 7p15.3 | 84668.002.1 | 3815.002.2 | 84668.2 | 8404.8 |
| 260 | 3872.007.1-C_at | KRT17 | NM_000422 | 17q12-q21 | 3872.007.1 | 3815.002.3 | 3872.7 | 4240.11 |
| 261 | 2115.008.1-T_at | ETV1 | NM_004956 | 7p21.3 | 2115.008.1 | 3815.002.4 | 2115.8 | 94274.2 |
| 262 | 65983.004.2-T_at | GRAMD3 | NM_023927 | 5q23.2 | 65983.004.2 | 3832.002.1 | 65983.4 | 4638.15 |
| 263 | 57447.034.1-D_at | NDRG2 | NM_016258 | 14q11.2 | 57447.034.1 | 3852.004.1 | 57447.34 | 57447.43 |
| 264 | 3866.001.1-F_at | KRT15 | NM_002275 | 17q21.2 | 3866.001.1 | 3852.005.1 | 3866.1 | 59.39 |
| 265 | 3866.008.1-T_at | KRT15 | NM_002275 | 17q21.2 | 3866.008.1 | 3852.006.1 | 3866.8 | 25802.3 |
| 266 | 1959.003.1-C_at | EGR2 | NM_000399 | 10q21.1 | 1959.003.1 | 3852.008.1 | 1959.3 | 57447.17 |
| 267 | 389432.002.1-T | SAMD5 | NM_001030060 | 6q24.3 | 389432.002.1 | 3852.008.2 | 389432.2 | 7018.28 |
| 268 | 389734.001.1-T | | | | 389734.001.1 | 3852.009.1 | 389734.1 | 57447.12 |
| 269 | 3855.001.2-D_at | KRT7 | NM_005556 | 12q12-q13 | 3855.001.2 | 3852.012.2 | 3855.1 | 57447.6 |
| 270 | 3866.003.1-T_at | KRT15 | NM_002275 | 17q21.2 | 3866.003.1 | 3852.013.1 | 3866.3 | 9493.6 |
| 271 | 3084.006.1-F_at | NRG1 | NM_004502 | 8p12 | 3084.006.1 | 3852.014.1 | 3084.6 | 9493.4 |
| 272 | 4915.008.1-B_at | NTRK2 | NM_001007102 | 9q22.1 | 4915.008.1 | 3852.017.1 | 4915.8 | 7169.15 |
| 273 | 2115.011.1-T_at | ETV1 | NM_004956 | 7p21.3 | 2115.011.1 | 3852.020.1 | 2115.11 | 57451.1 |
| 274 | 65983.005.1-T_at | GRAMD3 | NM_023927 | 5q23.2 | 65983.005.1 | 3852.021.1 | 65983.5 | 8404.4 |
| 275 | 84668.004.1-T_at | FAM126A | NM_032581 | 7p15.3 | 84668.004.1 | 3852.022.1 | 84668.4 | 3855.4 |
| 276 | 59.015.2-T_at | ACTA2 | NM_001613 | 10q23.3 | 59.015.2 | 3852.023.1 | 59.15 | 9452.1 |
| 277 | 2119.006.1-B_at | ETV5 | NM_004454 | 3q28 | 2119.006.1 | 3855.001.2 | 2119.6 | 57447.40 |
| 278 | 4638.006.2-F_at | MYLK | NM_005968 | 3q21 | 4638.006.2 | 3855.004.2 | 4638.6 | 3426.1 |
| 279 | 3866.007.2-D_at | KRT15 | NM_002275 | 17q21.2 | 3866.007.2 | 3860.007.1 | 3866.7 | 10253.1 |
| 280 | 59.014.1-T_at | ACTA2 | NM_001613 | 10q23.3 | 59.014.1 | 3860.008.1 | 59.14 | 9073.1 |
| 281 | 3866.001.2-F_at | KRT15 | NM_002275 | 17q21.2 | 3866.001.2 | 3861.001.1 | 3866.1 | 51201.5 |
| 282 | 1308.008.1-B_at | COL17A1 | NM_000502 | 10q24.3 | 1308.008.1 | 3861.007.1 | 1308.8 | 9477.6 |
| 283 | 59.026.1-F_at | ACTA2 | NM_001613 | 10q23.3 | 59.026.1 | 3861.008.1 | 59.26 | 57447.28 |
| 284 | 3866.013.1-T_at | KRT15 | NM_002275 | 17q21.2 | 3866.013.1 | 3861.013.1 | 3866.13 | 25925.7 |
| 285 | 1264.007.1-F_at | CNN1 | NM_001299 | 19p13.2-p13.1 | 1264.007.1 | 3861.018.1 | 1264.7 | 4281.8 |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 286 | 3866.007.2-T_at | KRT15 | NM_002275 | 17q21.2 | 3866.007.2 | 3861.019.1 | 3866.7 | 90231.1 |
| 287 | 27122.013.1-T_at | DKK3 | NM_001018060 | 11p15.2 | 27122.013.1 | 3861.020.1 | 27122.13 | 358.12 |
| 288 | 27122.006.2-T_at | DKK3 | NM_001018061 | 11p15.2 | 27122.006.2 | 3861.022.1 | 27122.6 | 3852.21 |
| 289 | 3866.006.2-T_at | KRT15 | NM_002275 | 17q21.2 | 3866.006.2 | 3861.023.1 | 3866.6 | 57447.48 |
| 290 | 3866.009.2-T_at | KRT15 | NM_002275 | 17q21.2 | 3866.009.2 | 3866.001.1 | 3866.9 | 7018.25 |
| 291 | 4240.004.1-D_at | MFGE8 | NM_005928 | 15q25 | 4240.004.1 | 3866.001.2 | 4240.4 | 5608.4 |
| 292 | 3866.010.1-C_at | KRT15 | NM_002275 | 17q21.2 | 3866.010.1 | 3866.002.1 | 3866.10 | 4306.2 |
| 293 | 3866.009.2-B_at | KRT15 | NM_002275 | 17q21.2 | 3866.009.2 | 3866.003.1 | 3866.9 | 4288.4 |
| 294 | 3866.009.1-T_at | KRT15 | NM_002275 | 17q21.2 | 3866.009.1 | 3866.003.2 | 3866.9 | 57447.2 |
| 295 | 4629.006.1-T_at | MYH11 | NM_001040136 | 16p13.11 | 4629.006.1 | 3866.004.1 | 4629.6 | 4281.18 |
| 296 | 7018.029.1-B_at | TF | NM_001063 | 3q22.1 | 7018.029.1 | 3866.005.1 | 7018.29 | 10144.20 |
| 297 | 1410.002.2-B_at | CRYAB | NM_001885 | 11q22.3-q23.1 | 1410.002.2 | 3866.006.1 | 1410.2 | 6876.16 |
| 298 | 3866.012.1-T_at | KRT15 | NM_002275 | 17q21.2 | 3866.012.1 | 3866.006.2 | 3866.12 | 51203.4 |
| 299 | 59.034.2-D_at | ACTA2 | NM_001613 | 10q23.3 | 59.034.2 | 3866.007.1 | 59.34 | 2335.28 |
| 300 | 27122.019.1-F_at | DKK3 | NM_001018062 | 11p15.2 | 27122.019.1 | 3866.007.2 | 27122.19 | 81557.6 |
| 301 | 5156.001.1-T_at | PDGFRA | NM_006206 | 4q11-q13 | 5156.001.1 | 3866.008.1 | 5156.1 | 3866.2 |
| 302 | 389734.001.2-T | | | | 389734.001.2 | 3866.009.1 | 389734.1 | 55107.6 |
| 303 | 27122.014.1-T_at | DKK3 | NM_001018063 | 11p15.2 | 27122.014.1 | 3866.009.2 | 27122.14 | 57447.9 |
| 304 | 57447.010.3-T_at | NDRG2 | NM_016259 | 14q11.2 | 57447.010.3 | 3866.010.1 | 57447.10 | 2115.15 |
| 305 | 358.018.1-F_at | AQP1 | NM_198098 | 7p14 | 358.018.1 | 3866.011.1 | 358.18 | 8404.1 |
| 306 | 3866.006.1-T_at | KRT15 | NM_002275 | 17q21.2 | 3866.006.1 | 3866.011.2 | 3866.6 | 57447.24 |
| 307 | 7373.001.1-T_at | COL14A1 | NM_021110 | 8q23 | 7373.001.1 | 3866.012.1 | 7373.1 | 79608.2 |
| 308 | 26289.012.1-B_at | AK5 | NM_012115 | 1p31 | 26289.012.1 | 3866.012.2 | 26289.12 | 8404.23 |
| 309 | 57447.029.1-T_at | NDRG2 | NM_016260 | 14q11.2 | 57447.029.1 | 3866.013.1 | 57447.29 | 3426.2 |
| 310 | 358.018.1-B_at | AQP1 | NM_198098 | 7p14 | 358.018.1 | 3868.004.1 | 358.18 | 2335.27 |
| 311 | 79068.010.1-B_at | FTO | NM_001080432 | 16q12.2 | 79068.010.1 | 3868.005.1 | 79068.10 | 11065.9 |
| 312 | 59.024.1-B_at | ACTA2 | NM_001613 | 10q23.3 | 59.024.1 | 3872.005.1 | 59.24 | 140885.13 |
| 313 | 59.004.1-B_at | ACTA2 | NM_001613 | 10q23.3 | 59.004.1 | 3872.006.1 | 59.4 | 25802.4 |
| 314 | 3866.011.1-T_at | KRT15 | NM_002275 | 17q21.2 | 3866.011.1 | 3872.007.1 | 3866.11 | 5156.5 |
| 315 | 3866.013.1-E_at | KRT15 | NM_002275 | 17q21.2 | 3866.013.1 | 3872.009.1 | 3866.13 | 25802.8 |
| 316 | 3866.010.1-D_at | KRT15 | NM_002275 | 17q21.2 | 3866.010.1 | 3872.010.2 | 3866.10 | 7169.22 |
| 317 | 59.004.1-T_at | ACTA2 | NM_001613 | 10q23.3 | 59.004.1 | 3872.014.1 | 59.4 | 23266.1 |
| 318 | 2115.012.1-T_at | ETV1 | NM_004956 | 7p21.3 | 2115.012.1 | 3872.016.1 | 2115.12 | 29127.19 |
| 319 | 2.018.1-D_at | A2M | NM_000014 | 12p13.3-p12.3 | 2.018.1 | 3872.018.1 | 2.18 | 10253.4 |
| 320 | 2115.007.1-T_at | ETV1 | NM_004956 | 7p21.3 | 2115.007.1 | 3880.005.1 | 2115.7 | 10124.2 |
| 321 | 59.040.1-T_at | ACTA2 | NM_001613 | 10q23.3 | 59.040.1 | 3880.011.1 | 59.40 | 8404.32 |
| 322 | 130497.001.2-T | OSR1 | NM_145260 | 2p24.1 | 130497.001.2 | 389432.002.1 | 130497.1 | 84441.2 |
| 323 | 140885.014.1-T | SIRPA | NM_001040022 | 20p15 | 140885.014.1 | 389734.001.1 | 140885.14 | 2.13 |
| 324 | 3866.005.1-F_at | KRT15 | NM_002275 | 17q21.2 | 3866.005.1 | 389734.002.1 | 3866.5 | 2.24 |
| 325 | 7373.003.3-F_at | COL14A1 | NM_021110 | 8q23 | 7373.003.3 | 399687.001.1 | 7373.3 | 1756.9 |
| 326 | 8404.028.1-F_at | SPARCL1 | NM_004684 | 4q22.1 | 8404.028.1 | 403340.001.2 | 8404.28 | 7091.14 |
| 327 | 3860.007.1-D_at | KRT13 | NM_002274 | 17q12-q21.2 | 3860.007.1 | 4094.001.1 | 3860.7 | 115207.2 |
| 328 | 4638.003.1-C_at | MYLK | NM_005969 | 3q21 | 4638.003.1 | 4094.002.1 | 4638.3 | 4281.1 |
| 329 | 3872.009.1-E_at | KRT17 | NM_000422 | 17q12-q21 | 3872.009.1 | 4147.004.1 | 3872.9 | 57447.44 |
| 330 | 59.004.2-T_at | ACTA2 | NM_001613 | 10q23.3 | 59.004.2 | 4147.005.2 | 59.4 | 8626.6 |
| 331 | 3872.006.1-C_at | KRT17 | NM_000422 | 17q12-q21 | 3872.006.1 | 4147.011.1 | 3872.6 | 57447.51 |
| 332 | 3866.005.1-C_at | KRT15 | NM_002275 | 17q21.2 | 3866.005.1 | 4147.012.1 | 3866.5 | 1063.1 |
| 333 | 25925.008.1-T_at | ZNF521 | NM_015461 | 18q11.2 | 25925.008.1 | 4240.001.1 | 25925.8 | 1308.1 |
| 334 | 23650.011.2-T_at | TRIM29 | NM_012101 | 11q22-q23 | 23650.011.2 | 4240.004.1 | 23650.11 | 2115.14 |
| 335 | 3866.012.2-T_at | KRT15 | NM_002275 | 17q21.2 | 3866.012.2 | 4240.009.1 | 3866.12 | 5284.4 |
| 336 | 3852.017.1-D_at | KRT5 | NM_000424 | 12q12-q13 | 3852.017.1 | 4240.011.1 | 3852.17 | 2982.2 |
| 337 | 4915.005.1-T_at | NTRK2 | NM_001007103 | 9q22.1 | 4915.005.1 | 4240.011.3 | 4915.5 | 57447.47 |
| 338 | 4638.003.1-B_at | MYLK | NM_005970 | 3q21 | 4638.003.1 | 4240.015.1 | 4638.3 | 5803.6 |
| 339 | 1756.003.1-B_at | DMD | NM_000140 | Xp21.2 | 1756.003.1 | 4281.001.1 | 1756.3 | 57447.39 |
| 340 | 4638.006.1-F_at | MYLK | NM_005971 | 3q21 | 4638.006.1 | 4281.008.2 | 4638.6 | 6876.11 |
| 341 | 57447.035.1-F_at | NDRG2 | NM_016261 | 14q11.2 | 57447.035.1 | 4281.009.1 | 57447.35 | 9768.2 |
| 342 | 4638.014.1-T_at | MYLK | NM_005972 | 3q21 | 4638.014.1 | 4281.010.1 | 4638.14 | 140885.10 |
| 343 | 7373.003.4-T_at | COL14A1 | NM_021110 | 8q23 | 7373.003.4 | 4281.012.1 | 7373.3 | 4638.20 |
| 344 | 27122.014.2-D_at | DKK3 | NM_001018064 | 11p15.2 | 27122.014.2 | 4281.012.2 | 27122.14 | 7373.4 |
| 345 | 3866.007.1-T_at | KRT15 | NM_002275 | 17q21.2 | 3866.007.1 | 4281.014.1 | 3866.7 | 4281.15 |
| 346 | 2707.002.1-E_at | GJB3 | NM_001005752 | 1p34 | 2707.002.1 | 4281.015.1 | 2707.2 | 8404.13 |
| 347 | 59.024.1-T_at | ACTA2 | NM_001613 | 10q23.3 | 59.024.1 | 4281.018.1 | 59.24 | 90293.1 |
| 348 | 23650.011.1-T_at | TRIM29 | NM_012101 | 11q22-q23 | 23650.011.1 | 4281.023.1 | 23650.11 | 2335.6 |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 349 | 4638.011.1-F_at | MYLK | NM_005973 | 3q21 | 4638.011.1 | 4288.004.1 | 4638.11 | 57447.22 |
| 350 | 7373.002.1-F_at | COL14A1 | NM_021110 | 8q23 | 7373.002.1 | 4288.005.1 | 7373.2 | 8404.30 |
| 351 | 3866.013.1-F_at | KRT15 | NM_002275 | 17q21.2 | 3866.013.1 | 4288.006.1 | 3866.13 | 5803.2 |
| 352 | 5608.002.1-T_at | MAP2K6 | NM_002758 | 17q24.3 | 5608.002.1 | 4288.006.2 | 5608.2 | 84441.5 |
| 353 | 3866.001.1-C_at | KRT15 | NM_002275 | 17q21.2 | 3866.001.1 | 4288.007.1 | 3866.1 | 7091.15 |
| 354 | 1756.013.1-B_at | DMD | NM_000141 | Xp21.2 | 1756.013.1 | 4288.008.1 | 1756.13 | 2119.5 |
| 355 | 2115.006.1-E_at | ETV1 | NM_004956 | 7p21.3 | 2115.006.1 | 4288.009.1 | 2115.6 | 79608.8 |
| 356 | 6376.001.2-F_at | CX3CL1 | NM_002996 | 16q13 | 6376.001.2 | 4306.002.1 | 6376.1 | 8404.22 |
| 357 | 3084.004.1-B_at | NRG1 | NM_004503 | 8p12 | 3084.004.1 | 4311.001.1 | 3084.4 | 8404.34 |
| 358 | 3815.002.4-F_at | KIT | NM_000235 | 4q11-q12 | 3815.002.4 | 4311.001.2 | 3815.2 | 57447.49 |
| 359 | 8404.002.1-D_at | SPARCL1 | NM_004684 | 4q22.1 | 8404.002.1 | 4311.009.1 | 8404.2 | 5311.2 |
| 360 | 1264.006.1-T_at | CNN1 | NM_001299 | 19p13.2-p13.1 | 1264.006.1 | 440421.001.1 | 1264.6 | 2335.25 |
| 361 | 59.022.2-D_at | ACTA2 | NM_001613 | 10q23.3 | 59.022.2 | 4601.014.1 | 59.22 | 4147.12 |
| 362 | 25925.001.1-T_at | ZNF521 | NM_015461 | 18q11.2 | 25925.001.1 | 4629.005.1 | 25925.1 | 301.15 |
| 363 | 4638.006.2-B_at | MYLK | NM_005974 | 3q21 | 4638.006.2 | 4629.006.1 | 4638.6 | 301.4 |
| 364 | 7373.003.5-B_at | COL14A1 | NM_021110 | 8q23 | 7373.003.5 | 4629.006.2 | 7373.3 | 7091.1 |
| 365 | 8404.035.1-B_at | SPARCL1 | NM_004684 | 4q22.1 | 8404.035.1 | 4629.007.1 | 8404.35 | 8404.21 |
| 366 | 59.012.1-T_at | ACTA2 | NM_001613 | 10q23.3 | 59.012.1 | 4629.010.1 | 59.12 | 53335.2 |
| 367 | 3852.017.1-T_at | KRT5 | NM_000424 | 12q12-q13 | 3852.017.1 | 4629.015.1 | 3852.17 | 5284.3 |
| 368 | 3866.012.1-B_at | KRT15 | NM_002275 | 17q21.2 | 3866.012.1 | 4629.016.1 | 3866.12 | 23650.20 |
| 369 | 2.022.1-B_at | A2M | NM_000014 | 12p13.3-p12.3 | 2.022.1 | 4629.020.1 | 2.22 | 57447.42 |
| 370 | 27122.016.1-F_at | DKK3 | NM_001018065 | 11p15.2 | 27122.016.1 | 4629.021.1 | 27122.16 | 6876.23 |
| 371 | 4311.009.1-B_at | MME | NM_000906 | 3q25.1-q25.2 | 4311.009.1 | 4629.022.1 | 4311.9 | 6876.2 |
| 372 | 59.031.2-T_at | ACTA2 | NM_001613 | 10q23.3 | 59.031.2 | 4638.003.1 | 59.31 | 65983.7 |
| 373 | 4311.009.1-T_at | MME | NM_000907 | 3q25.1-q25.2 | 4311.009.1 | 4638.006.1 | 4311.9 | 152015.4 |
| 374 | 3866.006.2-B_at | KRT15 | NM_002275 | 17q21.2 | 3866.006.2 | 4638.006.2 | 3866.6 | 6285.1 |
| 375 | 57447.025.2-T_at | NDRG2 | NM_016262 | 14q11.2 | 57447.025.2 | 4638.009.1 | 57447.25 | 6289.5 |
| 376 | 1717.007.1-F_at | DHCR7 | NM_001360 | 11q13.2-q13.5 | 1717.007.1 | 4638.011.1 | 1717.7 | 9232.2 |
| 377 | 59.004.2-D_at | ACTA2 | NM_001613 | 10q23.3 | 59.004.2 | 4638.014.1 | 59.4 | 3084.11 |
| 378 | 3866.007.2-B_at | KRT15 | NM_002275 | 17q21.2 | 3866.007.2 | 4638.015.1 | 3866.7 | 3872.5 |
| 379 | 3866.010.1-F_at | KRT15 | NM_002275 | 17q21.2 | 3866.010.1 | 4638.020.1 | 3866.10 | 81704.8 |
| 380 | 9768.004.1-D_at | KIAA0101 | NM_001029989 | 15q22.31 | 9768.004.1 | 4744.004.1 | 9768.4 | 338707.6 |
| 381 | 3084.012.2-T_at | NRG1 | NM_004504 | 8p12 | 3084.012.2 | 4751.002.1 | 3084.12 | 23266.8 |
| 382 | 1410.004.2-B_at | CRYAB | NM_001885 | 11q22.3-q23.1 | 1410.004.2 | 4781.002.2 | 1410.4 | 120.5 |
| 383 | 59.008.1-D_at | ACTA2 | NM_001613 | 10q23.3 | 59.008.1 | 4781.006.2 | 59.8 | 4281.9 |
| 384 | 57447.030.1-C_at | NDRG2 | NM_016263 | 14q11.2 | 57447.030.1 | 4781.007.1 | 57447.30 | 4094.1 |
| 385 | 2327.002.1-D_at | FMO2 | NM_001460 | 1q23-q25 | 2327.002.1 | 4781.014.2 | 2327.2 | 2995.1 |
| 386 | 1308.004.1-B_at | COL17A1 | NM_000503 | 10q24.3 | 1308.004.1 | 4781.015.2 | 1308.4 | 2335.17 |
| 387 | 2568.005.2-B_at | GABRP | NM_014211 | 5q33-q34 | 2568.005.2 | 4781.016.1 | 2568.5 | 5284.1 |
| 388 | 2568.001.1-T_at | GABRP | NM_014211 | 5q33-q34 | 2568.001.1 | 4833.004.1 | 2568.1 | 8404.26 |
| 389 | 3084.004.2-T_at | NRG1 | NM_004505 | 8p12 | 3084.004.2 | 4833.010.1 | 3084.4 | 2335.9 |
| 390 | 7373.003.4-B_at | COL14A1 | NM_021110 | 8q23 | 7373.003.4 | 4915.004.1 | 7373.3 | 10461.2 |
| 391 | 7153.002.2-D_at | TOP2A | NM_001067 | 17q21-q22 | 7153.002.2 | 4915.005.1 | 7153.2 | 7091.10 |
| 392 | 2893.006.2-T_at | GRIA4 | NM_000829 | 11q22 | 2893.006.2 | 4915.008.1 | 2893.6 | 79895.1 |
| 393 | 3872.016.1-D_at | KRT17 | NM_000422 | 17q12-q21 | 3872.016.1 | 4915.011.1 | 3872.16 | 57447.38 |
| 394 | 9413.006.1-F_at | C9orf61 | NM_004816 | 9q13-q21 | 9413.006.1 | 4915.012.1 | 9413.6 | 7373.8 |
| 395 | 59.023.2-B_at | ACTA2 | NM_001613 | 10q23.3 | 59.023.2 | 501.006.1 | 59.23 | 4744.4 |
| 396 | 72.005.1-B_at | ACTG2 | NM_001615 | 2p13.1 | 72.005.1 | 51062.008.1 | 72.5 | 8404.15 |
| 397 | 4915.011.1-C_at | NTRK2 | NM_001007104 | 9q22.1 | 4915.011.1 | 51201.005.1 | 4915.11 | 4281.14 |
| 398 | 27122.018.1-F_at | DKK3 | NM_001018066 | 11p15.2 | 27122.018.1 | 51201.007.1 | 27122.18 | 4288.6 |
| 399 | 3852.006.1-B_at | KRT5 | NM_000424 | 12q12-q13 | 3852.006.1 | 51203.002.2 | 3852.6 | 25925.9 |
| 400 | 4638.006.2-D_at | MYLK | NM_005975 | 3q21 | 4638.006.2 | 51203.003.1 | 4638.6 | 667.10 |
| 401 | 7153.005.1-E_at | TOP2A | NM_001067 | 17q21-q22 | 7153.005.1 | 51203.004.1 | 7153.5 | 57447.11 |
| 402 | 7373.001.2-T_at | COL14A1 | NM_021110 | 8q23 | 7373.001.2 | 51203.009.1 | 7373.1 | 8404.24 |
| 403 | 7018.026.1-B_at | TF | NM_001063 | 3q22.1 | 7018.026.1 | 5137.004.2 | 7018.26 | 57447.32 |
| 404 | 7402.014.1-B_at | UTRN | NM_007124 | 6q24 | 7402.014.1 | 5156.001.1 | 7402.14 | 51062.8 |
| 405 | 57447.010.3-D_at | NDRG2 | NM_016264 | 14q11.2 | 57447.010.3 | 5156.005.1 | 57447.10 | 2335.13 |
| 406 | 140446.004.1-T | | | | 140446.004.1 | 5213.024.1 | 140446.4 | 7170.5 |
| 407 | 59.026.2-T_at | ACTA2 | NM_001613 | 10q23.3 | 59.026.2 | 5284.001.1 | 59.26 | 2568.3 |
| 408 | 59.038.1-B_at | ACTA2 | NM_001613 | 10q23.3 | 59.038.1 | 5284.003.1 | 59.38 | 9898.15 |
| 409 | 4240.009.1-C_at | MFGE8 | NM_005928 | 15q25 | 4240.009.1 | 5284.003.2 | 4240.9 | 7018.13 |
| 410 | 57447.030.1-F_at | NDRG2 | NM_016265 | 14q11.2 | 57447.030.1 | 5284.004.1 | 57447.30 | 7170.34 |
| 411 | 9768.004.1-B_at | KIAA0101 | NM_001029990 | 15q22.31 | 9768.004.1 | 5288.001.1 | 9768.4 | 2.2 |
| 412 | 57447.008.1-T_at | NDRG2 | NM_016266 | 14q11.2 | 57447.008.1 | 5288.001.2 | 57447.8 | 57447.50 |
| 413 | 59.014.2-T_at | ACTA2 | NM_001613 | 10q23.3 | 59.014.2 | 5288.001.3 | 59.14 | 2335.32 |
| 414 | 4915.012.1-T_at | NTRK2 | NM_001007105 | 9q22.1 | 4915.012.1 | 5288.003.1 | 4915.12 | 51203.3 |
| 415 | 3866.004.1-T_at | KRT15 | NM_002275 | 17q21.2 | 3866.004.1 | 5311.002.1 | 3866.4 | 9493.1 |
| 416 | 2582.007.2-C_at | GALE | NM_000403 | 1p36-p35 | 2582.007.2 | 5311.003.1 | 2582.7 | 80034.3 |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 417 | 7153.002.5-T_at | TOP2A | NM_001067 | 17q21-q22 | 7153.002.5 | 53335.002.1 | 7153.2 | 7170.16 |
| 418 | 4638.009.1-T_at | MYLK | NM_005976 | 3q21 | 4638.009.1 | 53829.001.2 | 4638.9 | 57447.26 |
| 419 | 3861.023.1-T_at | KRT14 | NM_000526 | 17q12-q21 | 3861.023.1 | 54443.006.2 | 3861.23 | 301.8 |
| 420 | 5858.003.3-C_at | PZP | NM_002864 | 12p13-p12.2 | 5858.003.3 | 54443.011.1 | 5858.3 | 80034.2 |
| 421 | 3861.020.1-F_at | KRT14 | NM_000526 | 17q12-q21 | 3861.020.1 | 54443.012.1 | 3861.20 | 3852.23 |
| 422 | 147495.005.1-T | APCDD1 | NM_153000 | 18p11.22 | 147495.005.1 | 54443.013.1 | 147495.5 | 10124.3 |
| 423 | 4638.006.2-C_at | MYLK | NM_005977 | 3q21 | 4638.006.2 | 54829.001.1 | 4638.6 | 23650.19 |
| 424 | 1308.004.1-F_at | COL17A1 | NM_000504 | 10q24.3 | 1308.004.1 | 54928.003.1 | 1308.4 | 7170.27 |
| 425 | 4915.004.1-F_at | NTRK2 | NM_001007106 | 9q22.1 | 4915.004.1 | 54997.002.1 | 4915.4 | 54928.3 |
| 426 | 3866.008.1-B_at | KRT15 | NM_002275 | 17q21.2 | 3866.008.1 | 55107.006.2 | 3866.8 | 3084.10 |
| 427 | 8626.002.1-E_at | TP63 | NM_003722 | 3q28 | 8626.002.1 | 55366.001.1 | 8626.2 | 2115.3 |
| 428 | 1264.003.1-T_at | CNN1 | NM_001299 | 19p13.2-p13.1 | 1264.003.1 | 55366.001.2 | 1264.3 | 8404.9 |
| 429 | 59.042.1-F_at | ACTA2 | NM_001613 | 10q23.3 | 59.042.1 | 55656.007.3 | 59.42 | 6289.3 |
| 430 | 4833.004.1-C_at | NME4 | NM_005009 | 16p13.3 | 4833.004.1 | 55732.003.2 | 4833.4 | 7170.25 |
| 431 | 2568.006.1-B_at | GABRP | NM_014211 | 5q33-q34 | 2568.006.1 | 5608.002.1 | 2568.6 | 22974.7 |
| 432 | 57447.004.2-T_at | NDRG2 | NM_016267 | 14q11.2 | 57447.004.2 | 5608.004.1 | 57447.4 | 4147.11 |
| 433 | 59.014.2-B_at | ACTA2 | NM_001613 | 10q23.3 | 59.014.2 | 5621.002.2 | 59.14 | 23650.3 |
| 434 | 3084.012.1-T_at | NRG1 | NM_004506 | 8p12 | 3084.012.1 | 5621.008.1 | 3084.12 | 64168.10 |
| 435 | 27122.017.1-T_at | DKK3 | NM_001018067 | 11p15.2 | 27122.017.1 | 5627.002.1 | 27122.17 | 25925.11 |
| 436 | 3852.012.2-T_at | KRT5 | NM_000424 | 12q12-q13 | 3852.012.2 | 56477.001.1 | 3852.12 | 9232.4 |
| 437 | 59.033.1-T_at | ACTA2 | NM_001613 | 10q23.3 | 59.033.1 | 57162.010.1 | 59.33 | 4147.5 |
| 438 | 27122.002.1-C_at | DKK3 | NM_001018068 | 11p15.2 | 27122.002.1 | 57447.002.1 | 27122.2 | 147804.4 |
| 439 | 3880.011.1-B_at | KRT19 | NM_002276 | 17q21.2 | 3880.011.1 | 57447.004.1 | 3880.11 | 81704.13 |
| 440 | 65983.013.1-T_at | GRAMD3 | NM_023927 | 5q23.2 | 65983.013.1 | 57447.004.2 | 65983.13 | 54443.13 |
| 441 | 3872.014.1-T_at | KRT17 | NM_000422 | 17q12-q21 | 3872.014.1 | 57447.006.1 | 3872.14 | 1410.5 |
| 442 | 162605.001.4-C | KRT28 | NM_181535 | 17q21.2 | 162605.001.4 | 57447.008.1 | 162605.1 | 3204.1 |
| 443 | 59.031.2-B_at | ACTA2 | NM_001613 | 10q23.3 | 59.031.2 | 57447.008.2 | 59.31 | 29997.12 |
| 444 | 3084.012.2-B_at | NRG1 | NM_004507 | 8p12 | 3084.012.2 | 57447.009.1 | 3084.12 | 2.5 |
| 445 | 5858.001.2-C_at | PZP | NM_002864 | 12p13-p12.2 | 5858.001.2 | 57447.010.1 | 5858.1 | 1063.2 |
| 446 | 65983.010.1-T_at | GRAMD3 | NM_023927 | 5q23.2 | 65983.010.1 | 57447.010.2 | 65983.10 | 10144.21 |
| 447 | 7373.003.5-F_at | COL14A1 | NM_021110 | 8q23 | 7373.003.5 | 57447.010.3 | 7373.3 | 8404.25 |
| 448 | 3866.010.1-T_at | KRT15 | NM_002275 | 17q21.2 | 3866.010.1 | 57447.011.1 | 3866.10 | 6876.20 |
| 449 | 8404.005.1-B_at | SPARCL1 | NM_004684 | 4q22.1 | 8404.005.1 | 57447.012.1 | 8404.5 | 7170.6 |
| 450 | 3866.005.1-T_at | KRT15 | NM_002275 | 17q21.2 | 3866.005.1 | 57447.012.2 | 3866.5 | 10051.16 |
| 451 | 59.003.1-F_at | ACTA2 | NM_001613 | 10q23.3 | 59.003.1 | 57447.017.1 | 59.3 | 5627.2 |
| 452 | 7153.002.5-F_at | TOP2A | NM_001067 | 17q21-q22 | 7153.002.5 | 57447.021.1 | 7153.2 | 399687.1 |
| 453 | 2487.001.1-T_at | FRZB | NM_001463 | 2qter | 2487.001.1 | 57447.022.1 | 2487.1 | 54997.2 |
| 454 | 3866.010.1-B_at | KRT15 | NM_002275 | 17q21.2 | 3866.010.1 | 57447.024.1 | 3866.10 | 57561.1 |
| 455 | 147495.009.1-T | APCDD1 | NM_153000 | 18p11.22 | 147495.009.1 | 57447.025.1 | 147495.9 | 8404.31 |
| 456 | 65983.003.2-T_at | GRAMD3 | NM_023927 | 5q23.2 | 65983.003.2 | 57447.025.2 | 65983.3 | 2.25 |
| 457 | 59.040.1-D_at | ACTA2 | NM_001613 | 10q23.3 | 59.040.1 | 57447.026.1 | 59.40 | 699.2 |
| 458 | 59.024.2-T_at | ACTA2 | NM_001613 | 10q23.3 | 59.024.2 | 57447.027.1 | 59.24 | 9055.13 |
| 459 | 1717.009.2-B_at | DHCR7 | NM_001360 | 11q13.2-q13.5 | 1717.009.2 | 57447.028.1 | 1717.9 | 10051.5 |
| 460 | 1756.027.1-F_at | DMD | NM_000142 | Xp21.2 | 1756.027.1 | 57447.029.1 | 1756.27 | 2568.2 |
| 461 | 59.042.1-B_at | ACTA2 | NM_001613 | 10q23.3 | 59.042.1 | 57447.030.1 | 59.42 | 4147.4 |
| 462 | 7153.002.5-D_at | TOP2A | NM_001067 | 17q21-q22 | 7153.002.5 | 57447.031.1 | 7153.2 | 2938.1 |
| 463 | 57447.031.1-F_at | NDRG2 | NM_016268 | 14q11.2 | 57447.031.1 | 57447.032.1 | 57447.31 | 2982.12 |
| 464 | 140885.011.1-C | SIRPA | NM_001040023 | 20p13 | 140885.011.1 | 57447.033.1 | 140885.11 | 2893.2 |
| 465 | 59.003.1-T_at | ACTA2 | NM_001613 | 10q23.3 | 59.003.1 | 57447.034.1 | 59.3 | 116369.6 |
| 466 | 3832.002.1-D_at | KIF11 | NM_004523 | 10q24.1 | 3832.002.1 | 57447.035.1 | 3832.2 | 6304.7 |
| 467 | 3880.005.1-D_at | KRT19 | NM_002276 | 17q21.2 | 3880.005.1 | 57447.037.1 | 3880.5 | 2335.35 |
| 468 | 3084.012.1-F_at | NRG1 | NM_004508 | 8p12 | 3084.012.1 | 57447.038.1 | 3084.12 | 4751.2 |
| 469 | 6595.012.1-B_at | SMARCA2 | NM_003070 | 9p22.3 | 6595.012.1 | 57447.039.1 | 6595.12 | 64151.1 |
| 470 | 59.012.2-D_at | ACTA2 | NM_001613 | 10q23.3 | 59.012.2 | 57447.040.1 | 59.12 | 29089.3 |
| 471 | 57447.034.1-C_at | NDRG2 | NM_016269 | 14q11.2 | 57447.034.1 | 57447.041.1 | 57447.34 | 3860.8 |
| 472 | 56477.001.1-B_at | CCL28 | NM_148672 | 5p12 | 56477.001.1 | 57447.042.1 | 56477.1 | 25925.6 |
| 473 | 57447.041.1-D_at | NDRG2 | NM_016270 | 14q11.2 | 57447.041.1 | 57447.043.1 | 57447.41 | 59.49 |
| 474 | 9768.005.1-B_at | KIAA0101 | NM_001029991 | 15q22.31 | 9768.005.1 | 57447.044.1 | 9768.5 | 6289.2 |
| 475 | 285203.001.2-C | C3orf64 | NM_173654 | 3p14.1 | 285203.001.2 | 57447.047.1 | 285203.1 | 244.3 |
| 476 | 147495.006.1-B | APCDD1 | NM_153000 | 18p11.22 | 147495.006.1 | 57447.048.1 | 147495.6 | 11065.8 |
| 477 | 7018.029.1-D_at | TF | NM_001063 | 3q22.1 | 7018.029.1 | 57447.048.2 | 7018.29 | 7091.6 |
| 478 | 3852.009.1-T_at | KRT5 | NM_000424 | 12q12-q13 | 3852.009.1 | 57447.049.1 | 3852.9 | 79608.9 |
| 479 | 59.023.2-D_at | ACTA2 | NM_001613 | 10q23.3 | 59.023.2 | 57447.050.1 | 59.23 | 9413.2 |
| 480 | 1959.002.1-D_at | EGR2 | NM_000399 | 10q21.1 | 1959.002.1 | 57447.051.1 | 1959.2 | 7431.64 |
| 481 | 7018.014.1-D_at | TF | NM_001063 | 3q22.1 | 7018.014.1 | 57447.051.2 | 7018.14 | 8404.29 |
| 482 | 5858.004.1-F_at | PZP | NM_002864 | 12p13-p12.2 | 5858.004.1 | 57451.001.3 | 5858.4 | 301.5 |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 483 | 79192.002.2-D_at | IRX1 | NM_024337 | 5p15.3 | 79192.002.2 | 57451.002.3 | 79192.2 | 9055.14 |
| 484 | 59.008.2-B_at | ACTA2 | NM_001613 | 10q23.3 | 59.008.2 | 57451.004.1 | 59.8 | 4281.23 |
| 485 | 8404.008.1-E_at | SPARCL1 | NM_004684 | 4q22.1 | 8404.008.1 | 57561.001.1 | 8404.8 | 1062.1 |
| 486 | 59.008.1-F_at | ACTA2 | NM_001613 | 10q23.3 | 59.008.1 | 57561.002.1 | 59.8 | 5858.5 |
| 487 | 4240.011.1-B_at | MFGE8 | NM_005928 | 15q25 | 4240.011.1 | 5764.001.1 | 4240.11 | 51201.7 |
| 488 | 94274.002.1-C_at | PPP1R14A | NM_033256 | 19q13.1 | 94274.002.1 | 5803.002.1 | 94274.2 | 4240.1 |
| 489 | 4638.015.1-T_at | MYLK | NM_005978 | 3q21 | 4638.015.1 | 5803.002.2 | 4638.15 | 9413.1 |
| 490 | 6376.001.1-T_at | CX3CL1 | NM_002996 | 16q13 | 6376.001.1 | 5803.006.1 | 6376.1 | 11197.1 |
| 491 | 57447.043.1-F_at | NDRG2 | NM_016271 | 14q11.2 | 57447.043.1 | 58499.005.2 | 57447.43 | 6285.2 |
| 492 | 59.039.1-T_at | ACTA2 | NM_001613 | 10q23.3 | 59.039.1 | 5858.001.2 | 59.39 | 7169.1 |
| 493 | 4638.006.1-B_at | MYLK | NM_005979 | 3q21 | 4638.006.1 | 5858.003.3 | 4638.6 | 4601.14 |
| 494 | 25802.003.1-F_at | LMOD1 | NM_012134 | 1q32 | 25802.003.1 | 5858.004.1 | 25802.3 | 51203.2 |
| 495 | 57447.025.1-T_at | NDRG2 | NM_016272 | 14q11.2 | 57447.025.1 | 5858.005.1 | 57447.25 | 7018.22 |
| 496 | 57447.017.1-T_at | NDRG2 | NM_016273 | 14q11.2 | 57447.017.1 | 59.003.1 | 57447.17 | 4288.9 |
| 497 | 7018.026.1-C_at | TF | NM_001063 | 3q22.1 | 7018.026.1 | 59.004.1 | 7018.26 | 8321.4 |
| 498 | 7018.028.1-E_at | TF | NM_001063 | 3q22.1 | 7018.028.1 | 59.004.2 | 7018.28 | 8564.4 |
| 499 | 4915.008.1-C_at | NTRK2 | NM_001007107 | 9q22.1 | 4915.008.1 | 59.008.1 | 4915.8 | 29127.13 |
| 500 | 358.018.1-C_at | AQP1 | NM_198098 | 7p14 | 358.018.1 | 59.008.2 | 358.18 | 1058.4 |
| 501 | 7153.002.6-B_at | TOP2A | NM_001067 | 17q21-q22 | 7153.002.6 | 59.009.1 | 7153.2 | 2232.14 |
| 502 | 57447.012.1-T_at | NDRG2 | NM_016274 | 14q11.2 | 57447.012.1 | 59.012.1 | 57447.12 | 23650.5 |
| 503 | 59.040.1-B_at | ACTA2 | NM_001613 | 10q23.3 | 59.040.1 | 59.012.2 | 59.40 | 5621.2 |
| 504 | 57447.006.1-T_at | NDRG2 | NM_016275 | 14q11.2 | 57447.006.1 | 59.014.1 | 57447.6 | 54443.12 |
| 505 | 9493.006.1-F_at | KIF23 | NM_004856 | 15q23 | 9493.006.1 | 59.014.2 | 9493.6 | 3479.3 |
| 506 | 57447.004.1-T_at | NDRG2 | NM_016276 | 14q11.2 | 57447.004.1 | 59.015.1 | 57447.4 | 94274.3 |
| 507 | 57447.004.2-B_at | NDRG2 | NM_016277 | 14q11.2 | 57447.004.2 | 59.015.2 | 57447.4 | 84668.3 |
| 508 | 7373.001.2-D_at | COL14A1 | NM_021110 | 8q23 | 7373.001.2 | 59.016.1 | 7373.1 | 22974.8 |
| 509 | 9493.004.1-B_at | KIF23 | NM_004856 | 15q23 | 9493.004.1 | 59.022.1 | 9493.4 | 55656.7 |
| 510 | 2568.005.2-C_at | GABRP | NM_014211 | 5q33-q34 | 2568.005.2 | 59.022.2 | 2568.5 | 29127.2 |
| 511 | 7018.029.1-F_at | TF | NM_001063 | 3q22.1 | 7018.029.1 | 59.023.1 | 7018.29 | 4281.12 |
| 512 | 26289.013.1-B_at | AK5 | NM_012116 | 1p31 | 26289.013.1 | 59.023.2 | 26289.13 | 79627.3 |
| 513 | 7169.015.1-B_at | TPM2 | NM_003289 | 9p13.2-p13.1 | 7169.015.1 | 59.024.1 | 7169.15 | 2982.14 |
| 514 | 57451.001.3-F_at | ODZ2 | NM_001080428 | 5q34-q35.1 | 57451.001.3 | 59.024.2 | 57451.1 | 2335.53 |
| 515 | 2568.005.2-F_at | GABRP | NM_014211 | 5q33-q34 | 2568.005.2 | 59.026.1 | 2568.5 | 667.1 |
| 516 | 57447.004.2-F_at | NDRG2 | NM_016278 | 14q11.2 | 57447.004.2 | 59.026.2 | 57447.4 | 55366.1 |
| 517 | 8404.004.1-D_at | SPARCL1 | NM_004684 | 4q22.1 | 8404.004.1 | 59.029.1 | 8404.4 | 5311.3 |
| 518 | 3855.004.2-D_at | KRT7 | NM_005556 | 12q12-q13 | 3855.004.2 | 59.031.1 | 3855.4 | 6304.11 |
| 519 | 3872.014.1-F_at | KRT17 | NM_000422 | 17q12-q21 | 3872.014.1 | 59.031.2 | 3872.14 | 7373.7 |
| 520 | 57447.033.1-F_at | NDRG2 | NM_016279 | 14q11.2 | 57447.033.1 | 59.033.1 | 57447.33 | 1410.9 |
| 521 | 9452.001.1-T_at | ITM2A | NM_004867 | Xq13.3-Xq21.2 | 9452.001.1 | 59.033.2 | 9452.1 | 79745.4 |
| 522 | 59.033.2-T_at | ACTA2 | NM_001613 | 10q23.3 | 59.033.2 | 59.034.1 | 59.33 | 24137.4 |
| 523 | 3084.009.1-T_at | NRG1 | NM_004509 | 8p12 | 3084.009.1 | 59.034.2 | 3084.9 | 6241.13 |
| 524 | 57447.040.1-T_at | NDRG2 | NM_016280 | 14q11.2 | 57447.040.1 | 59.038.1 | 57447.40 | 1410.1 |
| 525 | 4833.004.1-T_at | NME4 | NM_005009 | 16p13.3 | 4833.004.1 | 59.039.1 | 4833.4 | 4781.15 |
| 526 | 3426.001.1-F_at | CFI | NM_000204 | 4q25 | 3426.001.1 | 59.040.1 | 3426.1 | 72.2 |
| 527 | 59.034.1-B_at | ACTA2 | NM_001613 | 10q23.3 | 59.034.1 | 59.042.1 | 59.34 | 2982.13 |
| 528 | 10253.001.1-E_at | SPRY2 | NM_005842 | 13q31.1 | 10253.001.1 | 59.049.1 | 10253.1 | 79971.12 |
| 529 | 9073.001.1-C_at | CLDN8 | NM_199328 | 21q22.11 | 9073.001.1 | 6122.037.1 | 9073.1 | 7169.4 |
| 530 | 51201.005.1-T_at | ZDHHC2 | NM_016353 | 8p21.3-p22 | 51201.005.1 | 6122.046.1 | 51201.5 | 2335.16 |
| 531 | 9477.006.1-C_at | MED20 | NM_004275 | 6p21.1 | 9477.006.1 | 6241.013.1 | 9477.6 | 259266.3 |
| 532 | 57447.028.1-T_at | NDRG2 | NM_016281 | 14q11.2 | 57447.028.1 | 6285.001.1 | 57447.28 | 9055.20 |
| 533 | 25925.007.1-T_at | ZNF521 | NM_015461 | 18q11.2 | 25925.007.1 | 6285.002.1 | 25925.7 | 7091.16 |
| 534 | 59.024.2-B_at | ACTA2 | NM_001613 | 10q23.3 | 59.024.2 | 6285.003.1 | 59.24 | 57162.10 |
| 535 | 2.022.1-T_at | A2M | NM_000014 | 12p13.3-p12.3 | 2.022.1 | 6286.001.1 | 2.22 | 4781.2 |
| 536 | 4281.008.2-B_at | MID1 | NM_000382 | Xp22 | 4281.008.2 | 6288.001.1 | 4281.8 | 6122.37 |
| 537 | 90231.001.1-C_at | KIAA2013 | NM_138346 | 1p36.22 | 90231.001.1 | 6288.004.1 | 90231.1 | 4240.15 |
| 538 | 358.012.1-D_at | AQP1 | NM_198098 | 7p14 | 358.012.1 | 6289.001.1 | 358.12 | 6304.2 |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 539 | 3852.021.1-T_at | KRT5 | NM_000424 | 12q12-q13 | 3852.021.1 | 6289.001.2 | 3852.21 | 301.13 |
| 540 | 7373.003.4-D_at | COL14A1 | NM_021110 | 8q23 | 7373.003.4 | 6289.002.1 | 7373.3 | 6304.12 |
| 541 | 57447.048.1-T_at | NDRG2 | NM_016282 | 14q11.2 | 57447.048.1 | 6289.002.2 | 57447.48 | 11065.5 |
| 542 | 358.012.1-B_at | AQP1 | NM_198098 | 7p14 | 358.012.1 | 6289.003.1 | 358.12 | 29997.16 |
| 543 | 7018.025.1-C_at | TF | NM_001063 | 3q22.1 | 7018.025.1 | 6289.003.2 | 7018.25 | 1410.11 |
| 544 | 5608.004.1-T_at | MAP2K6 | NM_002758 | 17q24.3 | 5608.004.1 | 6289.005.1 | 5608.4 | 7170.40 |
| 545 | 3084.012.2-F_at | NRG1 | NM_004510 | 8p12 | 3084.012.2 | 6289.006.1 | 3084.12 | 7170.41 |
| 546 | 4306.002.1-C_at | NR3C2 | NM_000901 | 4q31.1 | 4306.002.1 | 6304.002.1 | 4306.2 | 4094.2 |
| 547 | 4288.004.1-D_at | MKI67 | NM_002417 | 10q25-qter | 4288.004.1 | 6304.006.2 | 4288.4 | 7113.11 |
| 548 | 57447.002.1-F_at | NDRG2 | NM_016283 | 14q11.2 | 57447.002.1 | 6304.007.1 | 57447.2 | 7170.2 |
| 549 | 4281.018.1-T_at | MID1 | NM_000383 | Xp22 | 4281.018.1 | 6304.007.2 | 4281.18 | 8404.17 |
| 550 | 10144.020.2-B_at | FAM13A1 | NM_001015045 | 4q22.1 | 10144.020.2 | 6304.011.1 | 10144.20 | 59.29 |
| 551 | 6876.016.1-E_at | TAGLN | NM_001001522 | 11q23.2 | 6876.016.1 | 6304.012.1 | 6876.16 | 29089.1 |
| 552 | 57447.008.2-T_at | NDRG2 | NM_016284 | 14q11.2 | 57447.008.2 | 6376.001.1 | 57447.8 | 9134.1 |
| 553 | 51203.004.1-T_at | NUSAP1 | NM_016359 | 15q15.1 | 51203.004.1 | 6376.001.2 | 51203.4 | 1410.10 |
| 554 | 2335.028.1-B_at | FN1 | NM_002026 | 2q34 | 2335.028.1 | 64151.001.2 | 2335.28 | 2327.3 |
| 555 | 7018.028.1-F_at | TF | NM_001063 | 3q22.1 | 7018.028.1 | 64168.010.1 | 7018.28 | 6289.1 |
| 556 | 7373.003.5-T_at | COL14A1 | NM_021110 | 8q23 | 7373.003.5 | 6422.001.1 | 7373.3 | 1410.6 |
| 557 | 81557.006.1-C_at | MAGED4B | NM_030801 | — | 81557.006.1 | 6422.002.1 | 81557.6 | 80034.4 |
| 558 | 3866.002.1-D_at | KRT15 | NM_002275 | 17q21.2 | 3866.002.1 | 6441.004.1 | 3866.2 | 1410.8 |
| 559 | 3866.001.1-B_at | KRT15 | NM_002275 | 17q21.2 | 3866.001.1 | 6595.012.1 | 3866.1 | 6288.1 |
| 560 | 55107.006.2-T_at | TMEM16A | NM_018043 | 11q13.3 | 55107.006.2 | 65983.003.1 | 55107.6 | 8404.20 |
| 561 | 79068.010.1-D_at | FTO | NM_001080432 | 16q12.2 | 79068.010.1 | 65983.003.2 | 79068.10 | 3459.5 |
| 562 | 57447.009.1-T_at | NDRG2 | NM_016285 | 14q11.2 | 57447.009.1 | 65983.004.1 | 57447.9 | 83539.1 |
| 563 | 2115.015.1-T_at | ETV1 | NM_004956 | 7p21.3 | 2115.015.1 | 65983.004.2 | 2115.15 | 6288.4 |
| 564 | 1756.013.1-C_at | DMD | NM_000143 | Xp21.2 | 1756.013.1 | 65983.005.1 | 1756.13 | 4781.16 |
| 565 | 7169.015.1-F_at | TPM2 | NM_003290 | 9p13.2-p13.1 | 7169.015.1 | 65983.007.1 | 7169.15 | 53829.1 |
| 566 | 65983.013.2-F_at | GRAMD3 | NM_023927 | 5q23.2 | 65983.013.2 | 65983.008.1 | 65983.13 | 10051.8 |
| 567 | 8404.001.1-B_at | SPARCL1 | NM_004684 | 4q22.1 | 8404.001.1 | 65983.009.1 | 8404.1 | 1033.2 |
| 568 | 4240.004.1-B_at | MFGE8 | NM_005928 | 15q25 | 4240.004.1 | 65983.010.1 | 4240.4 | 2335.5 |
| 569 | 57447.012.2-T_at | NDRG2 | NM_016286 | 14q11.2 | 57447.012.2 | 65983.013.1 | 57447.12 | 7113.9 |
| 570 | 57447.024.1-F_at | NDRG2 | NM_016287 | 14q11.2 | 57447.024.1 | 65983.013.2 | 57447.24 | 7168.3 |
| 571 | 358.018.1-T_at | AQP1 | NM_198098 | 7p14 | 358.018.1 | 667.001.1 | 358.18 | 79608.1 |
| 572 | 57447.048.2-T_at | NDRG2 | NM_016288 | 14q11.2 | 57447.048.2 | 667.010.1 | 57447.48 | 7113.10 |
| 573 | 59.031.1-C_at | ACTA2 | NM_001613 | 10q23.3 | 59.031.1 | 667.021.1 | 59.31 | 4781.14 |
| 574 | 3860.007.1-F_at | KRT13 | NM_002275 | 17q12-q21.2 | 3860.007.1 | 667.022.1 | 3860.7 | 11065.3 |
| 575 | 8404.028.1-C_at | SPARCL1 | NM_004684 | 4q22.1 | 8404.028.1 | 6876.002.1 | 8404.28 | 3084.5 |
| 576 | 4240.011.3-E_at | MFGE8 | NM_005928 | 15q25 | 4240.011.3 | 6876.011.1 | 4240.11 | 6285.3 |
| 577 | 59.022.2-B_at | ACTA2 | NM_001613 | 10q23.3 | 59.022.2 | 6876.016.1 | 59.22 | 54829.1 |
| 578 | 3866.002.1-F_at | KRT15 | NM_002275 | 17q21.2 | 3866.002.1 | 6876.016.2 | 3866.2 | 9055.11 |
| 579 | 3866.002.1-T_at | KRT15 | NM_002275 | 17q21.2 | 3866.002.1 | 6876.020.1 | 3866.2 | 4288.8 |
| 580 | 4915.005.1-B_at | NTRK2 | NM_001007108 | 9q22.1 | 4915.005.1 | 6876.023.1 | 4915.5 | 4781.7 |
| 581 | 8404.008.1-F_at | SPARCL1 | NM_004684 | 4q22.1 | 8404.008.1 | 699.002.1 | 8404.8 | 9055.17 |
| 582 | 79608.002.1-F_at | RIC3 | NM_024557 | 11p15.4 | 79608.002.1 | 7018.013.1 | 79608.2 | 7170.18 |
| 583 | 8404.023.1-D_at | SPARCL1 | NM_004684 | 4q22.1 | 8404.023.1 | 7018.014.1 | 8404.23 | 10253.3 |
| 584 | 3426.002.1-D_at | CFI | NM_000204 | 4q25 | 3426.002.1 | 7018.022.1 | 3426.2 | 2982.15 |
| 585 | 2335.027.1-T_at | FN1 | NM_002027 | 2q34 | 2335.027.1 | 7018.025.1 | 2335.27 | 10124.4 |
| 586 | 11065.009.1-T_at | UBE2C | NM_007019 | 20q13.12 | 11065.009.1 | 7018.026.1 | 11065.9 | 7091.5 |
| 587 | 140885.013.1-F | SIRPA | NM_001040024 | 20p13 | 140885.013.1 | 7018.028.1 | 140885.13 | 501.6 |
| 588 | 57447.021.1-B_at | NDRG2 | NM_016289 | 14q11.2 | 57447.021.1 | 7018.029.1 | 57447.21 | 244.12 |
| 589 | 25802.004.1-C_at | LMOD1 | NM_012134 | 1q32 | 25802.004.1 | 7091.001.1 | 25802.4 | 3872.18 |
| 590 | 4638.014.1-F_at | MYLK | NM_005980 | 3q21 | 4638.014.1 | 7091.005.1 | 4638.14 | 10144.17 |
| 591 | 9493.004.1-F_at | KIF23 | NM_004856 | 15q23 | 9493.004.1 | 7091.006.1 | 9493.4 | 29127.7 |
| 592 | 8404.004.1-B_at | SPARCL1 | NM_004684 | 4q22.1 | 8404.004.1 | 7091.010.1 | 8404.4 | 10010.4 |
| 593 | 8404.004.2-T_at | SPARCL1 | NM_004684 | 4q22.1 | 8404.004.2 | 7091.014.1 | 8404.4 | 4781.6 |
| 594 | 57447.010.2-T_at | NDRG2 | NM_016290 | 14q11.2 | 57447.010.2 | 7091.015.1 | 57447.10 | 23092.4 |
| 595 | 57447.010.3-B_at | NDRG2 | NM_016291 | 14q11.2 | 57447.010.3 | 7091.016.1 | 57447.10 | 2335.2 |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 596 | 27122.006.1-T_at | DKK3 | NM_001018069 | 11p15.2 | 27122.006.1 | 7113.001.1 | 27122.6 | 6304.6 |
| 597 | 5156.005.1-T_at | PDGFRA | NM_006206 | 4q11-q13 | 5156.005.1 | 7113.009.1 | 5156.5 | 9055.19 |
| 598 | 5858.004.1-E_at | PZP | NM_002864 | 12p13-p12.2 | 5858.004.1 | 7113.010.1 | 5858.4 | 1398.1 |
| 599 | 25802.008.1-D_at | LMOD1 | NM_012134 | 1q32 | 25802.008.1 | 7113.011.1 | 25802.8 | 339965.1 |
| 600 | 2327.002.2-T_at | FMO2 | NM_001460 | 1q23-q25 | 2327.002.2 | 7153.002.2 | 2327.2 | 7113.1 |
| 601 | 3852.004.1-C_at | KRT5 | NM_000424 | 12q12-q13 | 3852.004.1 | 7153.002.3 | 3852.4 | 4833.10 |
| 602 | 59.026.2-F_at | ACTA2 | NM_001613 | 10q23.3 | 59.026.2 | 7153.002.4 | 59.26 | 79971.13 |
| 603 | 57447.029.1-C_at | NDRG2 | NM_016292 | 14q11.2 | 57447.029.1 | 7153.002.5 | 57447.29 | 152015.5 |
| 604 | 7169.022.1-D_at | TPM2 | NM_003291 | 9p13.2-p13.1 | 7169.022.1 | 7153.002.6 | 7169.22 | 4288.5 |
| 605 | 23266.001.3-B_at | LPHN2 | NM_012302 | 1p31.1 | 23266.001.3 | 7153.005.1 | 23266.1 | 6441.4 |
| 606 | 3084.012.1-B_at | NRG1 | NM_004511 | 8p12 | 3084.012.1 | 7168.003.1 | 3084.12 | 6122.46 |
| 607 | 29127.019.2-T_at | RACGAP1 | NM_013277 | 12q13.13 | 29127.019.2 | 7169.001.1 | 29127.19 | 115908.2 |
| 608 | 10253.004.1-T_at | SPRY2 | NM_005842 | 13q31.1 | 10253.004.1 | 7169.004.1 | 10253.4 | 9481.1 |
| 609 | 10124.002.1-D_at | ARL4A | NM_001037164 | 7p21-p15.3 | 10124.002.1 | 7169.015.1 | 10124.2 | 2335.24 |
| 610 | 3861.013.1-D_at | KRT14 | NM_000526 | 17q12-q21 | 3861.013.1 | 7169.022.1 | 3861.13 | 891.7 |
| 611 | 8404.032.1-T_at | SPARCL1 | NM_004684 | 4q22.1 | 8404.032.1 | 7170.002.1 | 8404.32 | 57451.4 |
| 612 | 84441.002.1-E_at | MAML2 | NM_032427 | 11q21 | 84441.002.1 | 7170.005.2 | 84441.2 | 6286.1 |
| 613 | 2.013.1-E_at | A2M | NM_000014 | 12p13.3-p12.3 | 2.013.1 | 7170.006.1 | 2.13 | 10580.12 |
| 614 | 3084.004.1-T_at | NRG1 | NM_004512 | 8p12 | 3084.004.1 | 7170.007.1 | 3084.4 | 23321.14 |
| 615 | 5288.001.2-F_at | PIK3C2G | NM_004570 | 12p12 | 5288.001.2 | 7170.014.1 | 5288.1 | 2824.1 |
| 616 | 57447.017.1-F_at | NDRG2 | NM_016293 | 14q11.2 | 57447.017.1 | 7170.016.3 | 57447.17 | 29127.22 |
| 617 | 3084.006.1-T_at | NRG1 | NM_004513 | 8p12 | 3084.006.1 | 7170.018.2 | 3084.6 | 54443.11 |
| 618 | 59.039.1-F_at | ACTA2 | NM_001613 | 10q23.3 | 59.039.1 | 7170.025.1 | 59.39 | 29997.8 |
| 619 | 2.024.1-T_at | A2M | NM_000014 | 12p13.3-p12.3 | 2.024.1 | 7170.027.1 | 2.24 | 57561.2 |
| 620 | 3815.002.2-E_at | KIT | NM_000236 | 4q11-q12 | 3815.002.2 | 7170.034.2 | 3815.2 | 57451.2 |
| 621 | 1756.009.1-D_at | DMD | NM_000144 | Xp21.2 | 1756.009.1 | 7170.040.1 | 1756.9 | 5213.24 |
| 622 | 7091.014.1-B_at | TLE4 | NM_007005 | 9q21.31 | 7091.014.1 | 7170.041.1 | 7091.14 | 11065.4 |
| 623 | 4629.015.1-F_at | MYH11 | NM_001040137 | 16p13.11 | 4629.015.1 | 72.001.1 | 4629.15 | 6289.6 |
| 624 | 59.008.2-F_at | ACTA2 | NM_001613 | 10q23.3 | 59.008.2 | 72.002.1 | 59.8 | 23284.7 |
| 625 | 2568.005.2-T_at | GABRP | NM_014211 | 5q33-q34 | 2568.005.2 | 72.005.1 | 2568.5 | 79971.9 |
| 626 | 115207.002.1-T | KCTD12 | NM_138444 | 13q22.3 | 115207.002.1 | 7373.001.1 | 115207.2 | 51203.9 |
| 627 | 4281.001.1-T_at | MID1 | NM_000384 | Xp22 | 4281.001.1 | 7373.001.2 | 4281.1 | 1308.2 |
| 628 | 84668.002.2-T_at | FAM126A | NM_032581 | 7p15.3 | 84668.002.2 | 7373.002.1 | 84668.2 | 4288.7 |
| 629 | 4240.004.1-F_at | MFGE8 | NM_005928 | 15q25 | 4240.004.1 | 7373.003.1 | 4240.4 | 244.11 |
| 630 | 8404.005.1-D_at | SPARCL1 | NM_004684 | 4q22.1 | 8404.005.1 | 7373.003.2 | 8404.5 | 3178.3 |
| 631 | 8404.032.1-B_at | SPARCL1 | NM_004684 | 4q22.1 | 8404.032.1 | 7373.003.3 | 8404.32 | 9055.12 |
| 632 | 57447.044.1-E_at | NDRG2 | NM_016294 | 14q11.2 | 57447.044.1 | 7373.003.4 | 57447.44 | 9232.1 |
| 633 | 8626.006.2-F_at | TP63 | NM_003722 | 3q28 | 8626.006.2 | 7373.003.5 | 8626.6 | 79068.11 |
| 634 | 57447.051.2-B_at | NDRG2 | NM_016295 | 14q11.2 | 57447.051.2 | 7373.003.6 | 57447.51 | 7534.1 |
| 635 | 1063.001.1-T_at | CENPF | NM_016343 | 1q32-q41 | 1063.001.1 | 7373.004.1 | 1063.1 | 79971.14 |
| 636 | 3426.002.1-T_at | CFI | NM_000204 | 4q25 | 3426.002.1 | 7373.007.1 | 3426.2 | 5621.8 |
| 637 | 1308.001.1-T_at | COL17A1 | NM_000505 | 10q24.3 | 1308.001.1 | 7373.008.1 | 1308.1 | 55732.3 |
| 638 | 389432.002.1-F | SAMD5 | NM_001030060 | 6q24.3 | 389432.002.1 | 7402.014.1 | 389432.2 | 221120.6 |
| 639 | 57447.017.1-B_at | NDRG2 | NM_016296 | 14q11.2 | 57447.017.1 | 7431.064.1 | 57447.17 | 2335.45 |
| 640 | 2115.014.1-F_at | ETV1 | NM_004956 | 7p21.3 | 2115.014.1 | 7534.001.1 | 2115.14 | 7170.7 |
| 641 | 5284.004.1-T_at | PIGR | NM_002644 | 1q31-q41 | 5284.004.1 | 79068.010.1 | 5284.4 | 9055.10 |
| 642 | 57447.029.1-F_at | NDRG2 | NM_016297 | 14q11.2 | 57447.029.1 | 79068.011.2 | 57447.29 | 58499.5 |
| 643 | 8626.006.1-F_at | TP63 | NM_003722 | 3q28 | 8626.006.1 | 79192.002.2 | 8626.6 | 54443.6 |
| 644 | 2982.002.1-C_at | GUCY1A3 | NM_000856 | 4q31.3-q33\| 4q31.1-q31.2 | 2982.002.1 | 79608.001.1 | 2982.2 | 59.16 |
| 645 | 57447.047.1-T_at | NDRG2 | NM_016298 | 14q11.2 | 57447.047.1 | 79608.002.1 | 57447.47 | 7170.14 |
| 646 | 5803.006.1-E_at | PTPRZ1 | NM_002851 | 7q31.3 | 5803.006.1 | 79608.008.1 | 5803.6 | |
| 647 | 57447.021.1-F_at | NDRG2 | NM_016299 | 14q11.2 | 57447.021.1 | 79608.008.2 | 57447.21 | |
| 648 | 57447.039.1-F_at | NDRG2 | NM_016300 | 14q11.2 | 57447.039.1 | 79608.009.1 | 57447.39 | 205 genes |
| 649 | 4281.008.2-F_at | MID1 | NM_000385 | Xp22 | 4281.008.2 | 79627.003.1 | 4281.8 | 645 transcrits |
| 650 | 57447.029.1-D_at | NDRG2 | NM_016301 | 14q11.2 | 57447.029.1 | 79745.004.3 | 57447.29 | 1228 probesets |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 651 | 65983.013.1-B_at | GRAMD3 | NM_023927 | 5q23.2 | 65983.013.1 | 79895.001.1 | 65983.13 | |
| 652 | 5284.004.1-E_at | PIGR | NM_002644 | 1q31-q41 | 5284.004.1 | 79937.001.1 | 5284.4 | |
| 653 | 4240.011.1-D_at | MFGE8 | NM_005928 | 15q25 | 4240.011.1 | 79937.002.1 | 4240.11 | |
| 654 | 57447.024.1-T_at | NDRG2 | NM_016302 | 14q11.2 | 57447.024.1 | 79971.009.1 | 57447.24 | |
| 655 | 6876.011.1-B_at | TAGLN | NM_001001523 | 11q23.2 | 6876.011.1 | 79971.012.1 | 6876.11 | |
| 656 | 7373.003.2-T_at | COL14A1 | NM_021110 | 8q23 | 7373.003.2 | 79971.013.2 | 7373.3 | |
| 657 | 3852.014.1-D_at | KRT5 | NM_000424 | 12q12-q13 | 3852.014.1 | 79971.014.1 | 3852.14 | |
| 658 | 4915.005.1-D_at | NTRK2 | NM_001007109 | 9q22.1 | 4915.005.1 | 80034.002.2 | 4915.5 | |
| 659 | 9768.002.2-B_at | KIAA0101 | NM_001029992 | 15q22.31 | 9768.002.2 | 80034.003.4 | 9768.2 | |
| 660 | 140885.010.1-D | SIRPA | NM_001040025 | 20p13 | 140885.010.1 | 80034.004.1 | 140885.10 | |
| 661 | 4638.020.1-E_at | MYLK | NM_005981 | 3q21 | 4638.020.1 | 81557.006.1 | 4638.20 | |
| 662 | 57447.017.1-C_at | NDRG2 | NM_016303 | 14q11.2 | 57447.017.1 | 81704.008.1 | 57447.17 | |
| 663 | 7373.004.1-T_at | COL14A1 | NM_021110 | 8q23 | 7373.004.1 | 81704.013.1 | 7373.4 | |
| 664 | 3852.008.2-E_at | KRT5 | NM_000424 | 12q12-q13 | 3852.008.2 | 8321.004.1 | 3852.8 | |
| 665 | 4281.015.1-E_at | MID1 | NM_000386 | Xp22 | 4281.015.1 | 83539.001.1 | 4281.15 | |
| 666 | 8404.013.1-C_at | SPARCL1 | NM_004684 | 4q22.1 | 8404.013.1 | 8404.001.1 | 8404.13 | |
| 667 | 90293.001.3-T_at | KLHL13 | NM_033495 | Xq23-q24 | 90293.001.3 | 8404.002.1 | 90293.1 | |
| 668 | 57447.044.1-T_at | NDRG2 | NM_016304 | 14q11.2 | 57447.044.1 | 8404.004.1 | 57447.44 | |
| 669 | 23650.011.2-D_at | TRIM29 | NM_012101 | 11q22-q23 | 23650.011.2 | 8404.004.2 | 23650.11 | |
| 670 | 2335.006.1-D_at | FN1 | NM_002028 | 2q34 | 2335.006.1 | 8404.005.1 | 2335.6 | |
| 671 | 57447.022.1-T_at | NDRG2 | NM_016305 | 14q11.2 | 57447.022.1 | 8404.008.1 | 57447.22 | |
| 672 | 8404.032.1-D_at | SPARCL1 | NM_004684 | 4q22.1 | 8404.032.1 | 8404.009.1 | 8404.32 | |
| 673 | 8404.030.1-F_at | SPARCL1 | NM_004684 | 4q22.1 | 8404.030.1 | 8404.013.1 | 8404.30 | |
| 674 | 5803.002.2-T_at | PTPRZ1 | NM_002851 | 7q31.3 | 5803.002.2 | 8404.015.1 | 5803.2 | |
| 675 | 8404.004.2-C_at | SPARCL1 | NM_004684 | 4q22.1 | 8404.004.2 | 8404.017.1 | 8404.4 | |
| 676 | 84441.005.1-C_at | MAML2 | NM_032427 | 11q21 | 84441.005.1 | 8404.017.2 | 84441.5 | |
| 677 | 7091.015.1-F_at | TLE4 | NM_007005 | 9q21.31 | 7091.015.1 | 8404.020.1 | 7091.15 | |
| 678 | 2119.005.1-D_at | ETV5 | NM_004454 | 3q28 | 2119.005.1 | 8404.021.1 | 2119.5 | |
| 679 | 7373.003.6-F_at | COL14A1 | NM_021110 | 8q23 | 7373.003.6 | 8404.022.1 | 7373.3 | |
| 680 | 79608.008.1-T_at | RIC3 | NM_024557 | 11p15.4 | 79608.008.1 | 8404.023.1 | 79608.8 | |
| 681 | 3852.008.1-T_at | KRT5 | NM_000424 | 12q12-q13 | 3852.008.1 | 8404.024.1 | 3852.8 | |
| 682 | 8626.007.1-T_at | TP63 | NM_003722 | 3q28 | 8626.007.1 | 8404.025.1 | 8626.7 | |
| 683 | 8404.022.1-T_at | SPARCL1 | NM_004684 | 4q22.1 | 8404.022.1 | 8404.026.1 | 8404.22 | |
| 684 | 8404.034.1-T_at | SPARCL1 | NM_004684 | 4q22.1 | 8404.034.1 | 8404.028.1 | 8404.34 | |
| 685 | 57447.049.1-T_at | NDRG2 | NM_016306 | 14q11.2 | 57447.049.1 | 8404.028.3 | 57447.49 | |
| 686 | 5311.002.1-B_at | PKD2 | NM_000297 | 4q21-q23 | 5311.002.1 | 8404.029.1 | 5311.2 | |
| 687 | 2335.025.3-T_at | FN1 | NM_002029 | 2q34 | 2335.025.3 | 8404.030.1 | 2335.25 | |
| 688 | 4147.012.1-T_at | MATN2 | NM_002380 | 8q22 | 4147.012.1 | 8404.031.1 | 4147.12 | |
| 689 | 301.015.1-T_at | ANXA1 | NM_000700 | 9q12-q21.2\|9q12-q21.2 | 301.015.1 | 8404.032.1 | 301.15 | |
| 690 | 301.004.1-T_at | ANXA1 | NM_000700 | 9q12-q21.2\|9q12-q21.2 | 301.004.1 | 8404.034.1 | 301.4 | |
| 691 | 3426.002.2-F_at | CFI | NM_000204 | 4q25 | 3426.002.2 | 8404.035.1 | 3426.2 | |
| 692 | 7091.001.1-C_at | TLE4 | NM_007005 | 9q21.31 | 7091.001.1 | 84417.001.1 | 7091.1 | |
| 693 | 8404.021.1-D_at | SPARCL1 | NM_004684 | 4q22.1 | 8404.021.1 | 84417.001.2 | 8404.21 | |
| 694 | 7153.002.3-B_at | TOP2A | NM_001067 | 17q21-q22 | 7153.002.3 | 84441.002.1 | 7153.2 | |
| 695 | 53335.002.1-E_at | BCL11A | NM_018014 | 2p16.1 | 53335.002.1 | 84441.005.1 | 53335.2 | |
| 696 | 5284.003.2-T_at | PIGR | NM_002644 | 1q31-q41 | 5284.003.2 | 84668.002.1 | 5284.3 | |
| 697 | 4306.002.1-F_at | NR3C2 | NM_000901 | 4q31.1 | 4306.002.1 | 84668.002.2 | 4306.2 | |
| 698 | 5284.003.2-D_at | PIGR | NM_002644 | 1q31-q41 | 5284.003.2 | 84668.003.1 | 5284.3 | |
| 699 | 5803.002.1-T_at | PTPRZ1 | NM_002851 | 7q31.3 | 5803.002.1 | 84668.004.1 | 5803.2 | |
| 700 | 10253.004.1-E_at | SPRY2 | NM_005842 | 13q31.1 | 10253.004.1 | 8564.004.1 | 10253.4 | |
| 701 | 23650.020.1-T_at | TRIM29 | NM_012101 | 11q22-q23 | 23650.020.1 | 8626.002.1 | 23650.20 | |
| 702 | 57447.042.1-T_at | NDRG2 | NM_016307 | 14q11.2 | 57447.042.1 | 8626.005.1 | 57447.42 | |
| 703 | 6876.023.1-F_at | TAGLN | NM_001001524 | 11q23.2 | 6876.023.1 | 8626.006.1 | 6876.23 | |
| 704 | 7169.015.1-C_at | TPM2 | NM_003292 | 9p13.2-p13.1 | 7169.015.1 | 8626.006.2 | 7169.15 | |
| 705 | 7153.002.4-F_at | TOP2A | NM_001067 | 17q21-q22 | 7153.002.4 | 8626.007.1 | 7153.2 | |
| 706 | 4629.016.1-B_at | MYH11 | NM_001040138 | 16p13.11 | 4629.016.1 | 891.007.1 | 4629.16 | |
| 707 | 6876.002.1-C_at | TAGLN | NM_001001525 | 11q23.2 | 6876.002.1 | 90231.001.1 | 6876.2 | |
| 708 | 65983.007.1-T_at | GRAMD3 | NM_023927 | 5q23.2 | 65983.007.1 | 90293.001.3 | 65983.7 | |
| 709 | 7373.003.2-F_at | COL14A1 | NM_021110 | 8q23 | 7373.003.2 | 9055.010.1 | 7373.3 | |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 710 | 152015.004.1-T | ROPN1B | NM_001012337 | 3q21.2 | 152015.004.1 | 9055.011.1 | 152015.4 | |
| 711 | 8404.004.2-B_at | SPARCL1 | NM_004684 | 4q22.1 | 8404.004.2 | 9055.012.1 | 8404.4 | |
| 712 | 6285.001.1-B_at | S100B | NM_006272 | 21q22.3 | 6285.001.1 | 9055.013.1 | 6285.1 | |
| 713 | 2115.007.1-E_at | ETV1 | NM_004956 | 7p21.3 | 2115.007.1 | 9055.014.1 | 2115.7 | |
| 714 | 2.013.1-T_at | A2M | NM_000014 | 12p13.3-p12.3 | 2.013.1 | 9055.017.1 | 2.13 | |
| 715 | 6289.005.1-T_at | SAA2 | NM_030754 | 11p15.1-p14 | 6289.005.1 | 9055.019.1 | 6289.5 | |
| 716 | 9232.002.1-T_at | PTTG1 | NM_004219 | 5q35.1 | 9232.002.1 | 9055.020.1 | 9232.2 | |
| 717 | 59.014.1-B_at | ACTA2 | NM_001613 | 10q23.3 | 59.014.1 | 9073.001.1 | 59.14 | |
| 718 | 59.031.1-F_at | ACTA2 | NM_001613 | 10q23.3 | 59.031.1 | 90865.006.1 | 59.31 | |
| 719 | 3084.011.1-T_at | NRG1 | NM_004514 | 8p12 | 3084.011.1 | 9134.001.1 | 3084.11 | |
| 720 | 3872.005.1-F_at | KRT17 | NM_000422 | 17q12-q21 | 3872.005.1 | 9232.001.1 | 3872.5 | |
| 721 | 3084.012.3-F_at | NRG1 | NM_004515 | 8p12 | 3084.012.3 | 9232.002.1 | 3084.12 | |
| 722 | 81704.008.1-F_at | DOCK8 | NM_203447 | 9p24.3 | 81704.008.1 | 9232.004.1 | 81704.8 | |
| 723 | 140885.010.2-C | SIRPA | NM_001040026 | 20p13 | 140885.010.2 | 9413.001.1 | 140885.10 | |
| 724 | 338707.006.1-E | B4GALNT4 | NM_178537 | 11p15.5 | 338707.006.1 | 9413.001.2 | 338707.6 | |
| 725 | 23266.008.2-T_at | LPHN2 | NM_012302 | 1p31.1 | 23266.008.2 | 9413.002.1 | 23266.8 | |
| 726 | 120.005.2-E_at | ADD3 | NM_001121 | 10q24.2-q24.3 | 120.005.2 | 9413.003.1 | 120.5 | |
| 727 | 4281.009.1-E_at | MID1 | NM_000387 | Xp22 | 4281.009.1 | 9413.006.1 | 4281.9 | |
| 728 | 4094.001.1-T_at | MAF | NM_001031804 | 16q22-q23 | 4094.001.1 | 94274.002.1 | 4094.1 | |
| 729 | 2995.001.1-T_at | GYPC | NM_002101 | 2q14-q21 | 2995.001.1 | 94274.003.1 | 2995.1 | |
| 730 | 4638.011.1-T_at | MYLK | NM_005982 | 3q21 | 4638.011.1 | 9452.001.1 | 4638.11 | |
| 731 | 2335.017.1-T_at | FN1 | NM_002030 | 2q34 | 2335.017.1 | 9477.006.1 | 2335.17 | |
| 732 | 5284.001.1-F_at | PIGR | NM_002644 | 1q31-q41 | 5284.001.1 | 9481.001.1 | 5284.1 | |
| 733 | 8404.026.1-D_at | SPARCL1 | NM_004684 | 4q22.1 | 8404.026.1 | 9493.001.1 | 8404.26 | |
| 734 | 2335.009.1-D_at | FN1 | NM_002031 | 2q34 | 2335.009.1 | 9493.004.1 | 2335.9 | |
| 735 | 10461.002.2-F_at | MERTK | NM_006343 | 2q14.1 | 10461.002.2 | 9493.006.1 | 10461.2 | |
| 736 | 84441.002.1-T_at | MAML2 | NM_032427 | 11q21 | 84441.002.1 | 9768.002.2 | 84441.2 | |
| 737 | 147495.006.1-T | APCDD1 | NM_153000 | 18p11.22 | 147495.006.1 | 9768.004.1 | 147495.6 | |
| 738 | 7091.010.1-B_at | TLE4 | NM_007005 | 9q21.31 | 7091.010.1 | 9768.005.1 | 7091.10 | |
| 739 | 8404.008.1-C_at | SPARCL1 | NM_004684 | 4q22.1 | 8404.008.1 | 9898.015.2 | 8404.8 | |
| 740 | 6376.001.2-C_at | CX3CL1 | NM_002996 | 16q13 | 6376.001.2 | | 6376.1 | |
| 741 | 3832.002.1-B_at | KIF11 | NM_004523 | 10q24.1 | 3832.002.1 | | 3832.2 | |
| 742 | 59.034.2-T_at | ACTA2 | NM_001613 | 10q23.3 | 59.034.2 | | 59.34 | |
| 743 | 147495.005.1-B | APCDD1 | NM_153000 | 18p11.22 | 147495.005.1 | | 147495.5 | |
| 744 | 3872.005.1-T_at | KRT17 | NM_000422 | 17q12-q21 | 3872.005.1 | | 3872.5 | |
| 745 | 79895.001.1-D_at | ATP8B4 | NM_024837 | 15q21.2 | 79895.001.1 | | 79895.1 | |
| 746 | 57447.038.1-T_at | NDRG2 | NM_016308 | 14q11.2 | 57447.038.1 | | 57447.38 | |
| 747 | 7373.008.1-T_at | COL14A1 | NM_021110 | 8q23 | 7373.008.1 | | 7373.8 | |
| 748 | 4744.004.1-C_at | NEFH | NM_021076 | 22q12.2 | 4744.004.1 | | 4744.4 | |
| 749 | 140885.010.1-T | SIRPA | NM_001040027 | 20p13 | 140885.010.1 | | 140885.10 | |
| 750 | 6876.016.2-E_at | TAGLN | NM_001001526 | 11q23.2 | 6876.016.2 | | 6876.16 | |
| 751 | 8404.015.1-T_at | SPARCL1 | NM_004684 | 4q22.1 | 8404.015.1 | | 8404.15 | |
| 752 | 4281.014.1-T_at | MID1 | NM_000388 | Xp22 | 4281.014.1 | | 4281.14 | |
| 753 | 4288.006.1-F_at | MKI67 | NM_002417 | 10q25-qter | 4288.006.1 | | 4288.6 | |
| 754 | 25925.009.1-E_at | ZNF521 | NM_015461 | 18q11.2 | 25925.009.1 | | 25925.9 | |
| 755 | 4240.009.1-B_at | MFGE8 | NM_005928 | 15q25 | 4240.009.1 | | 4240.9 | |
| 756 | 667.010.1-E_at | DST | NM_001725 | 6p12.1 | 667.010.1 | | 667.10 | |
| 757 | 3866.005.1-B_at | KRT15 | NM_002275 | 17q21.2 | 3866.005.1 | | 3866.5 | |
| 758 | 57447.011.1-T_at | NDRG2 | NM_016309 | 14q11.2 | 57447.011.1 | | 57447.11 | |
| 759 | 57447.034.1-B_at | NDRG2 | NM_016310 | 14q11.2 | 57447.034.1 | | 57447.34 | |
| 760 | 25802.004.1-B_at | LMOD1 | NM_012134 | 1q32 | 25802.004.1 | | 25802.4 | |
| 761 | 8404.024.1-T_at | SPARCL1 | NM_004684 | 4q22.1 | 8404.024.1 | | 8404.24 | |
| 762 | 57447.032.1-T_at | NDRG2 | NM_016311 | 14q11.2 | 57447.032.1 | | 57447.32 | |
| 763 | 667.021.1-F_at | DST | NM_001726 | 6p12.1 | 667.021.1 | | 667.21 | |
| 764 | 5858.001.2-F_at | PZP | NM_002864 | 12p13-p12.2 | 5858.001.2 | | 5858.1 | |
| 765 | 51062.008.1-T_at | SPG3A | NM_015915 | 14q22.1 | 51062.008.1 | | 51062.8 | |
| 766 | 2335.013.1-F_at | FN1 | NM_002032 | 2q34 | 2335.013.1 | | 2335.13 | |
| 767 | 2568.001.2-T_at | GABRP | NM_014211 | 5q33-q34 | 2568.001.2 | | 2568.1 | |
| 768 | 7170.005.2-D_at | TPM3 | NM_001043351 | 1q21.2 | 7170.005.2 | | 7170.5 | |
| 769 | 57447.034.1-F_at | NDRG2 | NM_016312 | 14q11.2 | 57447.034.1 | | 57447.34 | |
| 770 | 7153.002.6-C_at | TOP2A | NM_001067 | 17q21-q22 | 7153.002.6 | | 7153.2 | |
| 771 | 2568.003.1-T_at | GABRP | NM_014211 | 5q33-q34 | 2568.003.1 | | 2568.3 | |
| 772 | 59.008.2-T_at | ACTA2 | NM_001613 | 10q23.3 | 59.008.2 | | 59.8 | |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 773 | 9898.015.2-B_at | UBAP2L | NM_014847 | 1q21.3 | 9898.015.2 | | 9898.15 | |
| 774 | 7018.013.1-T_at | TF | NM_001063 | 3q22.1 | 7018.013.1 | | 7018.13 | |
| 775 | 7170.034.2-D_at | TPM3 | NM_001043352 | 1q21.2 | 7170.034.2 | | 7170.34 | |
| 776 | 3866.004.1-E_at | KRT15 | NM_002275 | 17q21.2 | 3866.004.1 | | 3866.4 | |
| 777 | 5284.001.1-T_at | PIGR | NM_002644 | 1q31-q41 | 5284.001.1 | | 5284.1 | |
| 778 | 2.002.1-C_at | A2M | NM_000014 | 12p13.3-p12.3 | 2.002.1 | | 2.2 | |
| 779 | 57447.050.1-T_at | NDRG2 | NM_016313 | 14q11.2 | 57447.050.1 | | 57447.50 | |
| 780 | 7018.014.1-F_at | TF | NM_001063 | 3q22.1 | 7018.014.1 | | 7018.14 | |
| 781 | 2335.032.1-D_at | FN1 | NM_002033 | 2q34 | 2335.032.1 | | 2335.32 | |
| 782 | 3866.002.1-C_at | KRT15 | NM_002275 | 17q21.2 | 3866.002.1 | | 3866.2 | |
| 783 | 57447.043.1-T_at | NDRG2 | NM_016314 | 14q11.2 | 57447.043.1 | | 57447.43 | |
| 784 | 51201.005.1-D_at | ZDHHC2 | NM_016353 | 8p21.3-p22 | 51201.005.1 | | 51201.5 | |
| 785 | 51203.003.1-T_at | NUSAP1 | NM_016360 | 15q15.1 | 51203.003.1 | | 51203.3 | |
| 786 | 9493.001.1-F_at | KIF23 | NM_004856 | 15q23 | 9493.001.1 | | 9493.1 | |
| 787 | 57447.024.1-B_at | NDRG2 | NM_016315 | 14q11.2 | 57447.024.1 | | 57447.24 | |
| 788 | 80034.003.4-B_at | FAM130A2 | NM_024969 | 2q24.3 | 80034.003.4 | | 80034.3 | |
| 789 | 7170.016.3-C_at | TPM3 | NM_001043353 | 1q21.2 | 7170.016.3 | | 7170.16 | |
| 790 | 65983.003.1-T_at | GRAMD3 | NM_023927 | 5q23.2 | 65983.003.1 | | 65983.3 | |
| 791 | 57447.026.1-T_at | NDRG2 | NM_016316 | 14q11.2 | 57447.026.1 | | 57447.26 | |
| 792 | 440421.001.1-F | | | | 440421.001.1 | | 440421.1 | |
| 793 | 301.008.1-D_at | ANXA1 | NM_000700 | 9q12-q21.2\|9q12-q21.2 | 301.008.1 | | 301.8 | |
| 794 | 80034.002.2-T_at | FAM130A2 | NM_024969 | 2q24.3 | 80034.002.2 | | 80034.2 | |
| 795 | 7153.002.5-B_at | TOP2A | NM_001067 | 17q21-q22 | 7153.002.5 | | 7153.2 | |
| 796 | 3852.023.1-T_at | KRT5 | NM_000424 | 12q12-q13 | 3852.023.1 | | 3852.23 | |
| 797 | 8404.013.1-F_at | SPARCL1 | NM_004684 | 4q22.1 | 8404.013.1 | | 8404.13 | |
| 798 | 2.018.1-C_at | A2M | NM_000014 | 12p13.3-p12.3 | 2.018.1 | | 2.18 | |
| 799 | 10124.003.1-B_at | ARL4A | NM_001037165 | 7p21-p15.3 | 10124.003.1 | | 10124.3 | |
| 800 | 3852.008.2-F_at | KRT5 | NM_000424 | 12q12-q13 | 3852.008.2 | | 3852.8 | |
| 801 | 4288.006.2-T_at | MKI67 | NM_002417 | 10q25-qter | 4288.006.2 | | 4288.6 | |
| 802 | 8404.026.1-C_at | SPARCL1 | NM_004684 | 4q22.1 | 8404.026.1 | | 8404.26 | |
| 803 | 23650.019.1-C_at | TRIM29 | NM_012101 | 11q22-q23 | 23650.019.1 | | 23650.19 | |
| 804 | 7170.027.1-T_at | TPM3 | NM_001043354 | 1q21.2 | 7170.027.1 | | 7170.27 | |
| 805 | 54928.003.1-E_at | IMPAD1 | NM_017813 | 8q12.1 | 54928.003.1 | | 54928.3 | |
| 806 | 2335.025.1-B_at | FN1 | NM_002034 | 2q34 | 2335.025.1 | | 2335.25 | |
| 807 | 3084.010.1-T_at | NRG1 | NM_004516 | 8p12 | 3084.010.1 | | 3084.10 | |
| 808 | 57447.051.1-T_at | NDRG2 | NM_016317 | 14q11.2 | 57447.051.1 | | 57447.51 | |
| 809 | 80034.003.4-T_at | FAM130A2 | NM_024969 | 2q24.3 | 80034.003.4 | | 80034.3 | |
| 810 | 2568.005.1-D_at | GABRP | NM_014211 | 5q33-q34 | 2568.005.1 | | 2568.5 | |
| 811 | 8404.032.1-F_at | SPARCL1 | NM_004684 | 4q22.1 | 8404.032.1 | | 8404.32 | |
| 812 | 2115.003.1-E_at | ETV1 | NM_004956 | 7p21.3 | 2115.003.1 | | 2115.3 | |
| 813 | 57447.035.1-T_at | NDRG2 | NM_016318 | 14q11.2 | 57447.035.1 | | 57447.35 | |
| 814 | 8404.009.1-T_at | SPARCL1 | NM_004684 | 4q22.1 | 8404.009.1 | | 8404.9 | |
| 815 | 8404.028.3-B_at | SPARCL1 | NM_004684 | 4q22.1 | 8404.028.3 | | 8404.28 | |
| 816 | 6289.003.1-B_at | SAA2 | NM_030754 | 11p15.1-p14 | 6289.003.1 | | 6289.3 | |
| 817 | 7170.025.1-F_at | TPM3 | NM_001043355 | 1q21.2 | 7170.025.1 | | 7170.25 | |
| 818 | 8404.030.1-D_at | SPARCL1 | NM_004684 | 4q22.1 | 8404.030.1 | | 8404.30 | |
| 819 | 8404.009.1-F_at | SPARCL1 | NM_004684 | 4q22.1 | 8404.009.1 | | 8404.9 | |
| 820 | 2335.009.1-T_at | FN1 | NM_002035 | 2q34 | 2335.009.1 | | 2335.9 | |
| 821 | 22974.007.1-F_at | TPX2 | NM_012112 | 20q11.2 | 22974.007.1 | | 22974.7 | |
| 822 | 3426.002.1-B_at | CFI | NM_000204 | 4q25 | 3426.002.1 | | 3426.2 | |
| 823 | 4638.003.1-D_at | MYLK | NM_005983 | 3q21 | 4638.003.1 | | 4638.3 | |
| 824 | 4147.011.1-T_at | MATN2 | NM_002381 | 8q22 | 4147.011.1 | | 4147.11 | |
| 825 | 6876.016.2-T_at | TAGLN | NM_001001527 | 11q23.2 | 6876.016.2 | | 6876.16 | |
| 826 | 23650.003.1-F_at | TRIM29 | NM_012101 | 11q22-q23 | 23650.003.1 | | 23650.3 | |
| 827 | 4744.004.1-E_at | NEFH | NM_021076 | 22q12.2 | 4744.004.1 | | 4744.4 | |
| 828 | 64168.010.1-F_at | EFCBP1 | NM_022351 | 8q21.3 | 64168.010.1 | | 64168.10 | |
| 829 | 9073.001.1-F_at | CLDN8 | NM_199328 | 21q22.11 | 9073.001.1 | | 9073.1 | |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 830 | 5288.001.3-B_at | PIK3C2G | NM_004570 | 12p12 | 5288.001.3 | | 5288.1 | |
| 831 | 3866.005.1-D_at | KRT15 | NM_002275 | 17q21.2 | 3866.005.1 | | 3866.5 | |
| 832 | 8404.021.1-T_at | SPARCL1 | NM_004684 | 4q22.1 | 8404.021.1 | | 8404.21 | |
| 833 | 25925.011.1-E_at | ZNF521 | NM_015461 | 18q11.2 | 25925.011.1 | | 25925.11 | |
| 834 | 23266.001.3-F_at | LPHN2 | NM_012302 | 1p31.1 | 23266.001.3 | | 23266.1 | |
| 835 | 9232.004.1-F_at | PTTG1 | NM_004219 | 5q35.1 | 9232.004.1 | | 9232.4 | |
| 836 | 4147.005.2-F_at | MATN2 | NM_002382 | 8q22 | 4147.005.2 | | 4147.5 | |
| 837 | 2335.025.3-B_at | FN1 | NM_002036 | 2q34 | 2335.025.3 | | 2335.25 | |
| 838 | 4638.006.1-C_at | MYLK | NM_005984 | 3q21 | 4638.006.1 | | 4638.6 | |
| 839 | 147804.004.1-T | LOC147804 | NM_001010856 | 19q13.41 | 147804.004.1 | | 147804.4 | |
| 840 | 81704.013.1-D_at | DOCK8 | NM_203447 | 9p24.3 | 81704.013.1 | | 81704.13 | |
| 841 | 54443.013.1-B_at | ANLN | NM_018685 | 7p15-p14 | 54443.013.1 | | 54443.13 | |
| 842 | 1410.005.1-T_at | CRYAB | NM_001885 | 11q22.3-q23.1 | 1410.005.1 | | 1410.5 | |
| 843 | 25925.009.1-T_at | ZNF521 | NM_015461 | 18q11.2 | 25925.009.1 | | 25925.9 | |
| 844 | 3204.001.1-T_at | HOXA7 | NM_006896 | 7p15-p14 | 3204.001.1 | | 3204.1 | |
| 845 | 29997.012.1-F_at | GLTSCR2 | NM_015710 | 19q13.3 | 29997.012.1 | | 29997.12 | |
| 846 | 2.005.1-C_at | A2M | NM_000014 | 12p13.3-p12.3 | 2.005.1 | | 2.5 | |
| 847 | 140885.011.1-F | SIRPA | NM_001040028 | 20p13 | 140885.011.1 | | 140885.11 | |
| 848 | 7153.002.3-F_at | TOP2A | NM_001067 | 17q21-q22 | 7153.002.3 | | 7153.2 | |
| 849 | 1063.002.1-F_at | CENPF | NM_016343 | 1q32-q41 | 1063.002.1 | | 1063.2 | |
| 850 | 10144.021.1-F_at | FAM13A1 | NM_001015046 | 4q22.1 | 10144.021.1 | | 10144.21 | |
| 851 | 8404.025.1-E_at | SPARCL1 | NM_004684 | 4q22.1 | 8404.025.1 | | 8404.25 | |
| 852 | 6876.020.1-B_at | TAGLN | NM_001001528 | 11q23.2 | 6876.020.1 | | 6876.20 | |
| 853 | 7170.006.1-C_at | TPM3 | NM_001043356 | 1q21.2 | 7170.006.1 | | 7170.6 | |
| 854 | 10051.016.1-T_at | SMC4 | NM_001002799 | 3q26.1 | 10051.016.1 | | 10051.16 | |
| 855 | 5288.001.2-D_at | PIK3C2G | NM_004570 | 12p12 | 5288.001.2 | | 5288.1 | |
| 856 | 7018.029.1-T_at | TF | NM_001063 | 3q22.1 | 7018.029.1 | | 7018.29 | |
| 857 | 5627.002.1-B_at | PROS1 | NM_000313 | 3q11.2 | 5627.002.1 | | 5627.2 | |
| 858 | 57447.037.1-T_at | NDRG2 | NM_016319 | 14q11.2 | 57447.037.1 | | 57447.37 | |
| 859 | 4147.005.2-D_at | MATN2 | NM_002383 | 8q22 | 4147.005.2 | | 4147.5 | |
| 860 | 8404.023.1-T_at | SPARCL1 | NM_004684 | 4q22.1 | 8404.023.1 | | 8404.23 | |
| 861 | 3872.006.1-D_at | KRT17 | NM_000422 | 17q12-q21 | 3872.006.1 | | 3872.6 | |
| 862 | 399687.001.1-C | MYO18A | NM_078471 | 17q11.2 | 399687.001.1 | | 399687.1 | |
| 863 | 3815.002.4-D_at | KIT | NM_000237 | 4q11-q12 | 3815.002.4 | | 3815.2 | |
| 864 | 59.034.2-B_at | ACTA2 | NM_001613 | 10q23.3 | 59.034.2 | | 59.34 | |
| 865 | 8404.035.1-T_at | SPARCL1 | NM_004684 | 4q22.1 | 8404.035.1 | | 8404.35 | |
| 866 | 8404.030.1-T_at | SPARCL1 | NM_004684 | 4q22.1 | 8404.030.1 | | 8404.30 | |
| 867 | 5997.002.2-T_at | TESC | NM_017899 | 12q24.22 | 54997.002.2 | | 54997.2 | |
| 868 | 57561.001.1-F_at | ARRDC3 | NM_020801 | 5q14.3 | 57561.001.1 | | 57561.1 | |
| 869 | 8404.031.1-T_at | SPARCL1 | NM_004684 | 4q22.1 | 8404.031.1 | | 8404.31 | |
| 870 | 2.025.1-E_at | A2M | NM_000014 | 12p13.3-p12.3 | 2.025.1 | | 2.25 | |
| 871 | 699.002.1-F_at | BUB1 | NM_004336 | 2q14 | 699.002.1 | | 699.2 | |
| 872 | 57447.041.1-F_at | NDRG2 | NM_016320 | 14q11.2 | 57447.041.1 | | 57447.41 | |
| 873 | 9055.013.1-D_at | PRC1 | NM_003981 | 15q26.1 | 9055.013.1 | | 9055.13 | |
| 874 | 8404.008.1-D_at | SPARCL1 | NM_004684 | 4q22.1 | 8404.008.1 | | 8404.8 | |
| 875 | 7018.028.1-T_at | TF | NM_001063 | 3q22.1 | 7018.028.1 | | 7018.28 | |
| 876 | 2568.005.1-T_at | GABRP | NM_014211 | 5q33-q34 | 2568.005.1 | | 2568.5 | |
| 877 | 10051.005.3-T_at | SMC4 | NM_001002800 | 3q26.1 | 10051.005.3 | | 10051.5 | |
| 878 | 2568.002.2-T_at | GABRP | NM_014211 | 5q33-q34 | 2568.002.2 | | 2568.2 | |
| 879 | 4147.004.1-F_at | MATN2 | NM_002384 | 8q22 | 4147.004.1 | | 4147.4 | |
| 880 | 2938.001.1-T_at | GSTA1 | NM_145740 | 6p12.1 | 2938.001.1 | | 2938.1 | |
| 881 | 1308.007.1-E_at | COL17A1 | NM_000506 | 10q24.3 | 1308.007.1 | | 1308.7 | |
| 882 | 2982.012.1-T_at | GUCY1A3 | NM_000856 | 4q31.3-q33\| 4q31.1-q31.2 | 2982.012.1 | | 2982.12 | |
| 883 | 8404.028.1-D_at | SPARCL1 | NM_004684 | 4q22.1 | 8404.028.1 | | 8404.28 | |
| 884 | 7373.001.2-B_at | COL14A1 | NM_021110 | 8q23 | 7373.001.2 | | 7373.1 | |
| 885 | 2893.002.2-B_at | GRIA4 | NM_000829 | 11q22 | 2893.002.2 | | 2893.2 | |
| 886 | 116369.006.4-C | SLC26A8 | NM_052961 | 6p21 | 116369.006.4 | | 116369.6 | |
| 887 | 6304.007.1-T_at | SATB1 | NM_002971 | 3p23 | 6304.007.1 | | 6304.7 | |
| 888 | 2335.035.1-T_at | FN1 | NM_002037 | 2q34 | 2335.035.1 | | 2335.35 | |
| 889 | 4751.002.1-T_at | NEK2 | NM_002497 | 1q32.2-q41 | 4751.002.1 | | 4751.2 | |
| 890 | 64151.001.2-T_at | NCAPG | NM_022346 | 4p15.33 | 64151.001.2 | | 64151.1 | |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 891 | 29089.003.1-T_at | UBE2T | NM_014176 | 1q32.1 | 29089.003.1 | | 29089.3 | |
| 892 | 59.031.1-B_at | ACTA2 | NM_001613 | 10q23.3 | 59.031.1 | | 59.31 | |
| 893 | 7018.025.1-T_at | TF | NM_001063 | 3q22.1 | 7018.025.1 | | 7018.25 | |
| 894 | 3860.008.1-T_at | KRT13 | NM_002276 | 17q12-q21.2 | 3860.008.1 | | 3860.8 | |
| 895 | 5858.003.3-F_at | PZP | NM_002864 | 12p13-p12.2 | 5858.003.3 | | 5858.3 | |
| 896 | 8404.009.1-C_at | SPARCL1 | NM_004684 | 4q22.1 | 8404.009.1 | | 8404.9 | |
| 897 | 7169.022.1-T_at | TPM2 | NM_003293 | 9p13.2-p13.1 | 7169.022.1 | | 7169.22 | |
| 898 | 25925.006.1-T_at | ZNF521 | NM_015461 | 18q11.2 | 25925.006.1 | | 25925.6 | |
| 899 | 59.049.1-F_at | ACTA2 | NM_001613 | 10q23.3 | 59.049.1 | | 59.49 | |
| 900 | 5284.003.1-T_at | PIGR | NM_002644 | 1q31-q41 | 5284.003.1 | | 5284.3 | |
| 901 | 2982.002.1-F_at | GUCY1A3 | NM_000856 | 4q31.3-q33\|4q31.1-q31.2 | 2982.002.1 | | 2982.2 | |
| 902 | 2568.002.1-T_at | GABRP | NM_014211 | 5q33-q34 | 2568.002.1 | | 2568.2 | |
| 903 | 301.004.1-B_at | ANXA1 | NM_000700 | 9q12-q21.2\|9q12-q21.2 | 301.004.1 | | 301.4 | |
| 904 | 25925.011.1-F_at | ZNF521 | NM_015461 | 18q11.2 | 25925.011.1 | | 25925.11 | |
| 905 | 59.004.1-F_at | ACTA2 | NM_001613 | 10q23.3 | 59.004.1 | | 59.4 | |
| 906 | 6289.002.1-B_at | SAA2 | NM_030754 | 11p15.1-p14 | 6289.002.1 | | 6289.2 | |
| 907 | 244.003.1-C_at | ANXA8L2 | NM_001630 | 10q11.22 | 244.003.1 | | 244.3 | |
| 908 | 11065.008.1-C_at | UBE2C | NM_007020 | 20q13.12 | 11065.008.1 | | 11065.8 | |
| 909 | 7091.006.1-T_at | TLE4 | NM_007005 | 9q21.31 | 7091.006.1 | | 7091.6 | |
| 910 | 79608.009.1-F_at | RIC3 | NM_024557 | 11p15.4 | 79608.009.1 | | 79608.9 | |
| 911 | 9413.002.1-T_at | C9orf61 | NM_004816 | 9q13-q21 | 9413.002.1 | | 9413.2 | |
| 912 | 7431.064.1-C_at | VIM | NM_003380 | 10p13 | 7431.064.1 | | 7431.64 | |
| 913 | 8404.029.1-E_at | SPARCL1 | NM_004684 | 4q22.1 | 8404.029.1 | | 8404.29 | |
| 914 | 6876.020.1-T_at | TAGLN | NM_001001529 | 11q23.2 | 6876.020.1 | | 6876.20 | |
| 915 | 301.005.1-T_at | ANXA1 | NM_000700 | 9q12-q21.2\|9q12-q21.2 | 301.005.1 | | 301.5 | |
| 916 | 9055.014.1-T_at | PRC1 | NM_003982 | 15q26.1 | 9055.014.1 | | 9055.14 | |
| 917 | 4281.023.1-T_at | MID1 | NM_000389 | Xp22 | 4281.023.1 | | 4281.23 | |
| 918 | 3868.005.1-D_at | KRT16 | NM_005557 | 17q12-q21 | 3868.005.1 | | 3868.5 | |
| 919 | 1062.001.6-B_at | CENPE | NM_001813 | 4q24-q25 | 1062.001.6 | | 1062.1 | |
| 920 | 5858.005.1-T_at | PZP | NM_002864 | 12p13-p12.2 | 5858.005.1 | | 5858.5 | |
| 921 | 51201.007.1-F_at | ZDHHC2 | NM_016353 | 8p21.3-p22 | 51201.007.1 | | 51201.7 | |
| 922 | 4240.001.1-B_at | MFGE8 | NM_005928 | 15q25 | 4240.001.1 | | 4240.1 | |
| 923 | 8404.029.1-T_at | SPARCL1 | NM_004684 | 4q22.1 | 8404.029.1 | | 8404.29 | |
| 924 | 9413.001.1-T_at | C9orf61 | NM_004816 | 9q13-q21 | 9413.001.1 | | 9413.1 | |
| 925 | 9768.005.1-T_at | KIAA0101 | NM_001029993 | 15q22.31 | 9768.005.1 | | 9768.5 | |
| 926 | 11197.001.1-T_at | WIF1 | NM_007191 | 12q14.3 | 11197.001.1 | | 11197.1 | |
| 927 | 6285.002.1-T_at | S100B | NM_006272 | 21q22.3 | 6285.002.1 | | 6285.2 | |
| 928 | 2335.006.2-F_at | FN1 | NM_002038 | 2q34 | 2335.006.2 | | 2335.6 | |
| 929 | 7169.001.1-C_at | TPM2 | NM_003294 | 9p13.2-p13.1 | 7169.001.1 | | 7169.1 | |
| 930 | 9493.004.1-T_at | KIF23 | NM_004856 | 15q23 | 9493.004.1 | | 9493.4 | |
| 931 | 4601.014.1-T_at | MXI1 | NM_001008541 | 10q24-q25 | 4601.014.1 | | 4601.14 | |
| 932 | 51203.002.2-F_at | NUSAP1 | NM_016361 | 15q15.1 | 51203.002.2 | | 51203.2 | |
| 933 | 7018.022.1-F_at | TF | NM_001063 | 3q22.1 | 7018.022.1 | | 7018.22 | |
| 934 | 4288.009.1-F_at | MKI67 | NM_002417 | 10q25-qter | 4288.009.1 | | 4288.9 | |
| 935 | 8321.004.1-D_at | FZD1 | NM_003505 | 7q21 | 8321.004.1 | | 8321.4 | |
| 936 | 8564.004.1-E_at | KMO | NM_003679 | 1q42-q44 | 8564.004.1 | | 8564.4 | |
| 937 | 7169.022.1-C_at | TPM2 | NM_003295 | 9p13.2-p13.1 | 7169.022.1 | | 7169.22 | |
| 938 | 29127.013.1-T_at | RACGAP1 | NM_013277 | 12q13.13 | 29127.013.1 | | 29127.13 | |
| 939 | 2.018.1-B_at | A2M | NM_000014 | 12p13.3-p12.3 | 2.018.1 | | 2.18 | |
| 940 | 2.005.1-D_at | A2M | NM_000014 | 12p13.3-p12.3 | 2.005.1 | | 2.5 | |
| 941 | 1058.004.2-T_at | CENPA | NM_001042426 | 2p24-p21 | 1058.004.2 | | 1058.4 | |
| 942 | 2232.014.1-C_at | FDXR | NM_004110 | 17q24-q25 | 2232.014.1 | | 2232.14 | |
| 943 | 23650.005.1-E_at | TRIM29 | NM_012101 | 11q22-q23 | 23650.005.1 | | 23650.5 | |
| 944 | 5621.002.2-T_at | PRNP | NM_000311 | 20p13 | 5621.002.2 | | 5621.2 | |
| 945 | 51201.005.1-B_at | ZDHHC2 | NM_016353 | 8p21.3-p22 | 51201.005.1 | | 51201.5 | |
| 946 | 667.022.1-F_at | DST | NM_001727 | 6p12.1 | 667.022.1 | | 667.22 | |
| 947 | 54443.012.1-C_at | ANLN | NM_018685 | 7p15-p14 | 54443.012.1 | | 54443.12 | |
| 948 | 25802.003.1-C_at | LMOD1 | NM_012134 | 1q32 | 25802.003.1 | | 25802.3 | |
| 949 | 3479.003.1-T_at | IGF1 | NM_000618 | 12q22-q23 | 3479.003.1 | | 3479.3 | |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 950 | 94274.003.1-D_at | PPP1R14A | NM_033256 | 19q13.1 | 94274.003.1 | | 94274.3 | |
| 951 | 84668.003.1-T_at | FAM126A | NM_032581 | 7p15.3 | 84668.003.1 | | 84668.3 | |
| 952 | 22974.008.1-E_at | TPX2 | NM_012112 | 20q11.2 | 22974.008.1 | | 22974.8 | |
| 953 | 55656.007.3-B_at | INTS8 | NM_017864 | 8q22.1 | 55656.007.3 | | 55656.7 | |
| 954 | 29127.002.1-T_at | RACGAP1 | NM_013277 | 12q13.13 | 29127.002.1 | | 29127.2 | |
| 955 | 4281.012.2-T_at | MID1 | NM_000390 | Xp22 | 4281.012.2 | | 4281.12 | |
| 956 | 2335.013.1-B_at | FN1 | NM_002039 | 2q34 | 2335.013.1 | | 2335.13 | |
| 957 | 79627.003.1-B_at | OGFRL1 | NM_024576 | 6q13 | 79627.003.1 | | 79627.3 | |
| 958 | 2982.014.1-T_at | GUCY1A3 | NM_000856 | 4q31.3-q33\|4q31.1-q31.2 | 2982.014.1 | | 2982.14 | |
| 959 | 2335.053.1-T_at | FN1 | NM_002040 | 2q34 | 2335.053.1 | | 2335.53 | |
| 960 | 667.001.1-F_at | DST | NM_001728 | 6p12.1 | 667.001.1 | | 667.1 | |
| 961 | 8404.030.1-B_at | SPARCL1 | NM_004684 | 4q22.1 | 8404.030.1 | | 8404.30 | |
| 962 | 2335.025.1-C_at | FN1 | NM_002041 | 2q34 | 2335.025.1 | | 2335.25 | |
| 963 | 140885.010.3-D | SIRPA | NM_001040029 | 20p13 | 140885.010.3 | | 140885.10 | |
| 964 | 55366.001.2-F_at | LGR4 | NM_018490 | 11p14-p13 | 55366.001.2 | | 55366.1 | |
| 965 | 7169.015.1-D_at | TPM2 | NM_003296 | 9p13.2-p13.1 | 7169.015.1 | | 7169.15 | |
| 966 | 57447.002.1-B_at | NDRG2 | NM_016321 | 14q11.2 | 57447.002.1 | | 57447.2 | |
| 967 | 22974.008.1-T_at | TPX2 | NM_012112 | 20q11.2 | 22974.008.1 | | 22974.8 | |
| 968 | 6876.011.1-C_at | TAGLN | NM_001001530 | 11q23.2 | 6876.011.1 | | 6876.11 | |
| 969 | 4281.008.2-D_at | MID1 | NM_000391 | Xp22 | 4281.008.2 | | 4281.8 | |
| 970 | 59.008.1-T_at | ACTA2 | NM_001613 | 10q23.3 | 59.008.1 | | 59.8 | |
| 971 | 23266.008.1-F_at | LPHN2 | NM_012302 | 1p31.1 | 23266.008.1 | | 23266.8 | |
| 972 | 2568.003.2-T_at | GABRP | NM_014211 | 5q33-q34 | 2568.003.2 | | 2568.3 | |
| 973 | 5311.003.1-T_at | PKD2 | NM_000297 | 4q21-q23 | 5311.003.1 | | 5311.3 | |
| 974 | 6304.011.1-T_at | SATB1 | NM_002971 | 3p23 | 6304.011.1 | | 6304.11 | |
| 975 | 3861.008.1-B_at | KRT14 | NM_000526 | 17q12-q21 | 3861.008.1 | | 3861.8 | |
| 976 | 7018.013.1-B_at | TF | NM_001063 | 3q22.1 | 7018.013.1 | | 7018.13 | |
| 977 | 8404.005.1-F_at | SPARCL1 | NM_004684 | 4q22.1 | 8404.005.1 | | 8404.5 | |
| 978 | 7170.027.1-C_at | TPM3 | NM_001043357 | 1q21.2 | 7170.027.1 | | 7170.27 | |
| 979 | 8404.023.1-C_at | SPARCL1 | NM_004684 | 4q22.1 | 8404.023.1 | | 8404.23 | |
| 980 | 7373.007.1-C_at | COL14A1 | NM_021110 | 8q23 | 7373.007.1 | | 7373.7 | |
| 981 | 1410.009.1-T_at | CRYAB | NM_001885 | 11q22.3-q23.1 | 1410.009.1 | | 1410.9 | |
| 982 | 79745.004.3-D_at | CLIP4 | NM_024692 | 2p23.2 | 79745.004.3 | | 79745.4 | |
| 983 | 24137.004.1-T_at | KIF4A | NM_012310 | Xq13.1 | 24137.004.1 | | 24137.4 | |
| 984 | 6241.013.1-B_at | RRM2 | NM_001034 | 2p25-p24 | 6241.013.1 | | 6241.13 | |
| 985 | 1410.001.1-T_at | CRYAB | NM_001885 | 11q22.3-q23.1 | 1410.001.1 | | 1410.1 | |
| 986 | 4781.015.2-B_at | NFIB | NM_005596 | 9p24.1 | 4781.015.2 | | 4781.15 | |
| 987 | 72.002.1-T_at | ACTG2 | NM_001615 | 2p13.1 | 72.002.1 | | 72.2 | |
| 988 | 4833.004.1-D_at | NME4 | NM_005009 | 16p13.3 | 4833.004.1 | | 4833.4 | |
| 989 | 57447.024.1-D_at | NDRG2 | NM_016322 | 14q11.2 | 57447.024.1 | | 57447.24 | |
| 990 | 2982.013.2-T_at | GUCY1A3 | NM_000856 | 4q31.3-q33\|4q31.1-q31.2 | 2982.013.2 | | 2982.13 | |
| 991 | 79971.012.1-T_at | GPR177 | NM_001002292 | 1p31.3 | 79971.012.1 | | 79971.12 | |
| 992 | 8404.028.3-C_at | SPARCL1 | NM_004684 | 4q22.1 | 8404.028.3 | | 8404.28 | |
| 993 | 4638.011.1-E_at | MYLK | NM_005985 | 3q21 | 4638.011.1 | | 4638.11 | |
| 994 | 7169.004.1-C_at | TPM2 | NM_003297 | 9p13.2-p13.1 | 7169.004.1 | | 7169.4 | |
| 995 | 4288.004.1-F_at | MKI67 | NM_002417 | 10q25-qter | 4288.004.1 | | 4288.4 | |
| 996 | 59.012.2-C_at | ACTA2 | NM_001613 | 10q23.3 | 59.012.2 | | 59.12 | |
| 997 | 301.008.1-B_at | ANXA1 | NM_000700 | 9q12-q21.2\|9q12-q21.2 | 301.008.1 | | 301.8 | |
| 998 | 4281.012.1-T_at | MID1 | NM_000381; | Xp22 | 4281.012.1 | | 4281.12 | |
| 999 | 2335.016.1-F_at | FN1 | NM_002042 | 2q34 | 2335.016.1 | | 2335.16 | |
| 1000 | 259266.003.1-C | ASPM | NM_018136 | 1q31 | 259266.003.1 | | 259266.3 | |
| 1001 | 9055.020.1-T_at | PRC1 | NM_003983 | 15q26.1 | 9055.020.1 | | 9055.20 | |
| 1002 | 7091.016.1-T_at | TLE4 | NM_007005 | 9q21.31 | 7091.016.1 | | 7091.16 | |
| 1003 | 59.023.1-T_at | ACTA2 | NM_001613 | 10q23.3 | 59.023.1 | | 59.23 | |
| 1004 | 57162.010.1-B_at | PELI1 | NM_020651 | 2p13.3 | 57162.010.1 | | 57162.10 | |
| 1005 | 4781.002.2-D_at | NFIB | NM_005596 | 9p24.1 | 4781.002.2 | | 4781.2 | |
| 1006 | 6122.037.1-T_at | RPL3 | NM_000967 | 22q13 | 6122.037.1 | | 6122.37 | |
| 1007 | 4240.015.1-B_at | MFGE8 | NM_005928 | 15q25 | 4240.015.1 | | 4240.15 | |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 1008 | 59.034.1-T_at | ACTA2 | NM_001613 | 10q23.3 | 59.034.1 | | 59.34 | |
| 1009 | 8404.004.2-D_at | SPARCL1 | NM_004684 | 4q22.1 | 8404.004.2 | | 8404.4 | |
| 1010 | 9413.001.2-T_at | C9orf61 | NM_004816 | 9q13-q21 | 9413.001.2 | | 9413.1 | |
| 1011 | 2.005.1-F_at | A2M | NM_000014 | 12p13.3-p12.3 | 2.005.1 | | 2.5 | |
| 1012 | 6304.002.1-T_at | SATB1 | NM_002971 | 3p23 | 6304.002.1 | | 6304.2 | |
| 1013 | 3852.005.1-C_at | KRT5 | NM_000424 | 12q12-q13 | 3852.005.1 | | 3852.5 | |
| 1014 | 7170.027.1-B_at | TPM3 | NM_001043358 | 1q21.2 | 7170.027.1 | | 7170.27 | |
| 1015 | 301.013.1-T_at | ANXA1 | NM_000700 | 9q12-q21.2\|9q12-q21.2 | 301.013.1 | | 301.13 | |
| 1016 | 6304.012.1-F_at | SATB1 | NM_002971 | 3p23 | 6304.012.1 | | 6304.12 | |
| 1017 | 57447.051.2-T_at | NDRG2 | NM_016323 | 14q11.2 | 57447.051.2 | | 57447.51 | |
| 1018 | 11065.005.1-C_at | UBE2C | NM_007021 | 20q13.12 | 11065.005.1 | | 11065.5 | |
| 1019 | 6422.002.1-F_at | SFRP1 | NM_003012 | 8p12-p11.1 | 6422.002.1 | | 6422.2 | |
| 1020 | 6241.013.1-F_at | RRM2 | NM_001034 | 2p25-p24 | 6241.013.1 | | 6241.13 | |
| 1021 | 2335.032.1-T_at | FN1 | NM_002043 | 2q34 | 2335.032.1 | | 2335.32 | |
| 1022 | 11065.005.2-T_at | UBE2C | NM_007022 | 20q13.12 | 11065.005.2 | | 11065.5 | |
| 1023 | 2335.028.1-D_at | FN1 | NM_002044 | 2q34 | 2335.028.1 | | 2335.28 | |
| 1024 | 29997.016.1-F_at | GLTSCR2 | NM_015710 | 19q13.3 | 29997.016.1 | | 29997.16 | |
| 1025 | 7018.014.1-T_at | TF | NM_001063 | 3q22.1 | 7018.014.1 | | 7018.14 | |
| 1026 | 1410.011.1-E_at | CRYAB | NM_001885 | 11q22.3-q23.1 | 1410.011.1 | | 1410.11 | |
| 1027 | 7170.040.1-E_at | TPM3 | NM_001043359 | 1q21.2 | 7170.040.1 | | 7170.40 | |
| 1028 | 6289.002.2-F_at | SAA2 | NM_030754 | 11p15.1-p14 | 6289.002.2 | | 6289.2 | |
| 1029 | 7373.003.4-C_at | COL14A1 | NM_021110 | 8q23 | 7373.003.4 | | 7373.3 | |
| 1030 | 7170.041.1-E_at | TPM3 | NM_001043360 | 1q21.2 | 7170.041.1 | | 7170.41 | |
| 1031 | 128553.003.1-B | TSHZ2 | NM_173485 | 20q13.2 | 128553.003.1 | | 128553.3 | |
| 1032 | 4094.002.1-D_at | MAF | NM_001031805 | 16q22-q23 | 4094.002.1 | | 4094.2 | |
| 1033 | 7113.011.1-T_at | TMPRSS2 | NM_005656 | 21q22.3 | 7113.011.1 | | 7113.11 | |
| 1034 | 7170.002.1-C_at | TPM3 | NM_001043361 | 1q21.2 | 7170.002.1 | | 7170.2 | |
| 1035 | 8404.017.2-T_at | SPARCL1 | NM_004684 | 4q22.1 | 8404.017.2 | | 8404.17 | |
| 1036 | 59.029.1-T_at | ACTA2 | NM_001613 | 10q23.3 | 59.029.1 | | 59.29 | |
| 1037 | 29089.001.1-T_at | UBE2T | NM_014176 | 1q32.1 | 29089.001.1 | | 29089.1 | |
| 1038 | 358.012.1-T_at | AQP1 | NM_198098 | 7p14 | 358.012.1 | | 358.12 | |
| 1039 | 9134.001.1-B_at | CCNE2 | NM_057735 | 8q22.1 | 9134.001.1 | | 9134.1 | |
| 1040 | 2335.013.1-C_at | FN1 | NM_002045 | 2q34 | 2335.013.1 | | 2335.13 | |
| 1041 | 1410.010.1-T_at | CRYAB | NM_001885 | 11q22.3-q23.1 | 1410.010.1 | | 1410.10 | |
| 1042 | 2327.003.4-F_at | FMO2 | NM_001460 | 1q23-q25 | 2327.003.4 | | 2327.3 | |
| 1043 | 59.042.1-T_at | ACTA2 | NM_001613 | 10q23.3 | 59.042.1 | | 59.42 | |
| 1044 | 6304.007.2-T_at | SATB1 | NM_002971 | 3p23 | 6304.007.2 | | 6304.7 | |
| 1045 | 8404.031.1-B_at | SPARCL1 | NM_004684 | 4q22.1 | 8404.031.1 | | 8404.31 | |
| 1046 | 6289.001.1-F_at | SAA2 | NM_030754 | 11p15.1-p14 | 6289.001.1 | | 6289.1 | |
| 1047 | 1410.006.1-T_at | CRYAB | NM_001885 | 11q22.3-q23.1 | 1410.006.1 | | 1410.6 | |
| 1048 | 80034.004.1-T_at | FAM130A2 | NM_024969 | 2q24.3 | 80034.004.1 | | 80034.4 | |
| 1049 | 1410.008.1-T_at | CRYAB | NM_001885 | 11q22.3-q23.1 | 1410.008.1 | | 1410.8 | |
| 1050 | 57447.051.2-D_at | NDRG2 | NM_016324 | 14q11.2 | 57447.051.2 | | 57447.51 | |
| 1051 | 7170.016.3-B_at | TPM3 | NM_001043362 | 1q21.2 | 7170.016.3 | | 7170.16 | |
| 1052 | 4240.001.1-C_at | MFGE8 | NM_005928 | 15q25 | 4240.001.1 | | 4240.1 | |
| 1053 | 6288.001.1-T_at | SAA1 | NM_000331 | 11p15.1 | 6288.001.1 | | 6288.1 | |
| 1054 | 7018.014.1-C_at | TF | NM_001063 | 3q22.1 | 7018.014.1 | | 7018.14 | |
| 1055 | 8404.020.1-T_at | SPARCL1 | NM_004684 | 4q22.1 | 8404.020.1 | | 8404.20 | |
| 1056 | 6289.001.2-F_at | SAA2 | NM_030754 | 11p15.1-p14 | 6289.001.2 | | 6289.1 | |
| 1057 | 6876.011.1-F_at | TAGLN | NM_001001531 | 11q23.2 | 6876.011.1 | | 6876.11 | |
| 1058 | 8404.031.1-C_at | SPARCL1 | NM_004684 | 4q22.1 | 8404.031.1 | | 8404.31 | |
| 1059 | 57447.010.1-T_at | NDRG2 | NM_016325 | 14q11.2 | 57447.010.1 | | 57447.10 | |
| 1060 | 1410.007.2-C_at | CRYAB | NM_001885 | 11q22.3-q23.1 | 1410.007.2 | | 1410.7 | |
| 1061 | 59.012.2-B_at | ACTA2 | NM_001613 | 10q23.3 | 59.012.2 | | 59.12 | |
| 1062 | 3459.005.1-T_at | IFNGR1 | NM_000416 | 6q23-q24 | 3459.005.1 | | 3459.5 | |
| 1063 | 301.013.1-C_at | ANXA1 | NM_000700 | 9q12-q21.2\|9q12-q21.2 | 301.013.1 | | 301.13 | |
| 1064 | 83539.001.1-D_at | CHST9 | NM_031422 | 18q11.2 | 83539.001.1 | | 83539.1 | |
| 1065 | 6288.004.1-F_at | SAA1 | NM_000332 | 11p15.1 | 6288.004.1 | | 6288.4 | |
| 1066 | 4781.016.1-E_at | NFIB | NM_005596 | 9p24.1 | 4781.016.1 | | 4781.16 | |
| 1067 | 29997.012.1-E_at | GLTSCR2 | NM_015710 | 19q13.3 | 29997.012.1 | | 29997.12 | |
| 1068 | 57447.021.1-T_at | NDRG2 | NM_016326 | 14q11.2 | 57447.021.1 | | 57447.21 | |
| 1069 | 3426.002.1-C_at | CFI | NM_000204 | 4q25 | 3426.002.1 | | 3426.2 | |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 1070 | 53829.001.2-T_at | P2RY13 | NM_023914 | 3q24 | 53829.001.2 | | 53829.1 | |
| 1071 | 2115.001.2-B_at | ETV1 | NM_004956 | 7p21.3 | 2115.001.2 | | 2115.1 | |
| 1072 | 10051.008.1-T_at | SMC4 | NM_001002801 | 3q26.1 | 10051.008.1 | | 10051.8 | |
| 1073 | 1033.002.1-T_at | CDKN3 | NM_005192 | 14q22 | 1033.002.1 | | 1033.2 | |
| 1074 | 2335.005.1-D_at | FN1 | NM_002046 | 2q34 | 2335.005.1 | | 2335.5 | |
| 1075 | 7113.009.1-T_at | TMPRSS2 | NM_005656 | 21q22.3 | 7113.009.1 | | 7113.9 | |
| 1076 | 3866.002.1-B_at | KRT15 | NM_002275 | 17q21.2 | 3866.002.1 | | 3866.2 | |
| 1077 | 140885.014.1-D | SIRPA | NM_001040030 | 20p13 | 140885.014.1 | | 140885.14 | |
| 1078 | 7168.003.1-T_at | TPM1 | NM_000366 | 15q22.1 | 7168.003.1 | | 7168.3 | |
| 1079 | 79608.001.1-T_at | RIC3 | NM_024557 | 11p15.4 | 79608.001.1 | | 79608.1 | |
| 1080 | 79608.008.2-F_at | RIC3 | NM_024557 | 11p15.4 | 79608.008.2 | | 79608.8 | |
| 1081 | 1410.001.1-B_at | CRYAB | NM_001885 | 11q22.3-q23.1 | 1410.001.1 | | 1410.1 | |
| 1082 | 7113.010.1-T_at | TMPRSS2 | NM_005656 | 21q22.3 | 7113.010.1 | | 7113.10 | |
| 1083 | 4781.014.2-B_at | NFIB | NM_005596 | 9p24.1 | 4781.014.2 | | 4781.14 | |
| 1084 | 2335.016.1-E_at | FN1 | NM_002047 | 2q34 | 2335.016.1 | | 2335.16 | |
| 1085 | 11065.003.1-T_at | UBE2C | NM_007023 | 20q13.12 | 11065.003.1 | | 11065.3 | |
| 1086 | 3872.006.1-T_at | KRT17 | NM_000422 | 17q12-q21 | 3872.006.1 | | 3872.6 | |
| 1087 | 3084.005.1-F_at | NRG1 | NM_004517 | 8p12 | 3084.005.1 | | 3084.5 | |
| 1088 | 6285.003.1-T_at | S100B | NM_006272 | 21q22.3 | 6285.003.1 | | 6285.3 | |
| 1089 | 6876.016.2-F_at | TAGLN | NM_001001532 | 11q23.2 | 6876.016.2 | | 6876.16 | |
| 1090 | 8404.004.1-T_at | SPARCL1 | NM_004684 | 4q22.1 | 8404.004.1 | | 8404.4 | |
| 1091 | 54829.001.1-F_at | ASPN | NM_017680 | 9q22 | 54829.001.1 | | 54829.1 | |
| 1092 | 8404.001.1-T_at | SPARCL1 | NM_004684 | 4q22.1 | 8404.001.1 | | 8404.1 | |
| 1093 | 9055.011.1-E_at | PRC1 | NM_003984 | 15q26.1 | 9055.011.1 | | 9055.11 | |
| 1094 | 6289.003.2-F_at | SAA2 | NM_030754 | 11p15.1-p14 | 6289.003.2 | | 6289.3 | |
| 1095 | 22974.007.1-T_at | TPX2 | NM_012112 | 20q11.2 | 22974.007.1 | | 22974.7 | |
| 1096 | 59.023.2-T_at | ACTA2 | NM_001613 | 10q23.3 | 59.023.2 | | 59.23 | |
| 1097 | 7169.015.1-T_at | TPM2 | NM_003298 | 9p13.2-p13.1 | 7169.015.1 | | 7169.15 | |
| 1098 | 6289.002.1-F_at | SAA2 | NM_030754 | 11p15.1-p14 | 6289.002.1 | | 6289.2 | |
| 1099 | 4288.008.1-B_at | MKI67 | NM_002417 | 10q25-qter | 4288.008.1 | | 4288.8 | |
| 1100 | 4781.007.1-B_at | NFIB | NM_005596 | 9p24.1 | 4781.007.1 | | 4781.7 | |
| 1101 | 6876.023.1-T_at | TAGLN | NM_001001533 | 11q23.2 | 6876.023.1 | | 6876.23 | |
| 1102 | 9055.017.1-F_at | PRC1 | NM_003985 | 15q26.1 | 9055.017.1 | | 9055.17 | |
| 1103 | 7170.018.2-D_at | TPM3 | NM_001043363 | 1q21.2 | 7170.018.2 | | 7170.18 | |
| 1104 | 4781.014.2-D_at | NFIB | NM_005596 | 9p24.1 | 4781.014.2 | | 4781.14 | |
| 1105 | 7170.025.1-T_at | TPM3 | NM_001043364 | 1q21.2 | 7170.025.1 | | 7170.25 | |
| 1106 | 7018.025.1-B_at | TF | NM_001063 | 3q22.1 | 7018.025.1 | | 7018.25 | |
| 1107 | 10253.003.1-T_at | SPRY2 | NM_005842 | 13q31.1 | 10253.003.1 | | 10253.3 | |
| 1108 | 57447.039.1-D_at | NDRG2 | NM_016327 | 14q11.2 | 57447.039.1 | | 57447.39 | |
| 1109 | 59.022.1-T_at | ACTA2 | NM_001613 | 10q23.3 | 59.022.1 | | 59.22 | |
| 1110 | 2982.015.1-F_at | GUCY1A3 | NM_000856 | 4q31.3-q33\|4q31.1-q31.2 | 2982.015.1 | | 2982.15 | |
| 1111 | 10124.004.2-F_at | ARL4A | NM_001037166 | 7p21-p15.3 | 10124.004.2 | | 10124.4 | |
| 1112 | 6289.001.1-B_at | SAA2 | NM_030754 | 11p15.1-p14 | 6289.001.1 | | 6289.1 | |
| 1113 | 7091.005.1-F_at | TLE4 | NM_007005 | 9q21.31 | 7091.005.1 | | 7091.5 | |
| 1114 | 501.006.1-B_at | ALDH7A1 | NM_001182 | 5q31 | 501.006.1 | | 501.6 | |
| 1115 | 1410.001.1-C_at | CRYAB | NM_001885 | 11q22.3-q23.1 | 1410.001.1 | | 1410.1 | |
| 1116 | 57447.021.1-C_at | NDRG2 | NM_016328 | 14q11.2 | 57447.021.1 | | 57447.21 | |
| 1117 | 244.012.1-B_at | ANXA8L2 | NM_001630 | 10q11.22 | 244.012.1 | | 244.12 | |
| 1118 | 7018.026.1-F_at | TF | NM_001063 | 3q22.1 | 7018.026.1 | | 7018.26 | |
| 1119 | 3872.018.1-T_at | KRT17 | NM_000422 | 17q12-q21 | 3872.018.1 | | 3872.18 | |
| 1120 | 10144.017.3-T_at | FAM13A1 | NM_001015047 | 4q22.1 | 10144.017.3 | | 10144.17 | |
| 1121 | 11197.001.1-F_at | WIF1 | NM_007191 | 12q14.3 | 11197.001.1 | | 11197.1 | |
| 1122 | 29127.007.1-B_at | RACGAP1 | NM_013277 | 12q13.13 | 29127.007.1 | | 29127.7 | |
| 1123 | 10010.004.1-F_at | TANK | NM_004181 | 2q24-q31 | 10010.004.1 | | 10010.4 | |
| 1124 | 81704.013.1-C_at | DOCK8 | NM_203447 | 9p24.3 | 81704.013.1 | | 81704.13 | |
| 1125 | 4781.006.2-B_at | NFIB | NM_005596 | 9p24.1 | 4781.006.2 | | 4781.6 | |
| 1126 | 7373.003.1-F_at | COL14A1 | NM_021110 | 8q23 | 7373.003.1 | | 7373.3 | |
| 1127 | 8404.009.1-D_at | SPARCL1 | NM_004684 | 4q22.1 | 8404.009.1 | | 8404.9 | |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 1128 | 23092.004.1-T_at | ARHGAP26 | NM_015071 | 5q31 | 23092.004.1 | | 23092.4 | |
| 1129 | 2335.002.1-F_at | FN1 | NM_002048 | 2q34 | 2335.002.1 | | 2335.2 | |
| 1130 | 8404.031.1-F_at | SPARCL1 | NM_004684 | 4q22.1 | 8404.031.1 | | 8404.31 | |
| 1131 | 6304.006.2-T_at | SATB1 | NM_002971 | 3p23 | 6304.006.2 | | 6304.6 | |
| 1132 | 1410.008.1-E_at | CRYAB | NM_001885 | 11q22.3-q23.1 | 1410.008.1 | | 1410.8 | |
| 1133 | 9055.019.1-F_at | PRC1 | NM_003986 | 15q26.1 | 9055.019.1 | | 9055.19 | |
| 1134 | 1398.001.1-D_at | CRK | NM_000509 | 17p13.3 | 1398.001.1 | | 1398.1 | |
| 1135 | 57447.051.1-E_at | NDRG2 | NM_016329 | 14q11.2 | 57447.051.1 | | 57447.51 | |
| 1136 | 339965.001.2-B | FLJ25770 | NM_001042784 | 4q21.1 | 339965.001.2 | | 339965.1 | |
| 1137 | 7113.001.1-C_at | TMPRSS2 | NM_005656 | 21q22.3 | 7113.001.1 | | 7113.1 | |
| 1138 | 4240.009.1-D_at | MFGE8 | NM_005928 | 15q25 | 4240.009.1 | | 4240.9 | |
| 1139 | 7153.002.4-B_at | TOP2A | NM_001067 | 17q21-q22 | 7153.002.4 | | 7153.2 | |
| 1140 | 7169.004.1-D_at | TPM2 | NM_003299 | 9p13.2-p13.1 | 7169.004.1 | | 7169.4 | |
| 1141 | 1410.001.1-D_at | CRYAB | NM_001885 | 11q22.3-q23.1 | 1410.001.1 | | 1410.1 | |
| 1142 | 59.015.2-B_at | ACTA2 | NM_001613 | 10q23.3 | 59.015.2 | | 59.15 | |
| 1143 | 4833.010.1-T_at | NME4 | NM_005009 | 16p13.3 | 4833.010.1 | | 4833.10 | |
| 1144 | 7169.022.1-B_at | TPM2 | NM_003300 | 9p13.2-p13.1 | 7169.022.1 | | 7169.22 | |
| 1145 | 11065.005.1-T_at | UBE2C | NM_007024 | 20q13.12 | 11065.005.1 | | 11065.5 | |
| 1146 | 7170.018.2-T_at | TPM3 | NM_001043365 | 1q21.2 | 7170.018.2 | | 7170.18 | |
| 1147 | 79971.013.2-F_at | GPR177 | NM_001002293 | 1p31.3 | 79971.013.2 | | 79971.13 | |
| 1148 | 152015.005.2-F | ROPN1B | NM_001012337 | 3q21.2 | 152015.005.2 | | 152015.5 | |
| 1149 | 4288.005.1-D_at | MKI67 | NM_002417 | 10q25-qter | 4288.005.1 | | 4288.5 | |
| 1150 | 8404.002.1-T_at | SPARCL1 | NM_004684 | 4q22.1 | 8404.002.1 | | 8404.2 | |
| 1151 | 6441.004.1-E_at | SFTPD | NM_003019 | 10q22.2-q23.1 | 6441.004.1 | | 6441.4 | |
| 1152 | 6122.046.1-B_at | RPL3 | NM_000967 | 22q13 | 6122.046.1 | | 6122.46 | |
| 1153 | 115908.002.1-T | CTHRC1 | NM_138455 | 8q22.3 | 115908.002.1 | | 115908.2 | |
| 1154 | 9481.001.1-F_at | SLC25A27 | NM_004277 | 6p11.2-q12 | 9481.001.1 | | 9481.1 | |
| 1155 | 8404.008.1-T_at | SPARCL1 | NM_004684 | 4q22.1 | 8404.008.1 | | 8404.8 | |
| 1156 | 1410.007.1-D_at | CRYAB | NM_001885 | 11q22.3-q23.1 | 1410.007.1 | | 1410.7 | |
| 1157 | 8404.030.1-C_at | SPARCL1 | NM_004684 | 4q22.1 | 8404.030.1 | | 8404.30 | |
| 1158 | 57447.039.1-T_at | NDRG2 | NM_016330 | 14q11.2 | 57447.039.1 | | 57447.39 | |
| 1159 | 4147.004.1-E_at | MATN2 | NM_002385 | 8q22 | 4147.004.1 | | 4147.4 | |
| 1160 | 2335.024.2-F_at | FN1 | NM_002049 | 2q34 | 2335.024.2 | | 2335.24 | |
| 1161 | 891.007.1-T_at | CCNB1 | NM_031966 | 5q12 | 891.007.1 | | 891.7 | |
| 1162 | 2335.002.1-T_at | FN1 | NM_002050 | 2q34 | 2335.002.1 | | 2335.2 | |
| 1163 | 8404.017.1-T_at | SPARCL1 | NM_004684 | 4q22.1 | 8404.017.1 | | 8404.17 | |
| 1164 | 57451.004.1-B_at | ODZ2 | NM_001080428 | 5q34-q35.1 | 57451.004.1 | | 57451.4 | |
| 1165 | 8404.001.1-F_at | SPARCL1 | NM_004684 | 4q22.1 | 8404.001.1 | | 8404.1 | |
| 1166 | 8626.006.2-B_at | TP63 | NM_003722 | 3q28 | 8626.006.2 | | 8626.6 | |
| 1167 | 2335.025.1-T_at | FN1 | NM_002051 | 2q34 | 2335.025.1 | | 2335.25 | |
| 1168 | 6286.001.1-T_at | S100P | NM_005980 | 4p16 | 6286.001.1 | | 6286.1 | |
| 1169 | 10580.012.1-C_at | SORBS1 | NM_001034954 | 10q23.3-q24.1 | 10580.012.1 | | 10580.12 | |
| 1170 | 23321.014.1-T_at | TRIM2 | NM_015271 | 4q31.3 | 23321.014.1 | | 23321.14 | |
| 1171 | 2824.001.2-B_at | GPM6B | NM_001001994 | Xp22.2 | 2824.001.2 | | 2824.1 | |
| 1172 | 29127.022.1-T_at | RACGAP1 | NM_013277 | 12q13.13 | 29127.022.1 | | 29127.22 | |
| 1173 | 6289.003.1-F_at | SAA2 | NM_030754 | 11p15.1-p14 | 6289.003.1 | | 6289.3 | |
| 1174 | 7170.005.2-B_at | TPM3 | NM_001043366 | 1q21.2 | 7170.005.2 | | 7170.5 | |
| 1175 | 54443.011.1-F_at | ANLN | NM_018685 | 7p15-p14 | 54443.011.1 | | 54443.11 | |
| 1176 | 29127.019.1-T_at | RACGAP1 | NM_013277 | 12q13.13 | 29127.019.1 | | 29127.19 | |
| 1177 | 6288.004.1-T_at | SAA1 | NM_000333 | 11p15.1 | 6288.004.1 | | 6288.4 | |
| 1178 | 29997.008.1-C_at | GLTSCR2 | NM_015710 | 19q13.3 | 29997.008.1 | | 29997.8 | |
| 1179 | 57447.039.1-B_at | NDRG2 | NM_016331 | 14q11.2 | 57447.039.1 | | 57447.39 | |
| 1180 | 3872.007.1-B_at | KRT17 | NM_000422 | 17q12-q21 | 3872.007.1 | | 3872.7 | |
| 1181 | 57561.002.1-T_at | ARRDC3 | NM_020801 | 5q14.3 | 57561.002.1 | | 57561.2 | |
| 1182 | 57451.002.3-B_at | ODZ2 | NM_001080428 | 5q34-q35.1 | 57451.002.3 | | 57451.2 | |
| 1183 | 5213.024.1-B_at | PFKM | NM_000289 | 12q13.3 | 5213.024.1 | | 5213.24 | |
| 1184 | 2.005.1-T_at | A2M | NM_000014 | 12p13.3-p12.3 | 2.005.1 | | 2.5 | |
| 1185 | 11065.004.1-C_at | UBE2C | NM_007025 | 20q13.12 | 11065.004.1 | | 11065.4 | |
| 1186 | 1410.006.1-C_at | CRYAB | NM_001885 | 11q22.3-q23.1 | 1410.006.1 | | 1410.6 | |
| 1187 | 6289.006.1-T_at | SAA2 | NM_030754 | 11p15.1-p14 | 6289.006.1 | | 6289.6 | |

TABLE 4-continued

Probe sets used to construct molecular predictor (n = 1228).

| NO | Probeset_Id | Symbol | RefSeq | Location | Transcrit | Transcrit | Transcrit2 | Transcrit2 |
|---|---|---|---|---|---|---|---|---|
| 1188 | 55366.001.1-T_at | LGR4 | NM_018490 | 11p14-p13 | 55366.001.1 | | 55366.1 | |
| 1189 | 23284.007.1-F_at | LPHN3 | NM_015236 | 4q13.1 | 23284.007.1 | | 23284.7 | |
| 1190 | 79971.009.1-T_at | GPR177 | NM_001002294 | 1p31.3 | 79971.009.1 | | 79971.9 | |
| 1191 | 6288.004.1-E_at | SAA1 | NM_000334 | 11p15.1 | 6288.004.1 | | 6288.4 | |
| 1192 | 11065.004.1-T_at | UBE2C | NM_007026 | 20q13.12 | 11065.004.1 | | 11065.4 | |
| 1193 | 51203.009.1-T_at | NUSAP1 | NM_016362 | 15q15.1 | 51203.009.1 | | 51203.9 | |
| 1194 | 1410.010.1-E_at | CRYAB | NM_001885 | 11q22.3-q23.1 | 1410.010.1 | | 1410.10 | |
| 1195 | 57447.030.1-D_at | NDRG2 | NM_016332 | 14q11.2 | 57447.030.1 | | 57447.30 | |
| 1196 | 1308.002.1-T_at | COL17A1 | NM_000507 | 10q24.3 | 1308.002.1 | | 1308.2 | |
| 1197 | 4288.007.1-C_at | MKI67 | NM_002417 | 10q25-qter | 4288.007.1 | | 4288.7 | |
| 1198 | 244.011.1-T_at | ANXA8L2 | NM_001630 | 10q11.22 | 244.011.1 | | 244.11 | |
| 1199 | 94274.003.1-B_at | PPP1R14A | NM_033256 | 19q13.1 | 94274.003.1 | | 94274.3 | |
| 1200 | 3178.003.1-E_at | HNRNPA1 | NM_002136 | 12q13.1 | 3178.003.1 | | 3178.3 | |
| 1201 | 7153.002.4-T_at | TOP2A | NM_001067 | 17q21-q22 | 7153.002.4 | | 7153.2 | |
| 1202 | 9055.012.1-D_at | PRC1 | NM_003987 | 15q26.1 | 9055.012.1 | | 9055.12 | |
| 1203 | 9232.001.1-E_at | PTTG1 | NM_004219 | 5q35.1 | 9232.001.1 | | 9232.1 | |
| 1204 | 79068.011.2-B_at | FTO | NM_001080432 | 16q12.2 | 79068.011.2 | | 79068.11 | |
| 1205 | 120.005.2-F_at | ADD3 | NM_001122 | 10q24.2-q24.3 | 120.005.2 | | 120.5 | |
| 1206 | 7534.001.1-C_at | YWHAZ | NM_003406 | 8q23.1 | 7534.001.1 | | 7534.1 | |
| 1207 | 120.005.2-T_at | ADD3 | NM_001123 | 10q24.2-q24.3 | 120.005.2 | | 120.5 | |
| 1208 | 7373.003.3-C_at | COL14A1 | NM_021110 | 8q23 | 7373.003.3 | | 7373.3 | |
| 1209 | 57447.004.2-D_at | NDRG2 | NM_016333 | 14q11.2 | 57447.004.2 | | 57447.4 | |
| 1210 | 2568.005.1-F_at | GABRP | NM_014211 | 5q33-q34 | 2568.005.1 | | 2568.5 | |
| 1211 | 1308.001.1-E_at | COL17A1 | NM_000508 | 10q24.3 | 1308.001.1 | | 1308.1 | |
| 1212 | 6876.020.1-F_at | TAGLN | NM_001001534 | 11q23.2 | 6876.020.1 | | 6876.20 | |
| 1213 | 79971.014.1-D_at | GPR177 | NM_001002295 | 1p31.3 | 79971.014.1 | | 79971.14 | |
| 1214 | 5621.008.1-D_at | PRNP | NM_000312 | 20p13 | 5621.008.1 | | 5621.8 | |
| 1215 | 55732.003.2-T_at | C1orf112 | NM_018186 | 1q24.2 | 55732.003.2 | | 55732.3 | |
| 1216 | 221120.006.1-D | ALKBH3 | NM_139178 | 11p11.2 | 221120.006.1 | | 221120.6 | |
| 1217 | 23266.008.1-T_at | LPHN2 | NM_012302 | 1p31.1 | 23266.008.1 | | 23266.8 | |
| 1218 | 2335.045.1-F_at | FN1 | NM_002052 | 2q34 | 2335.045.1 | | 2335.45 | |
| 1219 | 7170.007.1-F_at | TPM3 | NM_001043367 | 1q21.2 | 7170.007.1 | | 7170.7 | |
| 1220 | 10461.002.1-B_at | MERTK | NM_006343 | 2q14.1 | 10461.002.1 | | 10461.2 | |
| 1221 | 59.031.2-F_at | ACTA2 | NM_001613 | 10q23.3 | 59.031.2 | | 59.31 | |
| 1222 | 9055.010.1-T_at | PRC1 | NM_003988 | 15q26.1 | 9055.010.1 | | 9055.10 | |
| 1223 | 58499.005.2-F_at | ZNF462 | NM_021224 | 9q31.2 | 58499.005.2 | | 58499.5 | |
| 1224 | 54443.006.2-F_at | ANLN | NM_018685 | 7p15-p14 | 54443.006.2 | | 54443.6 | |
| 1225 | 59.016.1-B_at | ACTA2 | NM_001613 | 10q23.3 | 59.016.1 | | 59.16 | |
| 1226 | 4288.004.1-C_at | MKI67 | NM_002417 | 10q25-qter | 4288.004.1 | | 4288.4 | |
| 1227 | 7170.014.1-C_at | TPM3 | NM_001043368 | 1q21.2 | 7170.014.1 | | 7170.14 | |
| 1228 | 7170.007.1-D_at | TPM3 | NM_001043369 | 1q21.2 | 7170.007.1 | | 7170.7 | |

TABLE 5

Table 5. Average profiles of the preferred 1,228 signature probe set on the 24 benign and 70 malignant tissues of the training set.

| NO | Probeset_Id | benign profile | malignant profile |
|---|---|---|---|
| 1 | 1756.022.2-C_at | 7.77577583 | 3.59039694 |
| 2 | 1756.029.1-D_at | 7.04295703 | 3.513387741 |
| 3 | 1756.026.1-C_at | 6.95161337 | 3.464276589 |
| 4 | 1756.022.4-T_at | 6.48188081 | 3.420868252 |
| 5 | 1756.011.1-B_at | 6.86417826 | 3.496864254 |
| 6 | 1308.008.1-C_at | 7.57956334 | 3.687873002 |
| 7 | 1756.022.3-F_at | 6.51097796 | 3.58405119 |
| 8 | 3861.020.1-D_at | 6.22316661 | 3.499798722 |
| 9 | 1756.011.1-F_at | 6.46286419 | 3.439670248 |
| 10 | 4629.007.1-F_at | 7.83187958 | 4.047826786 |
| 11 | 1756.022.4-B_at | 5.66870747 | 3.376207029 |
| 12 | 1756.024.1-F_at | 5.6343038 | 3.538881886 |
| 13 | 3861.019.1-T_at | 6.68378293 | 3.662794206 |
| 14 | 1756.026.1-T_at | 5.75006153 | 3.403683849 |
| 15 | 1756.022.1-B_at | 5.5659674 | 3.347255374 |
| 16 | 3861.001.1-T_at | 8.03618493 | 4.233009236 |
| 17 | 1308.008.1-T_at | 7.11931893 | 3.582324909 |
| 18 | 4629.020.1-C_at | 5.83439993 | 3.404790946 |

TABLE 5-continued

Table 5. Average profiles of the preferred 1,228 signature probe set on the 24 benign and 70 malignant tissues of the training set.

| NO | Probeset_Id | benign profile | malignant profile |
|---|---|---|---|
| 19 | 1756.027.1-T_at | 5.61961823 | 3.38354471 |
| 20 | 3861.013.1-T_at | 6.54371337 | 3.606451019 |
| 21 | 4629.020.1-F_at | 8.29507715 | 4.572815098 |
| 22 | 3861.001.1-B_at | 6.22211499 | 3.452593672 |
| 23 | 1756.022.4-F_at | 5.86145739 | 3.406465282 |
| 24 | 1756.026.1-F_at | 5.60288028 | 3.360497686 |
| 25 | 1756.022.2-T_at | 5.58253289 | 3.54186397 |
| 26 | 1756.022.2-F_at | 5.61962239 | 3.502994928 |
| 27 | 3861.022.1-B_at | 7.02845041 | 3.87855387 |
| 28 | 3868.004.1-D_at | 7.74158414 | 4.319798082 |
| 29 | 4629.015.1-C_at | 7.25657837 | 3.723809766 |
| 30 | 6422.002.1-E_at | 8.94850792 | 4.159424522 |
| 31 | 3861.001.1-D_at | 6.09123229 | 3.432322015 |
| 32 | 1756.022.1-F_at | 5.69246198 | 3.544494185 |
| 33 | 1308.003.1-T_at | 7.94010542 | 4.370493824 |
| 34 | 3868.005.1-B_at | 8.74334588 | 5.189519553 |
| 35 | 1308.007.1-F_at | 6.53872712 | 4.045429995 |
| 36 | 1308.009.1-F_at | 6.89532626 | 4.071167435 |
| 37 | 3861.007.1-E_at | 6.32900696 | 3.492862508 |
| 38 | 4629.016.1-D_at | 6.54432919 | 3.640775643 |
| 39 | 3084.007.1-F_at | 5.24077491 | 3.36157297 |
| 40 | 3861.007.1-F_at | 8.80010947 | 5.27987695 |
| 41 | 26289.003.1-E_at | 5.86287574 | 3.533159027 |
| 42 | 1756.028.1-T_at | 5.51782565 | 3.40968711 |
| 43 | 4629.021.1-E_at | 5.66627575 | 3.423025757 |
| 44 | 4629.020.1-D_at | 6.44086194 | 3.546901356 |
| 45 | 5764.001.1-F_at | 8.69561376 | 4.488059326 |
| 46 | 3815.002.3-F_at | 7.51289238 | 3.849064631 |
| 47 | 3852.020.1-T_at | 6.42797621 | 4.732898695 |
| 48 | 4629.007.1-E_at | 6.02756027 | 3.473012819 |
| 49 | 128553.003.1-F | 5.53321089 | 3.635562107 |
| 50 | 26289.003.1-F_at | 7.91558754 | 4.209493355 |
| 51 | 3815.002.2-F_at | 7.57464628 | 4.354458317 |
| 52 | 1756.029.1-B_at | 5.14699565 | 3.349809112 |
| 53 | 4629.005.1-E_at | 7.84091036 | 4.284271836 |
| 54 | 4629.010.1-B_at | 6.24893878 | 4.055036115 |
| 55 | 6422.001.1-T_at | 7.16633034 | 3.787746012 |
| 56 | 5764.001.1-E_at | 7.41150914 | 3.725088834 |
| 57 | 3861.008.1-F_at | 7.02710456 | 4.066582177 |
| 58 | 1756.030.2-T_at | 4.94195769 | 3.327396148 |
| 59 | 3084.009.1-B_at | 5.68938525 | 3.45247142 |
| 60 | 26289.002.1-T_at | 7.40948494 | 4.099092499 |
| 61 | 1756.022.5-B_at | 5.43279988 | 3.481330797 |
| 62 | 4629.007.1-D_at | 6.12853852 | 3.536108886 |
| 63 | 23336.001.1-C_at | 6.64495461 | 3.668475185 |
| 64 | 1308.003.1-D_at | 5.60928126 | 3.379520915 |
| 65 | 1756.022.3-T_at | 5.52680369 | 3.62832307 |
| 66 | 3861.020.1-T_at | 7.58427914 | 5.411375294 |
| 67 | 3861.022.1-C_at | 5.51190841 | 3.385538085 |
| 68 | 3852.012.2-B_at | 8.68398341 | 6.89513729 |
| 69 | 26289.012.1-E_at | 7.90570335 | 4.172489159 |
| 70 | 23336.003.1-T_at | 7.08201667 | 4.814503945 |
| 71 | 26289.007.1-B_at | 7.72470925 | 4.152306769 |
| 72 | 84417.001.1-T_at | 5.09011844 | 3.400475459 |
| 73 | 3861.018.1-D_at | 5.42966542 | 3.382067375 |
| 74 | 3852.004.1-B_at | 6.45366587 | 4.048382242 |
| 75 | 90865.006.1-B_at | 6.73968166 | 3.990889311 |
| 76 | 4629.021.1-F_at | 7.91177883 | 2.2531203 |
| 77 | 3861.018.1-T_at | 6.93768003 | 4.389579877 |
| 78 | 1756.022.1-T_at | 5.49427991 | 3.678236167 |
| 79 | 1264.003.1-B_at | 6.59427618 | 3.644806029 |
| 80 | 26289.010.1-E_at | 7.89895995 | 4.173752776 |
| 81 | 3861.001.1-F_at | 8.22227254 | 5.365451942 |
| 82 | 1908.002.1-T_at | 5.89142159 | 3.76026543 |
| 83 | 4629.007.1-C_at | 5.95159281 | 3.449026103 |
| 84 | 1756.022.5-T_at | 7.41985492 | 5.430396438 |
| 85 | 3815.002.4-B_at | 6.82005827 | 3.837481838 |
| 86 | 1756.022.2-B_at | 5.20019167 | 3.394669911 |
| 87 | 1756.027.1-B_at | 4.8537932 | 3.389107204 |
| 88 | 3852.008.2-T_at | 6.48445207 | 3.985807972 |
| 89 | 6422.001.1-E_at | 7.27907161 | 3.874506745 |
| 90 | 3861.022.1-F_at | 6.81336417 | 5.057032572 |
| 91 | 4915.011.1-D_at | 5.90431076 | 3.64199141 |
| 92 | 5288.001.1-F_at | 5.44594693 | 3.485884155 |
| 93 | 3861.007.1-T_at | 7.95368914 | 5.49032736 |
| 94 | 3852.006.1-C_at | 6.13678531 | 3.559093796 |
| 95 | 9413.003.1-T_at | 5.34538697 | 3.552156816 |
| 96 | 3861.020.1-C_at | 5.55692471 | 3.41004352 |
| 97 | 1308.008.1-D_at | 5.59542139 | 3.406938539 |
| 98 | 23336.001.1-T_at | 6.50954711 | 4.440969009 |
| 99 | 3815.001.1-F_at | 7.00089122 | 3.951400817 |
| 100 | 1756.022.5-F_at | 6.87448959 | 4.663598998 |
| 101 | 79937.001.1-T_at | 6.15393538 | 4.110481521 |
| 102 | 4915.012.1-E_at | 8.0872096 | 4.146795298 |
| 103 | 3861.022.1-T_at | 6.45943061 | 3.91885164 |
| 104 | 26289.005.1-T_at | 6.42663922 | 4.148293882 |
| 105 | 3815.002.3-B_at | 5.54627639 | 3.429691278 |
| 106 | 4311.009.1-F_at | 7.16081204 | 4.100265304 |
| 107 | 26289.006.1-T_at | 8.56062669 | 4.815103599 |
| 108 | 5288.003.1-F_at | 5.50819433 | 3.507713463 |
| 109 | 4629.020.1-B_at | 5.84433404 | 3.602970173 |
| 110 | 26289.007.1-D_at | 8.97225664 | 4.739722032 |
| 111 | 3815.002.1-B_at | 6.95057351 | 3.834713723 |
| 112 | 26289.004.1-T_at | 6.34773713 | 4.19513007 |
| 113 | 79192.002.2-T_at | 6.05826364 | 3.842242343 |
| 114 | 4638.006.1-D_at | 7.26387248 | 4.23337548 |
| 115 | 3084.008.1-F_at | 4.91747714 | 3.337620462 |
| 116 | 4311.001.2-T_at | 7.0894017 | 4.083336035 |
| 117 | 3815.002.1-D_at | 5.62489378 | 3.413633401 |
| 118 | 4629.020.1-T_at | 6.54528254 | 4.292670552 |
| 119 | 1756.026.1-B_at | 5.04408715 | 3.401481888 |
| 120 | 3852.022.1-T_at | 6.17920917 | 3.949400375 |
| 121 | 4629.015.1-D_at | 6.8794921 | 4.903440037 |
| 122 | 26289.007.1-C_at | 7.11737708 | 3.991072006 |
| 123 | 23194.003.1-C_at | 6.62756369 | 4.216361434 |
| 124 | 3815.002.1-F_at | 5.96350065 | 3.577775017 |
| 125 | 26289.007.1-T_at | 9.05284176 | 5.053614074 |
| 126 | 65983.009.1-B_at | 4.92316734 | 3.543080498 |
| 127 | 23336.001.1-F_at | 6.76043292 | 4.496928377 |
| 128 | 1410.007.2-B_at | 6.13154201 | 3.800315965 |
| 129 | 1756.029.1-F_at | 4.74778319 | 3.336087634 |
| 130 | 7373.003.6-C_at | 6.42568489 | 3.893070602 |
| 131 | 10010.002.1-E_at | 4.95595545 | 3.398356655 |
| 132 | 59.026.1-B_at | 5.82098007 | 3.829661839 |
| 133 | 4915.011.1-F_at | 6.93603667 | 3.88986704 |
| 134 | 3872.007.1-F_at | 6.20605492 | 3.672782211 |
| 135 | 26289.002.1-D_at | 4.95771354 | 3.437272763 |
| 136 | 84668.002.1-C_at | 7.73745334 | 4.885593169 |
| 137 | 1756.002.2-T_at | 7.42432799 | 4.334919851 |
| 138 | 57447.033.1-C_at | 6.98508503 | 4.791930475 |
| 139 | 26289.009.1-E_at | 8.95673913 | 4.746268267 |
| 140 | 3872.006.1-F_at | 8.33069501 | 5.239623762 |
| 141 | 3861.022.1-D_at | 4.91710968 | 3.325488578 |
| 142 | 3815.002.1-E_at | 5.32314912 | 3.412709023 |
| 143 | 667.021.1-B_at | 6.18631919 | 3.841433137 |
| 144 | 57447.027.1-F_at | 7.08539045 | 4.241139039 |
| 145 | 56477.001.1-D_at | 6.55969728 | 3.814097685 |
| 146 | 26289.008.1-F_at | 8.97978495 | 4.925626071 |
| 147 | 59.024.2-D_at | 7.22299753 | 4.423928704 |
| 148 | 4629.005.1-T_at | 8.60305039 | 5.554148468 |
| 149 | 3815.002.1-T_at | 8.34708459 | 4.557379602 |
| 150 | 23336.001.1-B_at | 7.9283908 | 5.377785469 |
| 151 | 3084.004.2-F_at | 4.90868361 | 3.371411318 |
| 152 | 27122.014.2-T_at | 5.66296874 | 3.671915992 |
| 153 | 26289.008.1-C_at | 6.19905784 | 3.792605417 |
| 154 | 286887.003.2-B | 6.65960082 | 4.217906735 |
| 155 | 4629.005.1-F_at | 7.92220509 | 5.827308726 |
| 156 | 3872.009.1-T_at | 8.11749997 | 4.97186016 |
| 157 | 59.014.2-D_at | 7.2803688 | 4.475411666 |
| 158 | 403340.001.2-B | 6.5225278 | 3.953645308 |
| 159 | 3852.014.1-F_at | 6.65504418 | 4.502352655 |
| 160 | 27122.001.1-T_at | 6.70494956 | 4.219728495 |
| 161 | 3815.002.3-T_at | 5.79983719 | 3.546807083 |
| 162 | 3852.008.1-E_at | 7.70698375 | 4.778195426 |
| 163 | 27122.012.1-T_at | 6.44372459 | 3.808594574 |
| 164 | 26289.007.1-F_at | 6.33764826 | 3.835752254 |
| 165 | 4638.006.1-T_at | 7.48416583 | 4.880628209 |
| 166 | 8626.005.1-B_at | 6.0506832 | 3.689171001 |
| 167 | 3815.002.4-T_at | 7.18867318 | 3.947318855 |
| 168 | 84668.004.1-F_at | 6.36068084 | 4.024117755 |

TABLE 5-continued

Table 5. Average profiles of the preferred 1,228 signature probe set on the 24 benign and 70 malignant tissues of the training set.

| NO | Probeset_Id | benign profile | malignant profile |
|---|---|---|---|
| 169 | 3872.007.1-F_at | 8.15990919 | 5.039544664 |
| 170 | 57447.031.1-E_at | 6.98413461 | 4.847264949 |
| 171 | 3084.012.3-T_at | 5.1724186 | 3.372130258 |
| 172 | 3852.005.1-T_at | 6.15177089 | 3.953202014 |
| 173 | 84417.001.2-T_at | 4.88905487 | 3.400666252 |
| 174 | 3866.003.2-T_at | 7.33197079 | 4.76008241 |
| 175 | 3866.008.1-C_at | 6.52361561 | 3.762190903 |
| 176 | 3852.009.1-F_at | 7.29388376 | 4.138971389 |
| 177 | 59.015.1-B_at | 5.98286286 | 3.912382525 |
| 178 | 79937.002.1-F_at | 4.55998542 | 3.353847089 |
| 179 | 7153.002.6-F_at | 5.25845229 | 8.105836861 |
| 180 | 4281.010.1-B_at | 5.89302118 | 3.740600544 |
| 181 | 59.008.1-B_at | 5.76124199 | 3.852970764 |
| 182 | 1264.007.1-T_at | 5.63801742 | 3.838276262 |
| 183 | 3868.004.1-T_at | 5.66410876 | 3.79017218 |
| 184 | 3084.002.1-F_at | 4.98674566 | 3.360938629 |
| 185 | 5137.004.2-T_at | 4.64089266 | 3.34890403 |
| 186 | 4629.022.1-T_at | 4.75765246 | 3.480568786 |
| 187 | 4915.011.1-T_at | 6.94354411 | 3.915112838 |
| 188 | 3852.013.1-E_at | 6.01894366 | 3.617314683 |
| 189 | 59.012.2-T_at | 8.08522667 | 5.172148648 |
| 190 | 59.015.1-F_at | 6.50494881 | 4.765128611 |
| 191 | 4638.006.2-T_at | 7.26086954 | 4.714147988 |
| 192 | 23336.002.1-B_at | 5.95183375 | 3.957277561 |
| 193 | 3868.005.1-C_at | 8.63446621 | 7.297975458 |
| 194 | 3866.011.2-D_at | 8.77838405 | 4.522564109 |
| 195 | 56477.001.1-T_at | 8.14939865 | 5.06922736 |
| 196 | 3815.001.1-F_at | 6.03901568 | 3.756819456 |
| 197 | 4311.001.1-T_at | 7.11420453 | 4.238075405 |
| 198 | 1264.003.1-D_at | 5.1912565 | 3.354675255 |
| 199 | 59.031.1-T_at | 7.4628458 | 4.949828067 |
| 200 | 57447.030.1-B_at | 6.45843286 | 3.891549539 |
| 201 | 1410.003.2-B_at | 6.05784067 | 3.779422009 |
| 202 | 3866.009.2-D_at | 8.80361998 | 4.576378265 |
| 203 | 59.026.1-T_at | 7.29639751 | 4.650053313 |
| 204 | 440421.001.1-T | 9.24293713 | 6.596812139 |
| 205 | 1756.022.4-D_at | 5.07768477 | 3.476314006 |
| 206 | 65983.009.1-D_at | 6.39596028 | 4.086911291 |
| 207 | 57447.041.1-T_at | 6.95593663 | 4.149259947 |
| 208 | 3872.010.2-D_at | 8.56203536 | 5.425416269 |
| 209 | 4629.006.2-T_at | 8.90925918 | 6.221775982 |
| 210 | 3861.018.1-F_at | 6.8430596 | 5.185870988 |
| 211 | 3815.002.2-T_at | 5.28733127 | 3.421518659 |
| 212 | 3866.012.2-D_at | 8.67083494 | 4.478603969 |
| 213 | 57447.021.1-D_at | 6.98727375 | 4.930757851 |
| 214 | 59.015.1-T_at | 7.34935329 | 4.513251269 |
| 215 | 8626.007.1-F_at | 7.17503293 | 5.028534466 |
| 216 | 5288.001.1-B_at | 5.02652959 | 3.42608729 |
| 217 | 72.001.1-B_at | 6.05804544 | 3.853258443 |
| 218 | 3866.006.2-D_at | 8.65913916 | 4.490509023 |
| 219 | 3852.004.1-T_at | 6.78881411 | 4.012650025 |
| 220 | 4629.016.1-F_at | 5.16326314 | 3.700432446 |
| 221 | 4629.007.1-T_at | 5.80150326 | 4.040994731 |
| 222 | 65983.008.1-T_at | 6.32502917 | 4.219582217 |
| 223 | 65983.013.1-F_at | 5.56252368 | 3.731459395 |
| 224 | 3084.004.1-F_at | 4.93700193 | 3.399738343 |
| 225 | 27122.007.1-F_at | 6.83642294 | 4.356100082 |
| 226 | 3866.008.1-D_at | 8.70576582 | 4.517001787 |
| 227 | 26289.009.1-T_at | 8.23631259 | 5.882347434 |
| 228 | 59.009.1-B_at | 7.1080566 | 4.810790662 |
| 229 | 4629.010.1-D_at | 5.14795762 | 3.377019173 |
| 230 | 59.023.1-B_at | 5.9667058 | 4.241472412 |
| 231 | 26289.002.1-F_at | 6.02532667 | 4.093116116 |
| 232 | 1908.001.1-T_at | 5.67746805 | 3.733518249 |
| 233 | 4915.008.1-F_at | 7.26142834 | 4.642285716 |
| 234 | 23336.002.1-T_at | 6.49776495 | 4.343732056 |
| 235 | 3861.008.1-C_at | 5.95153563 | 3.602851161 |
| 236 | 3861.008.1-D_at | 5.29062466 | 3.396003998 |
| 237 | 57447.035.1-E_at | 6.91652713 | 4.662107171 |
| 238 | 3861.018.1-C_at | 5.20378802 | 3.40238733 |
| 239 | 1308.003.1-B_at | 6.04491667 | 4.20754377 |
| 240 | 667.022.1-B_at | 9.21855078 | 6.264675763 |
| 241 | 3866.011.2-T_at | 9.26272502 | 4.964885149 |
| 242 | 2115.001.2-F_at | 4.89563967 | 3.419126266 |
| 243 | 3866.011.2-B_at | 8.90774202 | 5.955221725 |
| 244 | 26289.010.1-T_at | 6.53182588 | 3.913556066 |
| 245 | 27303.004.1-E_at | 5.37295265 | 3.543582523 |
| 246 | 59.003.1-B_at | 7.93270751 | 4.980983024 |
| 247 | 4311.009.1-C_at | 5.83645359 | 3.593262545 |
| 248 | 7373.003.6-B_at | 5.10650551 | 3.591717587 |
| 249 | 65983.004.1-T_at | 6.08803336 | 4.309048954 |
| 250 | 26289.013.1-D_at | 6.4702967 | 4.168098993 |
| 251 | 3866.004.1-F_at | 8.69085999 | 5.161823428 |
| 252 | 56477.001.1-F_at | 6.84530786 | 4.144567561 |
| 253 | 57447.037.1-F_at | 6.50794623 | 4.008371243 |
| 254 | 59.022.2-T_at | 8.05648541 | 5.423260634 |
| 255 | 147495.008.1-F | 4.79759981 | 3.504777229 |
| 256 | 2.018.1-T_at | 6.94869173 | 4.521707124 |
| 257 | 140807.003.1-E | 7.78013704 | 4.939516908 |
| 258 | 65983.009.1-T_at | 5.82469201 | 4.038349093 |
| 259 | 84668.002.1-F_at | 6.10679619 | 3.911726506 |
| 260 | 3872.007.1-C_at | 6.89188543 | 4.236245481 |
| 261 | 2115.008.1-T_at | 4.99544075 | 3.646690809 |
| 262 | 65983.004.2-T_at | 6.08050374 | 4.312433521 |
| 263 | 57447.034.1-D_at | 6.936035 | 4.801981821 |
| 264 | 3866.001.1-F_at | 9.09052167 | 5.099093334 |
| 265 | 3866.008.1-T_at | 9.07318081 | 5.048805174 |
| 266 | 1959.003.1-C_at | 5.09323093 | 3.511681612 |
| 267 | 389432.002.1-T | 5.08376017 | 3.428817257 |
| 268 | 389734.001.1-T | 5.43078503 | 3.868151914 |
| 269 | 3855.001.2-D_at | 7.00167453 | 4.478486691 |
| 270 | 3866.003.1-T_at | 7.28560994 | 4.919439752 |
| 271 | 3084.006.1-F_at | 4.88762029 | 3.435292071 |
| 272 | 4915.008.1-B_at | 9.33812372 | 6.600441272 |
| 273 | 2115.011.1-T_at | 4.96772945 | 3.573388451 |
| 274 | 65983.005.1-T_at | 5.18666491 | 3.68451349 |
| 275 | 84668.004.1-T_at | 5.6127121 | 3.643748216 |
| 276 | 59.015.2-T_at | 7.37091506 | 4.589962999 |
| 277 | 2119.006.1-B_at | 5.29804773 | 3.689885023 |
| 278 | 4638.006.2-F_at | 6.94711133 | 4.982563544 |
| 279 | 3866.007.2-D_at | 8.65600661 | 4.653097355 |
| 280 | 59.014.1-T_at | 6.68646455 | 4.640934588 |
| 281 | 3866.001.2-F_at | 8.99732872 | 5.069416275 |
| 282 | 1308.008.1-B_at | 5.17775427 | 3.436187546 |
| 283 | 59.026.1-F_at | 6.20953542 | 4.590760008 |
| 284 | 3866.013.1-F_at | 8.10955622 | 4.736748894 |
| 285 | 1264.007.1-F_at | 4.75311015 | 3.431422638 |
| 286 | 3866.007.2-F_at | 9.11439411 | 5.094569305 |
| 287 | 27122.013.1-T_at | 6.62548583 | 4.301605936 |
| 288 | 27122.006.2-F_at | 6.55351463 | 4.265429835 |
| 289 | 3866.006.2-T_at | 9.06546704 | 5.104948803 |
| 290 | 3866.009.2-T_at | 9.95142456 | 5.435454431 |
| 291 | 4240.004.1-D_at | 6.56591292 | 3.971193091 |
| 292 | 3866.010.1-F_at | 9.93993743 | 5.314895513 |
| 293 | 3866.009.2-B_at | 8.95840788 | 6.023022151 |
| 294 | 3866.009.1-T_at | 9.94526994 | 5.403869315 |
| 295 | 4629.006.1-T_at | 8.84832501 | 6.182536282 |
| 296 | 7018.029.1-B_at | 7.60030878 | 4.306073488 |
| 297 | 1410.002.2-B_at | 5.81431314 | 3.745409488 |
| 298 | 3866.012.1-T_at | 9.90206544 | 5.308091577 |
| 299 | 59.034.2-D_at | 7.86477089 | 5.080775226 |
| 300 | 27122.019.1-F_at | 6.89881084 | 4.480037843 |
| 301 | 5156.001.1-T_at | 4.81097854 | 3.473046125 |
| 302 | 389734.001.2-T | 5.40328573 | 3.837281942 |
| 303 | 27122.014.1-T_at | 5.51451528 | 3.660985743 |
| 304 | 57447.010.3-T_at | 7.75144798 | 5.575239001 |
| 305 | 358.018.1-F_at | 5.42702744 | 3.627847604 |
| 306 | 3866.006.1-T_at | 9.0668668 | 5.139316838 |
| 307 | 7373.001.1-T_at | 4.83532429 | 3.464644018 |
| 308 | 26289.012.1-B_at | 6.41666504 | 4.261745027 |
| 309 | 57447.029.1-T_at | 6.56314208 | 4.648604292 |
| 310 | 358.018.1-B_at | 6.41651654 | 4.110814767 |
| 311 | 79068.010.1-B_at | 5.46560699 | 3.70220541 |
| 312 | 59.024.1-B_at | 5.86685124 | 4.334726645 |
| 313 | 59.004.1-B_at | 7.7789734 | 4.946058533 |
| 314 | 3866.011.1-T_at | 9.18073541 | 5.037406823 |
| 315 | 3866.013.1-E_at | 9.93641299 | 5.489343529 |
| 316 | 3866.010.1-D_at | 7.92735291 | 4.325351254 |
| 317 | 59.004.1-T_at | 6.80411249 | 4.752679161 |
| 318 | 2115.012.1-T_at | 4.90559701 | 3.671185668 |

TABLE 5-continued

Table 5. Average profiles of the preferred 1,228 signature probe set on the 24 benign and 70 malignant tissues of the training set.

| NO | Probeset_Id | benign profile | malignant profile |
|---|---|---|---|
| 319 | 2.018.1-D_at | 7.56738794 | 4.906078362 |
| 320 | 2115.007.1-T_at | 4.92205691 | 3.509530779 |
| 321 | 59.040.1-T_at | 7.92500959 | 5.05284254 |
| 322 | 130497.001.2-T | 5.99836959 | 4.482736911 |
| 323 | 140885.014.1-T | 6.11906211 | 4.162154943 |
| 324 | 3866.005.1-F_at | 10.0863709 | 6.759928131 |
| 325 | 7373.003.3-F_at | 5.33919182 | 3.590603587 |
| 326 | 8404.028.1-F_at | 7.04051836 | 4.637927072 |
| 327 | 3860.007.1-D_at | 6.74551501 | 4.619163344 |
| 328 | 4638.003.1-C_at | 6.92132293 | 4.308398188 |
| 329 | 3872.009.1-E_at | 6.06310081 | 3.900207749 |
| 330 | 59.004.2-T_at | 6.8944992 | 4.903788058 |
| 331 | 3872.006.1-C_at | 5.96674849 | 3.642756113 |
| 332 | 3866.005.1-C_at | 9.92269961 | 5.465682846 |
| 333 | 25925.008.1-T_at | 5.69718285 | 3.927983551 |
| 334 | 23650.011.2-T_at | 7.84409583 | 5.100253551 |
| 335 | 3866.012.2-T_at | 9.91429542 | 5.489051755 |
| 336 | 3852.017.1-D_at | 7.83835576 | 6.280406857 |
| 337 | 4915.005.1-T_at | 6.46700411 | 3.841875247 |
| 338 | 4638.003.1-B_at | 5.77600419 | 3.967963498 |
| 339 | 1756.003.1-B_at | 5.78203385 | 3.613994813 |
| 340 | 4638.006.1-F_at | 6.98679711 | 5.084511181 |
| 341 | 57447.035.1-F_at | 8.86960129 | 6.679175491 |
| 342 | 4638.014.1-T_at | 6.2093321 | 4.224843914 |
| 343 | 7373.003.4-T_at | 5.85405082 | 3.941925452 |
| 344 | 27122.014.2-D_at | 7.20343208 | 5.077601963 |
| 345 | 3866.007.1-T_at | 8.98065251 | 5.096039971 |
| 346 | 2707.002.1-E_at | 5.34630411 | 3.674524536 |
| 347 | 59.024.1-T_at | 6.83542202 | 4.80269153 |
| 348 | 23650.011.1-T_at | 7.77512705 | 5.141458081 |
| 349 | 4638.011.1-F_at | 6.85698752 | 4.967669809 |
| 350 | 7373.002.1-F_at | 5.47015821 | 3.55519593 |
| 351 | 3866.013.1-F_at | 10.0353866 | 5.509128495 |
| 352 | 5608.002.1-T_at | 5.59795956 | 4.054949846 |
| 353 | 3866.001.1-C_at | 8.25309213 | 4.510684041 |
| 354 | 1756.013.1-B_at | 5.65046199 | 3.958957471 |
| 355 | 2115.006.1-E_at | 4.67003702 | 3.398574534 |
| 356 | 6376.001.2-F_at | 6.76738419 | 4.594461954 |
| 357 | 3084.004.1-B_at | 5.38510101 | 3.510068108 |
| 358 | 3815.002.4-F_at | 5.6936983 | 3.530847279 |
| 359 | 8404.002.1-D_at | 5.08914334 | 3.509495218 |
| 360 | 1264.006.1-T_at | 4.78935745 | 3.400776827 |
| 361 | 59.022.2-D_at | 7.5362729 | 4.574317348 |
| 362 | 25925.001.1-T_at | 5.6505549 | 3.971262708 |
| 363 | 4638.006.2-B_at | 10.2697846 | 7.926227045 |
| 364 | 7373.003.5-B_at | 6.13588807 | 3.881763973 |
| 365 | 8404.035.1-B_at | 4.89853755 | 3.542374505 |
| 366 | 59.012.1-T_at | 5.29276653 | 3.730940958 |
| 367 | 3852.017.1-T_at | 5.94439335 | 4.136178865 |
| 368 | 3866.012.2-B_at | 8.89819048 | 6.139221978 |
| 369 | 2.022.1-B_at | 6.71649373 | 4.755989653 |
| 370 | 27122.016.1-F_at | 5.4913787 | 3.685454959 |
| 371 | 4311.009.1-B_at | 5.80492787 | 3.970849589 |
| 372 | 59.031.2-T_at | 7.28741747 | 5.073231596 |
| 373 | 4311.009.1-T_at | 6.04715771 | 3.812370988 |
| 374 | 3866.006.2-B_at | 8.87200336 | 6.165346275 |
| 375 | 57447.025.2-T_at | 7.83901538 | 5.040091008 |
| 376 | 1717.007.1-F_at | 8.47657921 | 6.307092709 |
| 377 | 59.004.2-D_at | 5.77885906 | 4.201996709 |
| 378 | 3866.007.2-B_at | 9.03444459 | 6.541756746 |
| 379 | 3866.010.1-F_at | 10.0841138 | 6.76233538 |
| 380 | 9768.004.1-D_at | 5.61546594 | 8.042566668 |
| 381 | 3084.012.2-T_at | 4.98851121 | 3.374482117 |
| 382 | 1410.004.2-B_at | 5.76955824 | 3.747418029 |
| 383 | 59.008.1-D_at | 7.580525 | 4.705524193 |
| 384 | 57447.030.1-C_at | 6.89544125 | 5.081510062 |
| 385 | 2327.002.1-D_at | 5.9013749 | 3.706350575 |
| 386 | 1308.004.1-B_at | 5.16195304 | 3.553648577 |
| 387 | 2568.005.2-B_at | 6.91662284 | 3.904971891 |
| 388 | 2568.001.1-T_at | 5.88553699 | 3.946862951 |
| 389 | 3084.004.2-T_at | 4.94236295 | 3.3780596 |
| 390 | 7373.003.4-B_at | 5.93233847 | 3.707708869 |
| 391 | 7153.002.2-D_at | 4.68145177 | 7.624764565 |
| 392 | 2893.006.2-T_at | 4.85081759 | 3.447008535 |
| 393 | 3872.016.1-D_at | 11.1567975 | 8.699934006 |
| 394 | 9413.006.1-F_at | 5.72231532 | 3.924184102 |
| 395 | 59.023.2-B_at | 8.07001275 | 5.312063628 |
| 396 | 72.005.1-B_at | 6.00386245 | 3.894301071 |
| 397 | 4915.011.1-C_at | 6.67654504 | 3.909184112 |
| 398 | 27122.018.1-F_at | 6.87829457 | 4.481518888 |
| 399 | 3852.006.1-B_at | 6.41696793 | 4.385795959 |
| 400 | 4638.006.2-D_at | 8.29420831 | 6.32375426 |
| 401 | 7153.005.1-E_at | 4.77417213 | 7.640160109 |
| 402 | 7373.001.2-T_at | 4.90613308 | 3.486605886 |
| 403 | 7018.026.1-B_at | 7.57683708 | 4.643843211 |
| 404 | 7402.014.1-B_at | 4.80489581 | 3.457197254 |
| 405 | 57447.010.3-D_at | 6.06072901 | 3.842292369 |
| 406 | 140446.004.1-T | 6.16231533 | 4.305325034 |
| 407 | 59.026.2-T_at | 7.15005413 | 4.607592814 |
| 408 | 59.038.1-B_at | 5.6494079 | 4.056218565 |
| 409 | 4240.009.1-C_at | 6.78849961 | 4.026127894 |
| 410 | 57447.030.1-F_at | 7.60148038 | 5.351594285 |
| 411 | 9768.004.1-B_at | 8.05212792 | 10.06930458 |
| 412 | 57447.008.1-T_at | 7.31095336 | 4.743544863 |
| 413 | 59.014.2-T_at | 6.61391873 | 4.504144736 |
| 414 | 4915.012.1-T_at | 5.09228311 | 3.51551028 |
| 415 | 3866.004.1-T_at | 8.98279458 | 5.909305497 |
| 416 | 2582.007.2-C_at | 5.8740549 | 3.779098879 |
| 417 | 7153.002.5-T_at | 4.34207016 | 6.815675337 |
| 418 | 4638.009.1-T_at | 6.73711208 | 4.705108768 |
| 419 | 3861.023.1-T_at | 8.54451168 | 7.107258463 |
| 420 | 5858.003.3-C_at | 7.42717125 | 4.805969254 |
| 421 | 3861.020.1-F_at | 6.68913708 | 5.181784732 |
| 422 | 147495.005.1-T | 4.88155983 | 3.636974481 |
| 423 | 4638.006.2-C_at | 6.96393228 | 4.171935351 |
| 424 | 1308.004.1-F_at | 4.77853486 | 3.492851328 |
| 425 | 4915.004.1-F_at | 7.22504252 | 4.799719839 |
| 426 | 3866.008.1-B_at | 10.1199429 | 6.470209973 |
| 427 | 8626.002.1-E_at | 5.06121478 | 3.39085572 |
| 428 | 1264.003.1-T_at | 5.58569266 | 3.581548983 |
| 429 | 59.042.1-F_at | 7.27807331 | 4.623171279 |
| 430 | 4833.004.1-T_at | 9.54827464 | 10.38615702 |
| 431 | 2568.006.1-B_at | 6.6183729 | 3.976037452 |
| 432 | 57447.004.2-T_at | 6.70536079 | 4.18281839 |
| 433 | 59.014.2-B_at | 8.212195 | 5.378024412 |
| 434 | 3084.012.1-T_at | 5.03022579 | 3.397719814 |
| 435 | 27122.017.1-T_at | 6.51481084 | 4.366155325 |
| 436 | 3852.012.2-T_at | 6.92067083 | 5.004410401 |
| 437 | 59.033.1-T_at | 6.06486589 | 4.665665746 |
| 438 | 27122.002.1-C_at | 7.19364005 | 5.202367669 |
| 439 | 3880.011.1-B_at | 10.5071551 | 7.518624838 |
| 440 | 65983.013.1-T_at | 7.70720875 | 5.536789935 |
| 441 | 3872.014.1-T_at | 7.93552665 | 5.762824716 |
| 442 | 162605.001.4-C | 7.30134493 | 4.179141958 |
| 443 | 59.031.2-B_at | 5.4449077 | 3.782243257 |
| 444 | 3084.012.2-B_at | 6.18353868 | 4.174289227 |
| 445 | 5858.001.2-C_at | 7.44400374 | 4.932750742 |
| 446 | 65983.010.1-T_at | 5.57005121 | 3.990871808 |
| 447 | 7373.003.5-F_at | 5.34533867 | 3.627863939 |
| 448 | 3866.010.1-T_at | 9.51219169 | 5.699587788 |
| 449 | 8404.005.1-B_at | 7.38892631 | 4.907319634 |
| 450 | 3866.005.1-T_at | 9.03709767 | 6.030628254 |
| 451 | 59.003.1-F_at | 5.4356104 | 4.096508262 |
| 452 | 7153.002.5-F_at | 5.25391475 | 7.80693684 |
| 453 | 2487.001.1-T_at | 5.33828017 | 3.563654952 |
| 454 | 3866.010.1-B_at | 9.6945434 | 7.292676871 |
| 455 | 147495.009.1-T | 4.85966734 | 3.631522846 |
| 456 | 65983.003.2-T_at | 6.05435123 | 4.377097045 |
| 457 | 59.040.1-D_at | 7.44167751 | 4.584016558 |
| 458 | 59.024.2-T_at | 6.73075195 | 4.593534348 |
| 459 | 1717.009.2-B_at | 8.45360663 | 6.312163684 |
| 460 | 1756.027.1-F_at | 4.75197052 | 3.358719581 |
| 461 | 59.042.1-B_at | 8.72270213 | 5.878159021 |
| 462 | 7153.002.5-D_at | 4.84971619 | 7.17366424 |
| 463 | 57447.031.1-F_at | 6.49415294 | 4.65208765 |
| 464 | 140885.011.1-C | 6.38820366 | 4.253831639 |
| 465 | 59.003.1-T_at | 7.42538834 | 5.15557028 |
| 466 | 3832.002.1-D_at | 3.75527723 | 5.95014323 |
| 467 | 3880.005.1-D_at | 10.9942207 | 8.319628818 |
| 468 | 3084.012.1-F_at | 5.28504089 | 3.485172312 |

TABLE 5-continued

Table 5. Average profiles of the preferred 1,228 signature probe set on the 24 benign and 70 malignant tissues of the training set.

| NO | Probeset_Id | benign profile | malignant profile |
|---|---|---|---|
| 469 | 6595.012.1-B_at | 5.31888699 | 3.686393951 |
| 470 | 59.012.2-D_at | 7.44955953 | 4.615757659 |
| 471 | 57447.034.1-C_at | 8.57145373 | 6.706526296 |
| 472 | 56477.001.1-B_at | 7.19333631 | 5.61196287 |
| 473 | 57447.041.1-D_at | 6.52483208 | 4.131433849 |
| 474 | 9768.005.1-B_at | 8.31090623 | 9.919835275 |
| 475 | 285203.001.2-C | 5.76551543 | 4.033568669 |
| 476 | 147495.006.1-B | 4.7178507 | 3.386397601 |
| 477 | 7018.029.1-D_at | 7.49247458 | 4.695975326 |
| 478 | 3852.009.1-T_at | 7.08281122 | 4.869630434 |
| 479 | 59.023.2-D_at | 7.777198 | 5.151112126 |
| 480 | 1959.002.1-D_at | 4.95918444 | 3.503378215 |
| 481 | 7018.014.1-D_at | 7.44352827 | 4.557712011 |
| 482 | 5858.004.1-F_at | 6.76116585 | 4.375553995 |
| 483 | 79192.002.2-D_at | 5.63448533 | 3.51926817 |
| 484 | 59.008.2-B_at | 8.69617919 | 5.779103612 |
| 485 | 8404.008.1-E_at | 5.85502792 | 4.086526269 |
| 486 | 59.008.1-F_at | 6.10922251 | 4.513619758 |
| 487 | 4240.011.1-B_at | 6.01396547 | 3.771634645 |
| 488 | 94274.002.1-C_at | 6.16939359 | 3.837512253 |
| 489 | 4638.015.1-T_at | 5.62349541 | 3.911665402 |
| 490 | 6376.001.1-T_at | 7.28348829 | 5.069341011 |
| 491 | 57447.043.1-F_at | 6.82408835 | 4.362797669 |
| 492 | 59.039.1-T_at | 6.75082374 | 4.916156262 |
| 493 | 4638.006.1-B_at | 5.98299624 | 4.034678304 |
| 494 | 25802.003.1-F_at | 8.44079836 | 5.782396909 |
| 495 | 57447.025.1-T_at | 7.73646375 | 5.084216105 |
| 496 | 57447.017.1-T_at | 6.65771959 | 4.273635182 |
| 497 | 7018.026.1-C_at | 7.45984207 | 4.533286079 |
| 498 | 7018.028.1-E_at | 7.40598333 | 4.550309687 |
| 499 | 4915.008.1-C_at | 5.64881509 | 3.72422841 |
| 500 | 358.018.1-C_at | 5.7267252 | 3.761286452 |
| 501 | 7153.002.6-B_at | 4.11329877 | 6.373276857 |
| 502 | 57447.012.1-T_at | 7.30791833 | 4.819204577 |
| 503 | 59.040.1-B_at | 5.85498792 | 4.104163066 |
| 504 | 57447.006.1-T_at | 7.76068288 | 5.150567998 |
| 505 | 9493.006.1-F_at | 4.10577729 | 6.338245812 |
| 506 | 57447.004.1-T_at | 7.33632129 | 4.896275995 |
| 507 | 57447.004.2-B_at | 8.9127783 | 6.322143899 |
| 508 | 7373.001.2-D_at | 5.3965566 | 3.844531388 |
| 509 | 9493.004.1-B_at | 3.76399079 | 5.935350549 |
| 510 | 2568.005.2-C_at | 6.84549764 | 3.843092863 |
| 511 | 7018.029.1-F_at | 7.12490547 | 4.43476648 |
| 512 | 26289.013.1-B_at | 6.90469249 | 5.370319984 |
| 513 | 7169.015.1-B_at | 6.84318501 | 4.909744137 |
| 514 | 57451.001.3-F_at | 4.90668348 | 3.471308523 |
| 515 | 2568.005.2-F_at | 6.79093209 | 4.252137182 |
| 516 | 57447.004.2-F_at | 8.06429543 | 5.612147867 |
| 517 | 8404.004.1-D_at | 5.17131676 | 3.577119644 |
| 518 | 3855.004.2-D_at | 6.85394835 | 4.458549061 |
| 519 | 3872.014.1-F_at | 6.14273082 | 4.52366007 |
| 520 | 57447.033.1-F_at | 7.64663376 | 5.439828214 |
| 521 | 9452.001.1-T_at | 6.18030538 | 4.323283485 |
| 522 | 59.033.2-T_at | 5.65222584 | 4.220481151 |
| 523 | 3084.009.1-T_at | 5.35152557 | 3.607558469 |
| 524 | 57447.040.1-T_at | 8.2897346 | 6.134921385 |
| 525 | 4833.004.1-T_at | 9.46766291 | 10.42910615 |
| 526 | 3426.001.1-F_at | 6.26649958 | 4.50478468 |
| 527 | 59.034.1-B_at | 5.62313286 | 4.199853557 |
| 528 | 10253.001.1-E_at | 5.11930015 | 3.602200848 |
| 529 | 9073.001.1-C_at | 6.47130665 | 3.903135256 |
| 530 | 51201.005.1-T_at | 6.31581082 | 4.43048891 |
| 531 | 9477.006.1-C_at | 5.53969827 | 4.094283805 |
| 532 | 57447.028.1-T_at | 7.15440543 | 4.718940054 |
| 533 | 25925.007.1-T_at | 5.59498246 | 3.919647944 |
| 534 | 59.024.2-B_at | 8.11536088 | 5.398824045 |
| 535 | 2.022.1-T_at | 6.6607733 | 4.783988683 |
| 536 | 4281.008.2-B_at | 6.31875113 | 4.027809365 |
| 537 | 90231.001.1-C_at | 7.10807035 | 5.499098683 |
| 538 | 358.012.1-D_at | 7.14590494 | 4.561944415 |
| 539 | 3852.021.1-T_at | 6.09796458 | 4.733460989 |
| 540 | 7373.003.4-D_at | 5.31871742 | 3.444341336 |
| 541 | 57447.048.1-T_at | 7.77920047 | 5.301184204 |
| 542 | 358.012.1-B_at | 6.31206962 | 4.291200634 |
| 543 | 7018.025.1-C_at | 6.45586871 | 3.926355221 |
| 544 | 5608.004.1-T_at | 5.49475117 | 4.000756586 |
| 545 | 3084.012.2-F_at | 5.75533986 | 3.729134317 |
| 546 | 4306.002.1-C_at | 4.88461568 | 3.537810553 |
| 547 | 4288.004.1-D_at | 3.93407536 | 6.069531548 |
| 548 | 57447.002.1-F_at | 7.74355125 | 5.160300501 |
| 549 | 4281.018.1-T_at | 5.78771209 | 4.04473446 |
| 550 | 10144.020.2-B_at | 5.47403735 | 3.883269971 |
| 551 | 6876.016.1-E_at | 6.18917118 | 4.18306498 |
| 552 | 57447.008.2-T_at | 7.34801416 | 4.979022114 |
| 553 | 51203.004.1-T_at | 4.78407281 | 7.121996232 |
| 554 | 2335.028.1-B_at | 4.21322617 | 6.985070244 |
| 555 | 7018.028.1-T_at | 7.69070629 | 4.697084965 |
| 556 | 7373.003.5-T_at | 4.92968881 | 3.413713427 |
| 557 | 81557.006.1-C_at | 5.93949691 | 3.8795395 |
| 558 | 3866.002.1-D_at | 8.13043421 | 4.563939496 |
| 559 | 3866.001.1-B_at | 9.58995543 | 5.652717341 |
| 560 | 55107.006.2-T_at | 5.84582122 | 4.291743766 |
| 561 | 79068.010.1-D_at | 5.70046398 | 3.712391955 |
| 562 | 57447.009.1-T_at | 8.2708267 | 6.230837008 |
| 563 | 2115.015.1-E_at | 4.73030559 | 3.529706912 |
| 564 | 1756.013.1-C_at | 5.56755741 | 3.498765701 |
| 565 | 7169.015.1-F_at | 7.18617 | 5.481397093 |
| 566 | 65983.013.2-F_at | 6.02311371 | 4.186716607 |
| 567 | 8404.001.1-B_at | 7.99199458 | 5.467331229 |
| 568 | 4240.004.1-B_at | 5.05165978 | 3.552351613 |
| 569 | 57447.012.2-T_at | 7.26590502 | 4.745539951 |
| 570 | 57447.024.1-F_at | 7.68629251 | 5.418867784 |
| 571 | 358.018.1-T_at | 6.45498824 | 4.241533634 |
| 572 | 57447.048.2-T_at | 7.78420544 | 5.160126545 |
| 573 | 59.031.1-C_at | 7.49205582 | 4.903309981 |
| 574 | 3860.007.1-F_at | 7.96260627 | 7.096659156 |
| 575 | 8404.028.1-C_at | 8.62889588 | 6.246608834 |
| 576 | 4240.011.3-E_at | 6.64966622 | 4.03055242 |
| 577 | 59.022.2-B_at | 6.73772327 | 4.432555365 |
| 578 | 3866.002.1-F_at | 9.25258448 | 5.192570901 |
| 579 | 3866.002.1-T_at | 10.3199488 | 7.640256534 |
| 580 | 4915.005.1-B_at | 5.32094122 | 3.959770809 |
| 581 | 8404.008.1-F_at | 7.59063584 | 4.972790065 |
| 582 | 79608.002.1-F_at | 6.76648623 | 4.436714154 |
| 583 | 8404.023.1-D_at | 5.15683509 | 3.569085706 |
| 584 | 3426.002.1-D_at | 5.89393001 | 3.867643288 |
| 585 | 2335.027.1-T_at | 4.74881131 | 7.635920403 |
| 586 | 11065.009.1-T_at | 4.30670491 | 6.277657291 |
| 587 | 140885.013.1-F | 4.7450748 | 3.529107038 |
| 588 | 57447.021.1-B_at | 8.92169251 | 6.883898006 |
| 589 | 25802.004.1-C_at | 5.57673557 | 3.766890823 |
| 590 | 4638.014.1-F_at | 6.07887669 | 4.28495326 |
| 591 | 9493.004.1-F_at | 4.40101083 | 6.610015234 |
| 592 | 8404.004.1-B_at | 5.26981439 | 3.864868573 |
| 593 | 8404.004.2-T_at | 7.56316749 | 5.288443352 |
| 594 | 57447.010.2-T_at | 8.91041497 | 6.730736236 |
| 595 | 57447.010.3-B_at | 6.48036743 | 4.021664269 |
| 596 | 27122.006.1-T_at | 6.45932378 | 4.338943765 |
| 597 | 5156.005.1-T_at | 6.0454338 | 4.480368629 |
| 598 | 5858.004.1-E_at | 7.37541332 | 5.015122988 |
| 599 | 25802.008.1-D_at | 5.55466297 | 3.708835665 |
| 600 | 2327.002.2-T_at | 5.75006787 | 3.952332834 |
| 601 | 3852.004.1-C_at | 5.36673477 | 3.588173957 |
| 602 | 59.026.2-F_at | 6.23946248 | 4.728060027 |
| 603 | 57447.029.1-C_at | 6.81845329 | 4.22278911 |
| 604 | 7169.022.1-D_at | 7.8722658 | 5.729424902 |
| 605 | 23266.001.3-B_at | 6.46418041 | 4.203358555 |
| 606 | 3084.012.1-B_at | 5.2276441 | 3.451592509 |
| 607 | 29127.019.2-T_at | 4.21990379 | 6.173743362 |
| 608 | 10253.004.1-T_at | 5.1662428 | 3.694488428 |
| 609 | 10124.002.1-D_at | 4.89764097 | 3.541005706 |
| 610 | 3861.013.1-D_at | 9.32851084 | 8.049530881 |
| 611 | 8404.032.1-T_at | 7.52923111 | 5.000568707 |
| 612 | 84441.002.1-E_at | 5.90012193 | 3.970885538 |
| 613 | 2.013.1-E_at | 7.80547535 | 5.549361786 |
| 614 | 3084.004.1-T_at | 4.81080947 | 3.346803546 |
| 615 | 5288.001.2-F_at | 4.76245236 | 3.504782872 |
| 616 | 57447.017.1-F_at | 8.0107637 | 5.541276327 |
| 617 | 3084.006.1-T_at | 4.81532746 | 3.375970424 |
| 618 | 59.039.1-F_at | 6.56572249 | 5.093494374 |

TABLE 5-continued

Table 5. Average profiles of the preferred 1,228 signature probe set on the 24 benign and 70 malignant tissues of the training set.

| NO | Probeset_Id | benign profile | malignant profile |
|---|---|---|---|
| 619 | 2.024.1-T_at | 5.21957454 | 3.829912849 |
| 620 | 3815.002.2-E_at | 4.63092258 | 3.36714837 |
| 621 | 1756.009.1-D_at | 4.85499539 | 3.471377655 |
| 622 | 7091.014.1-B_at | 7.40595585 | 5.56221435 |
| 623 | 4629.015.1-F_at | 5.10691679 | 3.491137224 |
| 624 | 59.008.2-F_at | 6.0929029 | 4.444669467 |
| 625 | 2568.005.2-T_at | 8.95422916 | 5.14191273 |
| 626 | 115207.002.1-T | 5.88924208 | 4.419602651 |
| 627 | 4281.001.1-T_at | 5.35086765 | 3.640788304 |
| 628 | 84668.002.2-T_at | 5.15028907 | 3.79042988 |
| 629 | 4240.004.1-F_at | 5.66574104 | 3.720396854 |
| 630 | 8404.005.1-D_at | 6.9401254 | 4.492872909 |
| 631 | 8404.032.1-B_at | 7.44013836 | 5.095849595 |
| 632 | 57447.044.1-E_at | 6.80906698 | 4.217089915 |
| 633 | 8626.006.2-F_at | 7.23333868 | 4.510165054 |
| 634 | 57447.051.2-B_at | 7.98328422 | 5.210860718 |
| 635 | 1063.001.1-T_at | 3.65207754 | 5.460717647 |
| 636 | 3426.002.1-T_at | 6.14481418 | 4.337714037 |
| 637 | 1308.001.1-T_at | 4.49112544 | 3.366968911 |
| 638 | 389432.002.1-F | 4.87416968 | 3.449919343 |
| 639 | 57447.017.1-B_at | 7.4444592 | 4.927207265 |
| 640 | 2115.014.1-F_at | 4.64920074 | 3.393814502 |
| 641 | 5284.004.1-T_at | 5.42573909 | 3.644981157 |
| 642 | 57447.029.1-F_at | 6.90955367 | 4.763872665 |
| 643 | 8626.006.1-F_at | 7.10882986 | 4.577853419 |
| 644 | 2982.002.1-C_at | 5.95650332 | 4.047393285 |
| 645 | 57447.047.1-T_at | 8.49737877 | 6.301927816 |
| 646 | 5803.006.1-E_at | 4.70860909 | 3.460139104 |
| 647 | 57447.021.1-F_at | 6.99463667 | 4.787200512 |
| 648 | 57447.039.1-F_at | 8.6752975 | 7.025558424 |
| 649 | 4281.008.2-F_at | 5.78507528 | 3.786315944 |
| 650 | 57447.029.1-D_at | 7.11241156 | 4.695681706 |
| 651 | 65983.013.1-B_at | 6.06404247 | 4.544332621 |
| 652 | 5284.004.1-E_at | 5.48521773 | 3.473351613 |
| 653 | 4240.011.1-D_at | 6.58817281 | 4.028721269 |
| 654 | 57447.024.1-T_at | 6.74179663 | 4.451590226 |
| 655 | 6876.011.1-B_at | 6.30476658 | 4.18672283 |
| 656 | 7373.003.2-T_at | 4.82544001 | 3.471146792 |
| 657 | 3852.014.1-D_at | 5.18111457 | 3.45188203 |
| 658 | 4915.005.1-D_at | 5.64408415 | 3.959617796 |
| 659 | 9768.002.2-B_at | 5.37116829 | 7.073380688 |
| 660 | 140885.010.1-D | 6.19842073 | 4.31967621 |
| 661 | 4638.020.1-E_at | 5.02985387 | 3.533302553 |
| 662 | 57447.017.1-C_at | 7.71365249 | 6.834906013 |
| 663 | 7373.004.1-T_at | 5.09440176 | 3.576481268 |
| 664 | 3852.008.2-E_at | 5.70467573 | 3.895814365 |
| 665 | 4281.015.1-E_at | 5.86221529 | 3.827749855 |
| 666 | 8404.013.1-C_at | 7.63052911 | 5.806566552 |
| 667 | 90293.001.3-T_at | 5.16415646 | 3.590009024 |
| 668 | 57447.044.1-T_at | 6.3521445 | 4.368444106 |
| 669 | 23650.011.2-D_at | 5.16951309 | 3.620720053 |
| 670 | 2335.006.1-D_at | 5.19038486 | 8.099850829 |
| 671 | 57447.022.1-T_at | 8.16254038 | 6.240130159 |
| 672 | 8404.032.1-D_at | 6.59024869 | 4.387778168 |
| 673 | 8404.030.1-F_at | 6.20905072 | 4.160627809 |
| 674 | 5803.002.2-T_at | 4.56393909 | 3.473197076 |
| 675 | 8404.004.2-C_at | 5.26606619 | 3.620282123 |
| 676 | 84441.005.1-C_at | 4.85915223 | 3.545415518 |
| 677 | 7091.015.1-F_at | 6.21201003 | 4.478013561 |
| 678 | 2119.005.1-D_at | 5.07146093 | 3.567763303 |
| 679 | 7373.003.6-F_at | 6.24165607 | 4.086113068 |
| 680 | 79608.008.1-T_at | 7.43049786 | 5.105020166 |
| 681 | 3852.008.1-T_at | 6.84173919 | 4.788195739 |
| 682 | 8626.007.1-T_at | 5.77669765 | 3.835835567 |
| 683 | 8404.022.1-T_at | 6.96844417 | 4.561425115 |
| 684 | 8404.034.1-T_at | 7.70565001 | 5.437963133 |
| 685 | 57447.049.1-T_at | 8.19539372 | 6.244201139 |
| 686 | 5311.002.1-B_at | 5.23153491 | 3.9379694 |
| 687 | 2335.025.3-T_at | 4.97507454 | 7.552542415 |
| 688 | 4147.012.1-T_at | 6.56476077 | 4.115527169 |
| 689 | 301.015.1-T_at | 7.08671415 | 4.704911993 |
| 690 | 301.004.1-T_at | 5.88285125 | 4.193540097 |
| 691 | 3426.002.2-F_at | 6.42951667 | 4.610291858 |
| 692 | 7091.001.1-C_at | 5.78834657 | 3.99782643 |
| 693 | 8404.021.1-D_at | 7.13632332 | 4.668450897 |
| 694 | 7153.002.3-B_at | 4.32680853 | 6.386139877 |
| 695 | 53335.002.1-E_at | 6.97060249 | 4.349457276 |
| 696 | 5284.003.2-T_at | 5.56357531 | 3.826429145 |
| 697 | 4306.002.1-F_at | 5.12339023 | 3.619119014 |
| 698 | 5284.003.2-D_at | 5.40634511 | 3.413836573 |
| 699 | 5803.002.1-T_at | 4.46452818 | 3.454054461 |
| 700 | 10253.004.1-E_at | 5.04005634 | 3.60976014 |
| 701 | 23650.020.1-T_at | 4.5970193 | 3.540969462 |
| 702 | 57447.042.1-T_at | 8.23732789 | 6.24305985 |
| 703 | 6876.023.1-F_at | 6.0056721 | 4.219933741 |
| 704 | 7169.015.1-C_at | 7.73240413 | 5.633948369 |
| 705 | 7153.002.4-F_at | 4.29974508 | 6.250118979 |
| 706 | 4629.016.1-B_at | 6.78440003 | 5.390110166 |
| 707 | 6876.002.1-C_at | 6.05319952 | 3.996827256 |
| 708 | 65983.007.1-T_at | 5.80300089 | 4.538161738 |
| 709 | 7373.003.2-F_at | 4.94886483 | 3.638149496 |
| 710 | 152015.004.1-T | 7.02090877 | 4.99281238 |
| 711 | 8404.004.2-B_at | 9.10036043 | 6.953060695 |
| 712 | 6285.001.1-B_at | 6.79781208 | 4.254547252 |
| 713 | 2115.007.1-E_at | 4.60359502 | 3.455996501 |
| 714 | 2.013.1-T_at | 7.4129596 | 5.313450804 |
| 715 | 6289.005.1-T_at | 7.97416675 | 5.388443167 |
| 716 | 9232.002.1-T_at | 4.43941526 | 6.671542368 |
| 717 | 59.014.1-B_at | 5.61171235 | 4.093335038 |
| 718 | 59.031.1-F_at | 6.05184505 | 4.804165615 |
| 719 | 3084.011.1-T_at | 4.47393244 | 3.329487007 |
| 720 | 3872.005.1-F_at | 7.08989626 | 4.850069536 |
| 721 | 3084.012.3-F_at | 5.22568038 | 3.554479542 |
| 722 | 81704.008.1-F_at | 6.21408125 | 4.397532613 |
| 723 | 140885.010.2-C | 4.97071116 | 3.671401317 |
| 724 | 338707.006.1-E | 5.98755333 | 4.509773447 |
| 725 | 23266.008.2-T_at | 6.14954287 | 4.054145008 |
| 726 | 120.005.2-E_at | 4.96398804 | 3.493809568 |
| 727 | 4281.009.1-E_at | 5.85541642 | 3.780316615 |
| 728 | 4094.001.1-T_at | 4.9006582 | 3.742133457 |
| 729 | 2995.001.1-T_at | 5.43112669 | 4.074233155 |
| 730 | 4638.011.1-E_at | 5.98438955 | 4.171529554 |
| 731 | 2335.017.1-T_at | 4.62014922 | 7.477442043 |
| 732 | 5284.001.1-F_at | 5.85070156 | 4.156065391 |
| 733 | 8404.026.1-D_at | 5.85230036 | 3.946505653 |
| 734 | 2335.009.1-F_at | 4.30571681 | 7.164817626 |
| 735 | 10461.002.2-F_at | 4.63243519 | 3.535654634 |
| 736 | 84441.002.1-T_at | 5.38195119 | 3.727915338 |
| 737 | 147495.006.1-T | 5.03268944 | 3.722907652 |
| 738 | 7091.010.1-B_at | 7.35452034 | 5.471123192 |
| 739 | 8404.008.1-C_at | 8.16760292 | 5.675687385 |
| 740 | 6376.001.2-C_at | 4.95398073 | 3.657520603 |
| 741 | 3832.002.1-B_at | 5.6547708 | 7.337897553 |
| 742 | 59.034.2-T_at | 7.1564008 | 5.827736739 |
| 743 | 147495.005.1-B | 4.74136095 | 3.469591177 |
| 744 | 3872.005.1-T_at | 7.59194046 | 5.105397146 |
| 745 | 79895.001.1-D_at | 5.67879632 | 4.246832679 |
| 746 | 57447.018.1-T_at | 6.69850781 | 4.473274428 |
| 747 | 7373.008.1-T_at | 5.31202269 | 3.784685566 |
| 748 | 4744.004.1-C_at | 6.56900249 | 4.507168025 |
| 749 | 140885.010.1-T | 5.34750246 | 3.919015769 |
| 750 | 6876.016.2-E_at | 5.93029441 | 3.912787487 |
| 751 | 8404.015.1-T_at | 6.44737359 | 4.403676272 |
| 752 | 4281.014.1-T_at | 5.78461168 | 4.11824695 |
| 753 | 4288.006.1-F_at | 6.66901042 | 8.513403763 |
| 754 | 25925.009.1-E_at | 5.28428858 | 3.73856992 |
| 755 | 4240.009.1-B_at | 5.83089671 | 3.671481622 |
| 756 | 667.010.1-E_at | 6.85392624 | 5.299481091 |
| 757 | 3866.005.1-B_at | 7.15276909 | 4.263334499 |
| 758 | 57447.011.1-T_at | 8.19368289 | 6.289649841 |
| 759 | 57447.034.1-B_at | 5.65705009 | 3.831297336 |
| 760 | 25802.004.1-B_at | 8.21857039 | 6.532464436 |
| 761 | 8404.024.1-T_at | 6.97369157 | 4.587021041 |
| 762 | 57447.032.1-T_at | 7.06280543 | 4.783190929 |
| 763 | 667.021.1-F_at | 8.07963087 | 5.823822156 |
| 764 | 5858.001.2-F_at | 5.1370254 | 3.721747178 |
| 765 | 51062.008.1-T_at | 5.30551619 | 3.890620002 |
| 766 | 2335.013.1-F_at | 6.15540646 | 8.86885363 |
| 767 | 2568.001.2-T_at | 5.68238983 | 3.94629046 |
| 768 | 7170.005.2-D_at | 8.99098118 | 9.775109373 |

TABLE 5-continued

Table 5. Average profiles of the preferred 1,228 signature probe set on the 24 benign and 70 malignant tissues of the training set.

| NO | Probeset_Id | benign profile | malignant profile |
|---|---|---|---|
| 769 | 57447.034.1-F_at | 6.98073127 | 5.016025642 |
| 770 | 7153.002.6-C_at | 5.57448334 | 7.592280416 |
| 771 | 2568.003.1-T_at | 5.81249572 | 4.092333465 |
| 772 | 59.008.2-T_at | 8.60581658 | 6.540879986 |
| 773 | 9898.015.2-B_at | 3.9211311 | 5.201936253 |
| 774 | 7018.013.1-T_at | 5.65007058 | 3.778570945 |
| 775 | 7170.034.2-D_at | 9.01623909 | 9.815404878 |
| 776 | 3866.004.1-E_at | 4.83901548 | 3.502240062 |
| 777 | 5284.001.1-T_at | 8.49976792 | 6.07875714 |
| 778 | 2.002.1-C_at | 6.12813044 | 4.193878475 |
| 779 | 57447.050.1-T_at | 8.19795199 | 5.982437202 |
| 780 | 7018.014.1-F_at | 6.97729458 | 4.681227687 |
| 781 | 2335.032.1-D_at | 5.08653484 | 8.031106422 |
| 782 | 3866.002.1-C_at | 6.91504668 | 4.200467449 |
| 783 | 57447.043.1-T_at | 6.56411152 | 4.225208179 |
| 784 | 51201.005.1-D_at | 5.11440976 | 3.64815718 |
| 785 | 51203.003.1-T_at | 4.82041174 | 7.05990414 |
| 786 | 9493.001.1-F_at | 3.98373277 | 6.007980938 |
| 787 | 57447.024.1-B_at | 7.87321828 | 5.204843561 |
| 788 | 80034.003.4-B_at | 5.58242913 | 4.421835696 |
| 789 | 7170.016.3-C_at | 9.01883837 | 9.828229863 |
| 790 | 65983.003.1-T_at | 5.92193731 | 4.324879597 |
| 791 | 57447.026.1-T_at | 8.15874879 | 6.121827399 |
| 792 | 440421.001.1-F | 7.16019583 | 5.432495642 |
| 793 | 301.008.1-D_at | 5.48743448 | 3.703220782 |
| 794 | 80034.002.2-T_at | 4.34845355 | 3.381277916 |
| 795 | 7153.002.5-B_at | 5.10010536 | 7.50996728 |
| 796 | 3852.023.1-T_at | 5.16770498 | 4.068449227 |
| 797 | 8404.013.1-F_at | 6.3516361 | 4.31581135 |
| 798 | 2.018.1-C_at | 4.79949735 | 3.600814702 |
| 799 | 10124.003.1-B_at | 7.77141001 | 5.984762853 |
| 800 | 3852.008.2-F_at | 5.25269037 | 3.555215368 |
| 801 | 4288.006.2-T_at | 4.41269608 | 6.475089289 |
| 802 | 8404.026.1-C_at | 7.87032712 | 5.309471428 |
| 803 | 23650.019.1-C_at | 4.78127834 | 3.449585316 |
| 804 | 7170.027.1-T_at | 10.1785633 | 10.86779555 |
| 805 | 54928.003.1-E_at | 7.95793621 | 6.353966846 |
| 806 | 2335.025.1-B_at | 6.59794162 | 8.83157397 |
| 807 | 3084.010.1-T_at | 4.64480819 | 3.365397857 |
| 808 | 57447.051.1-T_at | 7.94997082 | 5.870179931 |
| 809 | 80034.003.4-T_at | 4.8124569 | 3.414443991 |
| 810 | 2568.005.1-D_at | 5.60503766 | 3.638290306 |
| 811 | 8404.032.1-F_at | 7.82269285 | 5.541014824 |
| 812 | 2115.003.1-E_at | 4.60503701 | 3.463043796 |
| 813 | 57447.035.1-T_at | 6.58609653 | 4.690569876 |
| 814 | 8404.009.1-T_at | 8.30486375 | 5.75977584 |
| 815 | 8404.028.3-B_at | 6.39814918 | 4.353137247 |
| 816 | 6289.003.1-B_at | 8.85424542 | 5.981607568 |
| 817 | 7170.025.1-F_at | 7.37697122 | 8.410726942 |
| 818 | 8404.030.1-D_at | 4.68883661 | 3.480079758 |
| 819 | 8404.009.1-F_at | 6.4288173 | 4.305937183 |
| 820 | 2335.009.1-T_at | 5.3309114 | 8.084486221 |
| 821 | 22974.007.1-F_at | 5.33852227 | 7.851513061 |
| 822 | 3426.002.1-B_at | 5.18878725 | 3.666443854 |
| 823 | 4638.003.1-D_at | 4.80794498 | 3.519315999 |
| 824 | 4147.011.1-T_at | 5.5473121 | 3.770096298 |
| 825 | 6876.016.2-T_at | 6.73562706 | 4.929179325 |
| 826 | 23650.003.1-F_at | 5.36467738 | 3.8134759 |
| 827 | 4744.004.1-E_at | 5.98052533 | 4.025288625 |
| 828 | 64168.010.1-F_at | 4.47544044 | 3.464747266 |
| 829 | 9073.001.1-F_at | 6.32607617 | 3.970691137 |
| 830 | 5288.001.3-F_at | 5.80543381 | 4.395911298 |
| 831 | 3866.005.1-D_at | 4.69976421 | 3.498394825 |
| 832 | 8404.021.1-T_at | 7.61048125 | 5.126133895 |
| 833 | 25925.011.1-E_at | 5.22009218 | 3.770296785 |
| 834 | 23266.001.3-F_at | 6.97341376 | 4.950755879 |
| 835 | 9232.004.1-F_at | 4.54899231 | 6.788996757 |
| 836 | 4147.005.2-F_at | 6.46653951 | 4.116097107 |
| 837 | 2335.025.3-B_at | 4.1218962 | 6.635944112 |
| 838 | 4638.006.1-C_at | 4.60097436 | 3.386710346 |
| 839 | 147804.004.1-T | 8.74204077 | 9.383412702 |
| 840 | 81704.013.1-D_at | 5.74760963 | 4.078176314 |
| 841 | 54443.013.1-B_at | 3.78713573 | 5.832999901 |
| 842 | 1410.005.1-T_at | 7.99587494 | 5.02138884 |
| 843 | 25925.009.1-T_at | 5.84441997 | 4.119796362 |
| 844 | 3204.001.1-T_at | 6.21835333 | 4.25541633 |
| 845 | 29997.012.1-F_at | 9.16397087 | 7.980650261 |
| 846 | 2.005.1-C_at | 9.81288715 | 8.155872692 |
| 847 | 140885.011.1-F | 6.19333879 | 4.903420797 |
| 848 | 7153.002.3-F_at | 3.47065774 | 5.379571026 |
| 849 | 1063.002.1-F_at | 4.818547 | 6.814140949 |
| 850 | 10144.021.1-F_at | 5.41639448 | 3.918615816 |
| 851 | 8404.025.1-E_at | 7.03203124 | 4.624818473 |
| 852 | 6876.020.1-B_at | 6.533895 | 4.437030997 |
| 853 | 7170.006.1-C_at | 9.05537796 | 9.822975281 |
| 854 | 10051.016.1-T_at | 7.11146583 | 8.35678465 |
| 855 | 5288.001.2-D_at | 4.36619367 | 3.362822607 |
| 856 | 7018.029.1-T_at | 6.23394945 | 3.983824938 |
| 857 | 5627.002.1-B_at | 5.10823783 | 3.887587419 |
| 858 | 57447.037.1-T_at | 6.70751747 | 4.463904664 |
| 859 | 4147.005.2-D_at | 6.41967658 | 4.010663201 |
| 860 | 8404.023.1-T_at | 8.96871259 | 6.761468547 |
| 861 | 3872.006.1-D_at | 7.20926464 | 5.468717646 |
| 862 | 399687.001.1-C | 5.1094656 | 3.656879029 |
| 863 | 3815.002.4-D_at | 4.48207839 | 3.345874495 |
| 864 | 59.034.2-B_at | 7.86775534 | 5.305977855 |
| 865 | 8404.035.1-T_at | 7.35557119 | 4.961673356 |
| 866 | 8404.030.1-T_at | 9.22413584 | 7.338140147 |
| 867 | 54997.002.2-T_at | 4.91413205 | 3.541335298 |
| 868 | 57561.001.1-F_at | 7.63984954 | 5.681299176 |
| 869 | 8404.031.1-T_at | 8.83771374 | 6.734753847 |
| 870 | 2.025.1-E_at | 6.76479665 | 4.728179737 |
| 871 | 699.002.1-F_at | 4.23691585 | 6.351343745 |
| 872 | 57447.041.1-F_at | 8.01010166 | 5.655092904 |
| 873 | 9055.013.1-D_at | 3.74232362 | 5.955553435 |
| 874 | 8404.008.1-D_at | 7.31144196 | 4.840262527 |
| 875 | 7018.028.1-T_at | 6.15805126 | 3.968077116 |
| 876 | 2568.005.1-T_at | 5.80411431 | 3.692039293 |
| 877 | 10051.005.3-T_at | 7.06136791 | 8.335822705 |
| 878 | 2568.002.2-T_at | 5.39690112 | 3.699196299 |
| 879 | 4147.004.1-T_at | 6.45719145 | 4.078127629 |
| 880 | 2938.001.1-T_at | 5.28917706 | 3.569952501 |
| 881 | 1308.007.1-E_at | 4.33353721 | 3.32285855 |
| 882 | 2982.012.1-T_at | 6.69749373 | 4.397652902 |
| 883 | 8404.028.1-D_at | 9.17080043 | 6.681120058 |
| 884 | 7373.001.2-B_at | 5.50958781 | 3.91365763 |
| 885 | 2893.002.2-B_at | 4.99194607 | 3.464698996 |
| 886 | 116369.006.4-C | 7.33578706 | 5.780057699 |
| 887 | 6304.007.1-T_at | 6.03651208 | 4.53887378 |
| 888 | 2335.035.1-T_at | 3.84203808 | 6.550409853 |
| 889 | 4751.002.1-T_at | 3.37070549 | 5.029578851 |
| 890 | 64151.001.2-T_at | 4.47557646 | 6.324975406 |
| 891 | 29089.003.1-T_at | 4.48056575 | 6.605198239 |
| 892 | 59.031.1-B_at | 7.22996112 | 4.744191474 |
| 893 | 7018.025.1-T_at | 5.84703558 | 3.746460765 |
| 894 | 3860.008.1-T_at | 5.34250998 | 4.140007902 |
| 895 | 5858.003.3-F_at | 5.09683569 | 3.735471384 |
| 896 | 8404.009.1-C_at | 8.45510904 | 6.045801083 |
| 897 | 7169.022.1-T_at | 6.97482167 | 4.826590592 |
| 898 | 25925.006.1-T_at | 5.34961663 | 3.868058889 |
| 899 | 59.049.1-F_at | 6.6091616 | 5.230817807 |
| 900 | 5284.003.1-T_at | 5.4389606 | 3.820813601 |
| 901 | 2982.002.1-F_at | 6.20754503 | 4.114933269 |
| 902 | 2568.002.1-T_at | 5.18521978 | 3.672133283 |
| 903 | 301.004.1-B_at | 6.4786296 | 4.407193121 |
| 904 | 25925.011.1-F_at | 5.58763288 | 4.002507678 |
| 905 | 59.004.1-F_at | 5.74336584 | 4.280036618 |
| 906 | 6289.002.1-B_at | 8.87204796 | 6.038294234 |
| 907 | 244.003.1-C_at | 5.36729328 | 3.596389122 |
| 908 | 11065.008.1-C_at | 3.66496529 | 5.619449029 |
| 909 | 7091.006.1-T_at | 6.70324989 | 4.896846915 |
| 910 | 79608.009.1-F_at | 6.81856163 | 4.583013558 |
| 911 | 9413.002.1-T_at | 5.78003165 | 4.176180652 |
| 912 | 7431.064.1-C_at | 6.00790783 | 4.318847511 |
| 913 | 8404.029.1-E_at | 7.5152716 | 5.026824891 |
| 914 | 6876.020.1-T_at | 6.73708584 | 4.994785476 |
| 915 | 301.005.1-T_at | 7.12173249 | 4.879038375 |
| 916 | 9055.014.1-T_at | 5.9433395 | 8.161119674 |
| 917 | 4281.023.1-T_at | 5.06611225 | 3.689556134 |
| 918 | 3868.005.1-D_at | 5.81265413 | 4.356646518 |

TABLE 5-continued

Table 5. Average profiles of the preferred 1,228 signature probe set on the 24 benign and 70 malignant tissues of the training set.

| NO | Probeset_Id | benign profile | malignant profile |
|---|---|---|---|
| 919 | 1062.001.6-B_at | 4.61979335 | 5.902124565 |
| 920 | 5858.005.1-T_at | 6.62044043 | 5.019290814 |
| 921 | 51201.007.1-F_at | 5.89798751 | 4.556162061 |
| 922 | 4240.001.1-B_at | 7.04315913 | 5.225486532 |
| 923 | 8404.029.1-T_at | 7.19061905 | 4.823349131 |
| 924 | 9413.001.1-T_at | 5.85356534 | 4.184779715 |
| 925 | 9768.005.1-T_at | 4.56065688 | 6.668381892 |
| 926 | 11197.001.1-T_at | 5.497932 | 3.863349343 |
| 927 | 6285.002.1-T_at | 7.15759953 | 4.38354551 |
| 928 | 2335.006.2-F_at | 4.52057793 | 7.007712622 |
| 929 | 7169.001.1-C_at | 9.97986289 | 8.443197393 |
| 930 | 9493.004.1-T_at | 4.12782496 | 5.475321289 |
| 931 | 4601.014.1-T_at | 7.11289499 | 5.834825527 |
| 932 | 51203.002.2-F_at | 3.76957554 | 5.500135903 |
| 933 | 7018.022.1-F_at | 5.24694116 | 3.916461778 |
| 934 | 4288.009.1-F_at | 4.54685294 | 6.450101537 |
| 935 | 8321.004.1-D_at | 5.28227566 | 3.892211156 |
| 936 | 8564.004.1-E_at | 6.48035789 | 5.023116233 |
| 937 | 7169.022.1-C_at | 8.24544042 | 5.873824132 |
| 938 | 29127.013.1-T_at | 4.10561977 | 5.802203111 |
| 939 | 2.018.1-B_at | 7.31981124 | 5.353818042 |
| 940 | 2.005.1-D_at | 8.25561915 | 6.09796658 |
| 941 | 1058.004.2-T_at | 3.7975226 | 5.865920911 |
| 942 | 2232.014.1-C_at | 5.21644948 | 3.868088006 |
| 943 | 23650.005.1-E_at | 6.06219649 | 4.127697497 |
| 944 | 5621.002.2-T_at | 6.01313915 | 4.906824984 |
| 945 | 51201.005.1-B_at | 6.93913414 | 5.202799498 |
| 946 | 667.022.1-F_at | 8.42885166 | 6.36231857 |
| 947 | 54443.012.1-C_at | 3.50725399 | 5.586709148 |
| 948 | 25802.003.1-C_at | 7.43616073 | 5.067395951 |
| 949 | 3479.003.1-T_at | 6.77825963 | 4.651724222 |
| 950 | 94274.003.1-D_at | 5.91050731 | 3.846777655 |
| 951 | 84668.003.1-T_at | 5.22078827 | 3.927647308 |
| 952 | 22974.008.1-E_at | 4.27998201 | 6.244828978 |
| 953 | 55656.007.3-B_at | 5.26745658 | 6.648785128 |
| 954 | 29127.002.1-T_at | 4.18023368 | 5.884883109 |
| 955 | 4281.012.2-T_at | 5.18559903 | 3.709369654 |
| 956 | 2335.013.1-B_at | 4.24843254 | 6.768210889 |
| 957 | 79627.003.1-B_at | 5.80046587 | 4.283731062 |
| 958 | 2982.014.1-T_at | 6.70490207 | 4.400137878 |
| 959 | 2335.053.1-T_at | 5.80672371 | 8.072794315 |
| 960 | 667.001.1-F_at | 5.91836585 | 4.436185766 |
| 961 | 8404.030.1-B_at | 8.7803817 | 6.762729417 |
| 962 | 2335.025.1-C_at | 5.89016354 | 8.340545982 |
| 963 | 140885.010.3-D | 5.64716726 | 3.935175019 |
| 964 | 55366.001.2-F_at | 6.45584577 | 4.52968697 |
| 965 | 7169.015.1-D_at | 9.10850076 | 7.746283286 |
| 966 | 57447.002.1-B_at | 10.5154174 | 8.85406099 |
| 967 | 22974.008.1-T_at | 4.68631855 | 6.537183038 |
| 968 | 6876.011.1-C_at | 6.44837046 | 4.645016388 |
| 969 | 4281.008.2-D_at | 5.85946061 | 3.878305283 |
| 970 | 59.008.1-T_at | 8.48935505 | 6.63847471 |
| 971 | 23266.008.1-F_at | 7.18072955 | 5.133107519 |
| 972 | 2568.003.2-T_at | 5.85722739 | 4.051173411 |
| 973 | 5311.003.1-T_at | 5.37168206 | 4.077343368 |
| 974 | 6304.011.1-T_at | 5.92190291 | 4.37727733 |
| 975 | 3861.008.1-B_at | 7.42551236 | 5.399716053 |
| 976 | 7018.013.1-B_at | 5.26119189 | 3.69876029 |
| 977 | 8404.005.1-F_at | 8.58438422 | 6.423269422 |
| 978 | 7170.027.1-C_at | 9.03620668 | 9.824923692 |
| 979 | 8404.023.1-C_at | 6.96271536 | 4.627460556 |
| 980 | 7373.007.1-C_at | 5.21901652 | 3.512769797 |
| 981 | 1410.009.1-T_at | 8.07507455 | 5.204140322 |
| 982 | 79745.004.3-D_at | 5.57669121 | 4.147896702 |
| 983 | 24137.004.1-T_at | 3.54526583 | 5.143662611 |
| 984 | 6241.013.1-B_at | 5.32142819 | 7.577868116 |
| 985 | 1410.001.1-T_at | 8.89756795 | 5.783554496 |
| 986 | 4781.015.2-B_at | 7.82251501 | 5.588763483 |
| 987 | 72.002.1-T_at | 5.49901408 | 3.657567415 |
| 988 | 4833.004.1-T_at | 7.72478747 | 8.933008875 |
| 989 | 57447.024.1-D_at | 8.39121333 | 5.734774748 |
| 990 | 2982.013.2-T_at | 6.69829498 | 4.788664846 |
| 991 | 79971.012.1-T_at | 7.86816422 | 5.097596928 |
| 992 | 8404.028.3-C_at | 8.43509005 | 5.660339589 |
| 993 | 4638.011.1-E_at | 4.54149983 | 3.401814228 |
| 994 | 7169.004.1-C_at | 9.93319291 | 8.292756224 |
| 995 | 4288.004.1-F_at | 5.48379306 | 7.569481427 |
| 996 | 59.012.2-C_at | 7.35490878 | 6.158197444 |
| 997 | 301.008.1-B_at | 7.75881704 | 5.561554031 |
| 998 | 4281.012.1-T_at | 5.22990892 | 3.775893084 |
| 999 | 2335.016.1-F_at | 5.72062946 | 8.271881228 |
| 1000 | 259266.003.1-C | 3.74524657 | 5.64429601 |
| 1001 | 9055.020.1-T_at | 4.54642664 | 6.710996898 |
| 1002 | 7091.016.1-T_at | 6.32037409 | 4.628367394 |
| 1003 | 59.023.1-T_at | 6.98702578 | 5.652733648 |
| 1004 | 57162.010.1-B_at | 5.51558535 | 4.297033118 |
| 1005 | 4781.002.2-D_at | 4.69751141 | 3.532094277 |
| 1006 | 6122.037.1-T_at | 10.367148 | 9.581841169 |
| 1007 | 4240.015.1-B_at | 5.58448718 | 3.769441906 |
| 1008 | 59.034.1-T_at | 7.30028333 | 5.815069711 |
| 1009 | 8404.004.2-D_at | 6.59680571 | 4.480908858 |
| 1010 | 9413.001.2-T_at | 5.83173699 | 4.199417075 |
| 1011 | 2.005.1-F_at | 9.23135004 | 7.463118008 |
| 1012 | 6304.002.1-F_at | 6.22980998 | 4.691222262 |
| 1013 | 3852.005.1-C_at | 5.1815999 | 3.540371293 |
| 1014 | 7170.027.1-B_at | 8.61016621 | 9.330841255 |
| 1015 | 301.013.1-T_at | 7.9831001 | 5.822883877 |
| 1016 | 6304.012.1-F_at | 5.99863704 | 4.356895672 |
| 1017 | 57447.051.2-T_at | 7.96085286 | 6.017184644 |
| 1018 | 11065.005.1-C_at | 3.70869314 | 5.527276202 |
| 1019 | 6422.002.1-F_at | 5.79053376 | 4.58677324 |
| 1020 | 6241.013.1-F_at | 4.36486456 | 6.707728465 |
| 1021 | 2335.032.1-T_at | 6.09077284 | 8.189655849 |
| 1022 | 11065.005.2-T_at | 4.44502121 | 6.241724709 |
| 1023 | 2335.028.1-D_at | 4.37811935 | 7.181272915 |
| 1024 | 29997.016.1-F_at | 7.01231968 | 5.364391961 |
| 1025 | 7018.014.1-T_at | 5.84447021 | 3.853791495 |
| 1026 | 1410.011.1-E_at | 10.4572153 | 7.631013667 |
| 1027 | 7170.040.1-E_at | 9.04381331 | 9.788601589 |
| 1028 | 6289.002.2-F_at | 7.95331589 | 5.409835249 |
| 1029 | 7373.003.4-C_at | 5.37900799 | 3.668049298 |
| 1030 | 7170.041.1-E_at | 9.0780429 | 9.837001991 |
| 1031 | 128553.003.1-B | 4.33787983 | 3.383127715 |
| 1032 | 4094.002.1-D_at | 5.80489701 | 4.110942964 |
| 1033 | 7113.011.1-T_at | 5.03380702 | 3.77489186 |
| 1034 | 7170.002.1-C_at | 10.3310325 | 11.10058024 |
| 1035 | 8404.017.2-T_at | 7.65991671 | 5.307045406 |
| 1036 | 59.029.1-T_at | 6.00974416 | 4.740356024 |
| 1037 | 29089.001.1-T_at | 4.60079781 | 6.714422405 |
| 1038 | 358.012.1-T_at | 7.75384082 | 5.172139857 |
| 1039 | 9134.001.1-B_at | 3.63113188 | 5.472113919 |
| 1040 | 2335.013.1-C_at | 6.22416658 | 8.858188139 |
| 1041 | 1410.010.1-T_at | 8.00194091 | 5.107287395 |
| 1042 | 2207.003.4-F_at | 5.3147747 | 3.687201869 |
| 1043 | 59.042.1-T_at | 8.33740211 | 6.337284559 |
| 1044 | 6304.007.2-T_at | 6.10850875 | 4.532546697 |
| 1045 | 8404.031.1-B_at | 7.42216219 | 5.19861614 |
| 1046 | 6289.001.1-F_at | 8.9307375 | 6.034635624 |
| 1047 | 1410.006.1-T_at | 9.12745661 | 6.076865916 |
| 1048 | 80034.004.1-T_at | 4.30047326 | 3.355594342 |
| 1049 | 1410.008.1-T_at | 7.99198784 | 5.116495458 |
| 1050 | 57447.051.2-D_at | 6.09844409 | 4.536325155 |
| 1051 | 7170.016.3-B_at | 8.29403671 | 9.288724852 |
| 1052 | 4240.001.1-C_at | 9.00972003 | 7.16992054 |
| 1053 | 6288.001.1-T_at | 8.96603543 | 6.273903027 |
| 1054 | 7018.014.1-C_at | 5.99538964 | 3.822846066 |
| 1055 | 8404.020.1-T_at | 7.54635493 | 5.312082632 |
| 1056 | 6289.001.2-F_at | 8.8100063 | 5.866140365 |
| 1057 | 6876.011.1-F_at | 6.08933324 | 4.374504349 |
| 1058 | 8404.031.1-C_at | 6.08486742 | 4.373738904 |
| 1059 | 57447.010.1-F_at | 8.82775044 | 6.339583859 |
| 1060 | 1410.007.2-C_at | 8.33758962 | 5.131217413 |
| 1061 | 59.012.2-B_at | 6.35775616 | 4.443173526 |
| 1062 | 3459.005.1-T_at | 5.80207334 | 4.471777329 |
| 1063 | 301.017.1-C_at | 4.76677119 | 3.59309712 |
| 1064 | 83539.001.1-D_at | 5.41027098 | 3.741417748 |
| 1065 | 6288.004.1-F_at | 7.89445249 | 5.613330538 |
| 1066 | 4781.016.1-E_at | 6.59597542 | 4.602150459 |
| 1067 | 29997.012.1-E_at | 8.53873537 | 7.295932688 |
| 1068 | 57447.021.1-T_at | 6.81768585 | 5.034847695 |

TABLE 5-continued

Table 5. Average profiles of the preferred 1,228 signature probe set on the 24 benign and 70 malignant tissues of the training set.

| NO | Probeset_Id | benign profile | malignant profile |
|---|---|---|---|
| 1069 | 3426.002.1-C_at | 5.23704842 | 3.641068359 |
| 1070 | 53829.001.2-T_at | 5.15275541 | 3.943598064 |
| 1071 | 2115.001.2-B_at | 4.85542703 | 3.530125932 |
| 1072 | 10051.008.1-T_at | 4.4316929 | 5.920843577 |
| 1073 | 1033.002.1-T_at | 3.63139162 | 5.34811339 |
| 1074 | 2335.005.1-D_at | 3.91739921 | 6.295453643 |
| 1075 | 7113.009.1-T_at | 5.43609158 | 3.994720867 |
| 1076 | 3866.002.1-B_at | 9.19732873 | 6.293031612 |
| 1077 | 140885.014.1-D | 7.59348333 | 5.605094004 |
| 1078 | 7168.003.1-T_at | 5.64472419 | 4.457129076 |
| 1079 | 79608.001.1-T_at | 5.30303748 | 3.935571553 |
| 1080 | 79608.008.2-F_at | 6.74835004 | 4.557558664 |
| 1081 | 1410.001.1-B_at | 6.75241131 | 4.22870793 |
| 1082 | 7113.010.1-T_at | 5.85442041 | 4.280294556 |
| 1083 | 4781.014.2-B_at | 7.86598754 | 5.705821081 |
| 1084 | 2335.016.1-E_at | 4.77399968 | 7.375547826 |
| 1085 | 11065.003.1-T_at | 4.37783851 | 6.306175214 |
| 1086 | 3872.006.1-T_at | 7.85482665 | 6.124969921 |
| 1087 | 3084.005.1-F_at | 4.51722715 | 3.439893991 |
| 1088 | 6285.003.1-T_at | 6.40683627 | 4.093334173 |
| 1089 | 6876.016.2-F_at | 6.53765126 | 5.03041211 |
| 1090 | 8404.004.1-T_at | 7.29426573 | 5.24109976 |
| 1091 | 54829.001.1-F_at | 4.55095384 | 7.099570517 |
| 1092 | 8404.001.1-T_at | 8.00106035 | 5.742296291 |
| 1093 | 9055.011.1-E_at | 5.20354473 | 7.152510552 |
| 1094 | 6289.003.2-F_at | 7.95780418 | 5.56331609 |
| 1095 | 22974.007.1-T_at | 4.55846251 | 6.477981817 |
| 1096 | 59.023.2-T_at | 6.91216911 | 5.63439702 |
| 1097 | 7169.015.1-T_at | 10.1958997 | 8.61185317 |
| 1098 | 6289.002.1-F_at | 7.95223459 | 5.506509999 |
| 1099 | 4288.008.1-B_at | 4.4490631 | 6.277435237 |
| 1100 | 4781.007.1-B_at | 6.06074416 | 4.463013886 |
| 1101 | 6876.023.1-T_at | 5.30318153 | 3.837265148 |
| 1102 | 9055.017.1-F_at | 4.93875917 | 6.675610123 |
| 1103 | 7170.018.2-D_at | 8.97464252 | 9.731315695 |
| 1104 | 4781.014.2-D_at | 6.62173963 | 4.59382551 |
| 1105 | 7170.025.1-T_at | 10.1528395 | 10.84778358 |
| 1106 | 7018.025.1-B_at | 5.85576515 | 3.729848132 |
| 1107 | 10253.003.1-T_at | 5.21328569 | 3.796731651 |
| 1108 | 57447.039.1-D_at | 6.20353459 | 4.650979725 |
| 1109 | 59.022.1-T_at | 5.01607936 | 3.66486644 |
| 1110 | 2982.015.1-F_at | 6.52910873 | 4.398315488 |
| 1111 | 10124.004.2-F_at | 5.65171957 | 4.395524581 |
| 1112 | 6289.001.1-B_at | 8.84060005 | 6.026432745 |
| 1113 | 7091.005.1-F_at | 6.22924785 | 4.644117845 |
| 1114 | 501.006.1-B_at | 5.49535249 | 3.832258169 |
| 1115 | 1410.001.1-C_at | 8.37978611 | 5.283357954 |
| 1116 | 57447.021.1-C_at | 6.64989625 | 4.516711936 |
| 1117 | 244.012.1-B_at | 4.57455863 | 3.452384416 |
| 1118 | 7018.026.1-F_at | 7.02591455 | 4.884695118 |
| 1119 | 3872.018.1-T_at | 5.9287371 | 4.536856978 |
| 1120 | 10144.017.3-T_at | 5.24556385 | 3.811639459 |
| 1121 | 11197.001.1-F_at | 5.1313114 | 3.685307479 |
| 1122 | 29127.007.1-B_at | 3.92146605 | 5.671967353 |
| 1123 | 10010.004.1-F_at | 6.85011832 | 5.471009514 |
| 1124 | 81704.013.1-C_at | 7.00929626 | 5.228254202 |
| 1125 | 4781.006.2-B_at | 7.95071123 | 5.849829769 |
| 1126 | 7373.003.1-F_at | 4.96962295 | 3.466223281 |
| 1127 | 8404.009.1-D_at | 7.25304506 | 5.54375843 |
| 1128 | 23092.004.1-T_at | 5.63034915 | 4.135821153 |
| 1129 | 2335.002.1-F_at | 4.95716635 | 7.470035933 |
| 1130 | 8404.031.1-F_at | 8.49473661 | 6.266230481 |
| 1131 | 6304.006.2-T_at | 6.19437915 | 4.664814203 |
| 1132 | 1410.008.1-E_at | 8.35323964 | 5.23093246 |
| 1133 | 9055.019.1-F_at | 5.08438207 | 6.749313988 |
| 1134 | 1398.001.1-D_at | 6.62952 | 5.474846977 |
| 1135 | 57447.051.1-E_at | 7.64975415 | 6.754949154 |
| 1136 | 339965.001.2-B | 6.09281787 | 4.427445717 |
| 1137 | 7113.001.1-C_at | 6.49441996 | 4.364555738 |
| 1138 | 4240.009.1-D_at | 6.92405991 | 4.992040248 |
| 1139 | 7153.002.4-B_at | 3.9192437 | 5.943978275 |
| 1140 | 7169.004.1-D_at | 10.5243791 | 9.455104283 |
| 1141 | 1410.001.1-D_at | 10.4537888 | 7.669238725 |
| 1142 | 59.015.2-B_at | 4.65235051 | 3.439217599 |
| 1143 | 4833.010.1-T_at | 7.67064462 | 8.499214874 |
| 1144 | 7169.022.1-B_at | 8.88810535 | 7.392553599 |
| 1145 | 11065.005.1-T_at | 4.40063594 | 6.264196367 |
| 1146 | 7170.018.2-T_at | 9.1005517 | 9.929531193 |
| 1147 | 79971.013.2-F_at | 7.81954831 | 5.197831093 |
| 1148 | 152015.005.2-F | 5.50228015 | 3.631181096 |
| 1149 | 4288.005.1-D_at | 3.58855622 | 5.41357555 |
| 1150 | 8404.002.1-T_at | 7.82572709 | 5.654573319 |
| 1151 | 6441.004.1-E_at | 7.06431123 | 5.1604289 |
| 1152 | 6122.046.1-B_at | 10.4919703 | 9.7185156 |
| 1153 | 115908.002.1-T | 3.8854167 | 5.716319219 |
| 1154 | 9481.001.1-F_at | 4.56745873 | 3.48672793 |
| 1155 | 8404.008.1-T_at | 7.67594705 | 5.231619593 |
| 1156 | 1410.007.1-D_at | 8.38485465 | 5.254780902 |
| 1157 | 8404.030.1-C_at | 8.36615125 | 6.003710685 |
| 1158 | 57447.039.1-T_at | 6.16284998 | 4.598519131 |
| 1159 | 4147.006.1-E_at | 6.5996408 | 4.306043014 |
| 1160 | 2335.024.2-F_at | 4.14778676 | 6.724104869 |
| 1161 | 891.007.1-T_at | 4.37836908 | 6.277454073 |
| 1162 | 2335.002.1-T_at | 3.69677239 | 5.842235509 |
| 1163 | 8404.017.1-T_at | 7.62129329 | 5.344108953 |
| 1164 | 57451.004.1-B_at | 4.98513349 | 3.645263861 |
| 1165 | 8404.001.1-F_at | 7.80115205 | 5.644594488 |
| 1166 | 8626.006.2-B_at | 4.99013916 | 3.634011318 |
| 1167 | 2335.025.1-T_at | 5.20342277 | 7.312790967 |
| 1168 | 6286.001.1-T_at | 4.37066146 | 7.627611404 |
| 1169 | 10580.012.1-C_at | 5.72236701 | 4.332788093 |
| 1170 | 23321.014.1-T_at | 4.77278608 | 3.653834143 |
| 1171 | 2824.001.2-B_at | 6.86512458 | 5.132614728 |
| 1172 | 29127.022.1-T_at | 4.01626993 | 5.699644246 |
| 1173 | 6289.003.1-F_at | 8.04884622 | 5.558117392 |
| 1174 | 7170.005.2-B_at | 7.21902208 | 8.187290968 |
| 1175 | 54443.011.1-F_at | 3.90847075 | 5.715840566 |
| 1176 | 29127.019.1-T_at | 4.45515346 | 6.238930793 |
| 1177 | 6288.004.1-T_at | 8.9163962 | 6.203405757 |
| 1178 | 29997.008.1-C_at | 8.54806753 | 7.280192975 |
| 1179 | 57447.039.1-B_at | 8.64953038 | 6.241324868 |
| 1180 | 3872.001.1-T_at | 5.78319757 | 3.824950968 |
| 1181 | 57561.002.1-T_at | 7.04642246 | 5.352091902 |
| 1182 | 57451.002.3-B_at | 4.71308984 | 3.460721722 |
| 1183 | 5213.024.1-B_at | 5.69666791 | 4.585191172 |
| 1184 | 2.005.1-T_at | 9.54067496 | 7.938923018 |
| 1185 | 11065.004.1-C_at | 3.58696224 | 5.482200678 |
| 1186 | 1410.006.1-C_at | 8.38947588 | 5.204282844 |
| 1187 | 6289.006.1-T_at | 6.36227497 | 4.331717996 |
| 1188 | 55366.001.1-T_at | 5.81899126 | 4.357905799 |
| 1189 | 23284.007.1-F_at | 5.22440061 | 3.837622352 |
| 1190 | 79971.009.1-T_at | 7.81567707 | 5.261440799 |
| 1191 | 6288.004.1-E_at | 6.55709998 | 4.810646704 |
| 1192 | 11065.004.1-T_at | 4.59241158 | 6.359329521 |
| 1193 | 51203.009.1-T_at | 4.74450869 | 6.362980434 |
| 1194 | 1410.010.1-E_at | 8.32156036 | 5.167245484 |
| 1195 | 57447.030.1-D_at | 7.16110591 | 5.926932144 |
| 1196 | 1308.002.1-T_at | 4.50117394 | 3.487272397 |
| 1197 | 4288.007.1-C_at | 4.97101233 | 7.189192841 |
| 1198 | 244.011.1-T_at | 5.29003948 | 3.948200539 |
| 1199 | 94274.003.1-B_at | 4.42148503 | 3.46060704 |
| 1200 | 3178.003.1-E_at | 6.30358046 | 5.181900836 |
| 1201 | 7153.002.4-T_at | 4.03542364 | 6.008249752 |
| 1202 | 9055.012.1-D_at | 4.02757905 | 6.120371884 |
| 1203 | 9232.001.1-E_at | 5.22181281 | 7.208579638 |
| 1204 | 79068.011.2-B_at | 6.64417255 | 5.308326918 |
| 1205 | 120.005.2-F_at | 9.06074824 | 6.73592483 |
| 1206 | 7534.001.1-C_at | 8.71480548 | 9.492140995 |
| 1207 | 120.005.2-T_at | 8.73626834 | 6.165418999 |
| 1208 | 7373.003.3-C_at | 4.85399243 | 3.462673564 |
| 1209 | 57447.004.2-D_at | 6.16627621 | 4.604091159 |
| 1210 | 2568.005.1-F_at | 4.73444224 | 3.560755491 |
| 1211 | 1308.001.1-E_at | 4.41347272 | 3.418435324 |
| 1212 | 6876.020.1-F_at | 6.2728158 | 4.761356719 |
| 1213 | 79971.014.1-D_at | 6.31129325 | 4.294251993 |
| 1214 | 5621.008.1-D_at | 5.98900704 | 4.179299085 |
| 1215 | 55732.003.2-T_at | 3.81867845 | 5.173615902 |
| 1216 | 221120.006.1-D | 8.08525795 | 7.079961293 |
| 1217 | 23266.008.1-T_at | 6.70366212 | 4.807135334 |
| 1218 | 2335.045.1-F_at | 4.39135516 | 6.494344728 |

TABLE 5-continued

Table 5. Average profiles of the preferred 1,228 signature probe set on the 24 benign and 70 malignant tissues of the training set.

| NO | Probeset_Id | benign profile | malignant profile |
|---|---|---|---|
| 1219 | 7170.007.1-F_at | 7.64167879 | 8.466704716 |
| 1220 | 10461.002.1-B_at | 4.77990896 | 3.622574749 |
| 1221 | 59.031.2-F_at | 5.912075 | 4.730239133 |
| 1222 | 9055.010.1-T_at | 4.95064392 | 6.677393383 |
| 1223 | 58499.005.2-F_at | 5.8908337 | 4.132220814 |
| 1224 | 54443.006.2-F_at | 3.53549616 | 5.526168717 |
| 1225 | 59.016.1-B_at | 5.96979167 | 4.589590519 |
| 1226 | 4288.004.1-C_at | 4.97220803 | 6.791619005 |
| 1227 | 7170.014.1-C_at | 10.3731633 | 11.0837507 |
| 1228 | 7170.007.1-D_at | 10.3462783 | 11.09055128 |

EXAMPLE III

Molecular Prediction for Breast Cancer Diagnosis: Validation Set

A validation set was carried-out that included overall 71 samples. Of these, 21 and 50 were benign lesions and breast cancer respectively. Using this dataset, the inventors assessed the performances of the 1228 signature probes to predict for breast cancer as opposed to benign lesions. Overall 68 out of 71 samples were accurately classified (96%). Sensitivity and specificity of the tests were 96% (95% CI: 90.5-100) and 95% (95% CI: 86.1-100). The correlation of each specimen with the malignant and benign profile is reported in FIG. 6. Of the three misclassified specimen, one corresponded to a benign tumor (inflammatory granulomatosis) classified as malignant, and two were malignant tumors classified as benign by molecular predictor.

The inventors then evaluated the add-value of molecular predictor to cytological exam, and to a model that included classification of American College of Radiology (ACR) and age. Cytological exam failed to provide a definitive diagnosis in 5 out of 71 patients. Four out of these 5 patients were accurately classified by the molecular predictor. The proportion of explained variation (PEV) by Clinical model (age and ACR) was 75%+−8%, while the PEV by molecular predictor was 81% (+/−10%). When clinical model and molecular predictor were combined, the PEV was 87% (+/−7%), suggesting that molecular predictor presented an add-value of 12% (+/−7%) to the clinical model.

Using the top 50 polynucleotide probe sets: 1 out of 21 samples from patients with benign status were misclassified and 8 out of 50 samples from patients with malignant status.

Using the top 100 polynucleotide probe sets: 1 out of 21 samples from patients with benign status were misclassified and 7 out of 50 samples from patients with malignant status.

Using the top 150 polynucleotide probe sets: 1 out of 21 samples from patients with benign status were misclassified and 10 out of 50 samples from patients with malignant status.

Using the top 200 polynucleotide probe sets: 1 out of 21 samples from patients with benign status were misclassified and 7 out of 50 samples from patients with malignant status.

These data demonstrate that top probe set, even if some misclassifications occur, gives a good prognosis for a breast tumor.

Moreover, the use of the 1228, or 1640, polynucleotide probe sets according to the invention allows, without ambiguity, and misclassification, to determine if a breast tumor is benign or malignant.

Discussion

In the present study, the inventors have reported the exonic portrait of breast malignancy. The analysis of differential exonic events between malignant and benign lesions provides a complete picture of genomic anomalies associated with breast malignancy. The present study reveals a high level of genomic dysregulation between malignant and benign breast lesions. The inventors found out that 56652 out of 703680 evidenced probes (8%) were different among the two conditions. When the analysis focused on gene expression level (geo mean of probe sets), 3733 out of 20649 genes (7%) were differentially expressed between malignant and benign lesions. Analysis of gene expression levels revealed overexpression of candidate genes for further investigations. Pituitary Tumor Transforming 1 (PTTG1) has been previously reported to be overexpressed in pituitary tumors, thyroid cancer, colon cancer and glioma and to mediate malignant transformation (Vlotides G, Eigler T, Melmed S. Pituitary tumor-transforming gene: physiology and implications for tumorigenesis. Endocr Rev. 2007 April; 28(2):165-86). Neuroepithelial cell transforming gene 1 (NET1) is a guanine exchange factor that has been reported to mediate oncogenic transformation through activation of RhoA (Chan A M, Takai S, Yamada K, Miki T. Isolation of a novel oncogene, NET1, from neuroepithelioma cells by expression cDNA cloning. Oncogene. 1996 Mar. 21; 12(6):1259-66). Pathway analysis revealed that genes involved in spliceosome assemble were enriched in the malignant condition. Spliceosome mediates alternative splicing, a phenomenon involved in oncogenesis (Lønning P E, Knappskog S, Staalesen V, Chrisanthar R, Lillehaug J R. Breast cancer prognostication and prediction in the postgenomic era. Ann Oncol. 2007 August; 18(8):1293-306; Pajares M J, Ezponda T, Catena R, Calvo A, Pio R, Montuenga L M. Alternative splicing: an emerging topic in molecular and clinical oncology. Lancet Oncol. 2007 April; 8(4):349-57). Present study suggests that alternative splicing could significantly contribute to the molecular profile of breast cancer. Based on this consideration, the inventors further evaluated to what extent analyses at exonic level could provide additional information to the ones provided by analyses at gene expression level.

The inventors identified that 2675 exon-probes that did not belong to genes identified as differentially expressed, actually presented a significantly higher intensity in breast cancer. A high proportion of these 2675 exon-probes presented a significantly increased splice index in breast cancer as compared to benign tumors. These exon-probes were considered to present a higher difference of intensity between cancer and benign lesions, as compared to the one of their relative genes. Several of these exons are located within genes linked to cancer biology (casein kinase 1, delta (Gao Z H, Seeling J M, Hill V, Yochum A, Virshup D M. Casein kinase I phosphorylates and destabilizes the beta-catenin degradation complex. Proc Natl Acad Sci USA. 2002 Feb. 5; 99(3):1182-), retinoblastoma binding protein 9 (Woitach J T, Zhang M, Niu C H, Thorgeirsson S S. A retinoblastoma-binding protein that affects cell-cycle control and confers transforming ability.

Nat Genet. 1998 August; 19(4):371-4) and ERB2 interacting protein (Jaulin-Bastard F, Arsanto J P, Le Bivic A, Navarro C, Vély F, Saito H, Marchetto S, Hatzfeld M, Santoni M J, Birnbaum D, Borg J P. Interaction between Erbin and a Catenin related protein in epithelial cells. J Biol Chem. 2002 Jan. 25; 277(4):2869-75)). These data point out the limits of analyses at gene expression level to define the transcriptional profile of diseases, and suggest that analysis at exon level could capture biological information that is missed by analysis at gene expression level.

Based on the finding that breast cancer presents a widely different exonic profile as compared to benign tumors, the inventors evaluated whether this technology could be used for breast cancer diagnosis. Pathologic exam of tumor biopsy is the gold standard for cancer diagnosis. Nevertheless, such approach presents several limitations including the need for invasive procedures and, in some tumor types, misdiagnosis. In the present study, the inventors have shown that a large scale molecular analysis based on fine needle aspiration could allow breast cancer diagnosis. This finding opens new ways in the field of cancer diagnosis. Applied to breast cancer, it could allow a more effective post-screening pattern of care by increasing the metric performances of fine needle aspiration. Although biopsy is the current gold standard for breast cancer diagnosis, it is associated with both morbidity and treatment delays (Meunier M, Clough K. Fine needle aspiration cytology versus percutaneous biopsy of nonpalpable breast lesions. Eur J Radiol. 2002 April; 42(1):10-6). Fine needle aspiration is a safer and easier approach but is associated with a high rate of false negative results. In the present study, molecular diagnosis by a 1228-probe signature using FNA samples was associated with 100% accuracy in a training set and 96% accuracy in a validation set. Interestingly, molecular classifier provided accurate diagnosis in 4 out of 5 samples for which the cytological exam was not conclusive. Altogether, these data suggested that the 1228-probe signature could be a complementary tool to cytological exam for the breast cancer diagnosis. This tool could allow avoiding biopsies and unnecessary surgery in patients with benign lesions of the breast. At the opposite, for malignant lesions, this approach could speed-up the diagnosis and could allow decreasing time to surgery. The development of molecular assays for cancer diagnosis could be of special interest in other tumor types. As illustration, the benign nature of thyroid nodules is often difficult to be determined preoperatively, leading to unnecessary surgeries (Poller D N, Stelow E B, Yiangou C. Thyroid FNAC cytology: can we do it better? Cytopathology. 2008 February; 19(1):4-10). A molecular assay could dramatically decrease the need for surgery in this setting.

Overall, the present study reports the full description of exons differentially expressed between breast malignant and benign tumors. These data allowed the identification of candidate genes (PTTG1, NET1) for further functional validation in breast cancer. In addition it suggests that alternative splicing significantly contributes the molecular profile of breast cancer, leading to the identification of exons with a significantly higher splice index in cancer, but located within unchanged gene.

Finally, the splice array technology allowed the development of an exon signature for breast cancer diagnosis.

Lengthy table referenced here

US08299233-20121030-T00001

Please refer to the end of the specification for access instructions.

Lengthy table referenced here

US08299233-20121030-T00002

Please refer to the end of the specification for access instructions.

LENGTHY TABLES

The patent contains a lengthy table section. A copy of the table is available in electronic form from the USPTO web site (http://seqdata.uspto.gov/?pageRequest=docDetail&DocID=US08299233B2). An electronic copy of the table will also be available from the USPTO upon request and payment of the fee set forth in 37 CFR 1.19(b)(3).

SEQUENCE LISTING (5694 sequences)

SEQ ID NO: 1 - DNA, 25 bp, Homo sapiens
tgctacaggacgaagaggaatggat

SEQ ID NO: 2 - DNA, 24 bp, Homo sapiens
ttggcgagcaactcaataaagcgt

SEQ ID NO: 3 - DNA, 25 bp, Homo sapiens
agcagagaatacgtgaacaacagga

SEQ ID NO: 4 - DNA, 24 bp, Homo sapiens
cctggagaagagacctgtcattta

SEQ ID NO: 5 - DNA, 24 bp, Homo sapiens
acctggagaagagacctgtcattt

SEQ ID NO: 6 - DNA, 24 bp, Homo sapiens
ctggagaagagacctgtcatttac

SEQ ID NO: 7 - DNA, 24 bp, Homo sapiens
ttacagcaaaagactgagaactat

SEQ ID NO: 8 - DNA, 24 bp, Homo sapiens
attacagcaaaagactgagaacta

SEQ ID NO: 9 - DNA, 24 bp, Homo sapiens
tacagcaaaagactgagaactatg

SEQ ID NO: 10 - DNA, 23 bp, Homo sapiens
acctgtcatttactccatccttt

SEQ ID NO: 11 - DNA, 25 bp, Homo sapiens
atgctacaggacgaagaggaatgga

SEQ ID NO: 12 - DNA, 23 bp, Homo sapiens
gctcctcggcttatgataactca

SEQ ID NO: 13 - DNA, 25 bp, Homo sapiens
acagggtgaagttgaacaaattgct

SEQ ID NO: 14 - DNA, 25 bp, Homo sapiens
agactgaacacgatgagggtatgct

SEQ ID NO: 15 - DNA, 23 bp, Homo sapiens
aagtcttgtgtcggagagttgaa

SEQ ID NO: 16 - DNA, 25 bp, Homo sapiens
aagatataattggttgtggacggct

SEQ ID NO: 17 - DNA, 25 bp, Homo sapiens
ttgctgaaatggaaactcaaaagga

SEQ ID NO: 18 - DNA, 25 bp, Homo sapiens
accaaagaaattaatgagaagagca

SEQ ID NO: 19 - DNA, 24 bp, Homo sapiens
aaacatgccacgagtaaagccaaa

SEQ ID NO: 20 - DNA, 25 bp, Homo sapiens
ccaaatggcagtggcaaatccaatg

SEQ ID NO: 21 - DNA, 25 bp, Homo sapiens
acttctatcctgtccaacctgcctt

SEQ ID NO: 22 - DNA, 25 bp, Homo sapiens
tgggtttggactgtgctggaaagac

SEQ ID NO: 23 - DNA, 25 bp, Homo sapiens
tgggatgtaggtggtcaggagaaat

SEQ ID NO: 24 - DNA, 24 bp, Homo sapiens
ggatatcagaaaatcagggagtcc

SEQ ID NO: 25 - DNA, 24 bp, Homo sapiens
aggatatcagaaaatcagggagtc

SEQ ID NO: 26 - DNA, 24 bp, Homo sapiens
gatatcagaaaatcagggagtccc

SEQ ID NO: 27 - DNA, 25 bp, Homo sapiens
ggaaggacggttagtcagcagtctt

SEQ ID NO: 28 - DNA, 25 bp, Homo sapiens
ttctatcctgtccaacctgccttca

SEQ ID NO: 29 - DNA, 24 bp, Homo sapiens
ttgttgtggactctgttgatgtcg

SEQ ID NO: 30 - DNA, 24 bp, Homo sapiens
gagtgtctacagcgtggtttgcct

SEQ ID NO: 31 - DNA, 24 bp, Homo sapiens
cctggaaatggggaatgggctgtc

SEQ ID NO: 32 - DNA, 25 bp, Homo sapiens
ccactactgcctcctcaagtacctt

SEQ ID NO: 33 - DNA, 25 bp, Homo sapiens
cgcatgaatgttcacaatctcgcca

SEQ ID NO: 34 - DNA, 25 bp, Homo sapiens
ggcttgaaggcatgaaggaacagga

SEQ ID NO: 35 - DNA, 24 bp, Homo sapiens
ataagaactccctgcccatccttt

SEQ ID NO: 36 - DNA, 25 bp, Homo sapiens
gaggcttagaaagagacatgccaaa

SEQ ID NO: 37 - DNA, 24 bp, Homo sapiens
gccgcgatcacggagttcagatgt

SEQ ID NO: 38 - DNA, 24 bp, Homo sapiens
agccgcgatcacggagttcagatg

SEQ ID NO: 39 - DNA, 24 bp, Homo sapiens
ccgcgatcacggagttcagatgtg

SEQ ID NO: 40 - DNA, 24 bp, Homo sapiens
tgaccacacttccaagacctgatg

SEQ ID NO: 41 - DNA, 23 bp, Homo sapiens
ctcagagtggcaacgggtcgcag

SEQ ID NO: 42 - DNA, 25 bp, Homo sapiens
agagccatccgaaacaccaatgagt

SEQ ID NO: 43 - DNA, 24 bp, Homo sapiens
caccagagcaagccatagacagcc

SEQ ID NO: 44 - DNA, 24 bp, Homo sapiens
ggcaatacagaccatcaagcaata

SEQ ID NO: 45 - DNA, 24 bp, Homo sapiens
tgagtttcgggacaaattagctgc

SEQ ID NO: 46 - DNA, 25 bp, Homo sapiens
gaaagatgaaggaccaaaaggccaa

SEQ ID NO: 47 - DNA, 23 bp, Homo sapiens
agtgatgtgtgggcatttggcgt

SEQ ID NO: 48 - DNA, 24 bp, Homo sapiens
ccgaagactgcctggatgaactgt

SEQ ID NO: 49 - DNA, 25 bp, Homo sapiens
tgtactcttgctggagaaccgatcc

SEQ ID NO: 50 - DNA, 24 bp, Homo sapiens
tgaagtcagcatccgtaacagcac

SEQ ID NO: 51 - DNA, 23 bp, Homo sapiens
gctgatccgctgagtaatggctc

SEQ ID NO: 52 - DNA, 24 bp, Homo sapiens
aacacctctgccttaccacatctg

SEQ ID NO: 53 - DNA, 25 bp, Homo sapiens
gcgagccattgaacttaccttacat

SEQ ID NO: 54 - DNA, 25 bp, Homo sapiens
tgggtgaaggagagtttgggtctgt

SEQ ID NO: 55 - DNA, 25 bp, Homo sapiens
ggaagatgggacctctctgaaagtg

SEQ ID NO: 56 - DNA, 24 bp, Homo sapiens
gctgtctggactttgctgtctctg

SEQ ID NO: 57 - DNA, 24 bp, Homo sapiens
tgagaaggagaagactgcatgact

SEQ ID NO: 58 - DNA, 24 bp, Homo sapiens
atgagacaatcaacaccgttccaa

SEQ ID NO: 59 - DNA, 24 bp, Homo sapiens
gcgaccagcaagacggagtctcac

SEQ ID NO: 60 - DNA, 24 bp, Homo sapiens
ggcgaccagcaagacggagtctca

SEQ ID NO: 61 - DNA, 24 bp, Homo sapiens
cgaccagcaagacggagtctcact

SEQ ID NO: 62 - DNA, 24 bp, Homo sapiens
actgctctccagtttgccagtact

SEQ ID NO: 63 - DNA, 24 bp, Homo sapiens
tactgctctccagtttgccagtac

SEQ ID NO: 64 - DNA, 24 bp, Homo sapiens
ctgctctccagtttgccagtactg

SEQ ID NO: 65 - DNA, 24 bp, Homo sapiens
atcctcagccttcaaataaaccct

SEQ ID NO: 66 - DNA, 24 bp, Homo sapiens
gtggaggtggcagcggcattgtac

SEQ ID NO: 67 - DNA, 24 bp, Homo sapiens
agttaaagcagcaaaatgaacagc

SEQ ID NO: 68 - DNA, 24 bp, Homo sapiens
agtaataaagaaggcagaacaaaa

SEQ ID NO: 69 - DNA, 24 bp, Homo sapiens
gggctttggaagaatggaaagaag

SEQ ID NO: 70 - DNA, 24 bp, Homo sapiens
ttgaaggacagcttgacaaactga

SEQ ID NO: 71 - DNA, 24 bp, Homo sapiens
agatggcacagaaaacagcagagc

SEQ ID NO: 72 - DNA, 24 bp, Homo sapiens
agctggagagttgcagttactgtt

SEQ ID NO: 73 - DNA, 24 bp, Homo sapiens
tgtctcagttcacagaagctggag

SEQ ID NO: 74 - DNA, 24 bp, Homo sapiens
acagggagctgatggcagtacact

SEQ ID NO: 75 - DNA, 25 bp, Homo sapiens
ttcccatatccctggactcttgaga

SEQ ID NO: 76 - DNA, 24 bp, Homo sapiens
gctaaggcacatggaagaccgatt

SEQ ID NO: 77 - DNA, 24 bp, Homo sapiens
cccagtggctacccttacaatgcg

SEQ ID NO: 78 - DNA, 23 bp, Homo sapiens
gttcctcacgccctgctatcacc

SEQ ID NO: 79 - DNA, 24 bp, Homo sapiens
atgtcaggaccattctgctctcca

SEQ ID NO: 80 - DNA, 23 bp, Homo sapiens
ccttgaacacacatgctgccgag

SEQ ID NO: 81 - DNA, 23 bp, Homo sapiens
aagcaggtcaccagccaggagcc

SEQ ID NO: 82 - DNA, 23 bp, Homo sapiens
ccagcctgtccttgtgtcgtctt

SEQ ID NO: 83 - DNA, 24 bp, Homo sapiens
atgaccctcatgatgtctggcgat

SEQ ID NO: 84 - DNA, 24 bp, Homo sapiens
gatgaccctcatgatgtctggcga

SEQ ID NO: 85 - DNA, 24 bp, Homo sapiens
tgaccctcatgatgtctggcgata

SEQ ID NO: 86 - DNA, 25 bp, Homo sapiens
tcaggaccattctgctctccatcca

SEQ ID NO: 87 - DNA, 25 bp, Homo sapiens
cagaagccaataacatgacaggagc

SEQ ID NO: 88 - DNA, 25 bp, Homo sapiens
gcctcctatgatgcagacatggtga

SEQ ID NO: 89 - DNA, 25 bp, Homo sapiens
aggcaggtggttatatgtgggaaga

SEQ ID NO: 90 - DNA, 25 bp, Homo sapiens
caaactgctcaaccacctgctttaa

SEQ ID NO: 91 - DNA, 25 bp, Homo sapiens
gagggagagcagtgtgaaatcagca

SEQ ID NO: 92 - DNA, 25 bp, Homo sapiens
cacaaccctgtcgaaatggaggtaa

SEQ ID NO: 93 - DNA, 25 bp, Homo sapiens
ggaacctgccatgaacccaacaaat

SEQ ID NO: 94 - DNA, 25 bp, Homo sapiens
aagaaggttggcatggaagacactg

SEQ ID NO: 95 - DNA, 23 bp, Homo sapiens
acgaagccagcctcatacatgcc

SEQ ID NO: 96 - DNA, 25 bp, Homo sapiens
tctgattgaccacttctgtgctgga

SEQ ID NO: 97 - DNA, 25 bp, Homo sapiens
ctggagctagttggaatcatctgga

SEQ ID NO: 98 - DNA, 25 bp, Homo sapiens
ggagcaaagaggtggatattctggc

SEQ ID NO: 99 - DNA, 24 bp, Homo sapiens
ctcgccagaagcccttgattccac

SEQ ID NO: 100 - DNA, 24 bp, Homo sapiens
acatggcagcagttactggcaaga

SEQ ID NO: 101 - DNA, 23 bp, Homo sapiens
aaggacgctgccgcctaagagtg

SEQ ID NO: 102 - DNA, 25 bp, Homo sapiens
caggtcgggatggattcaaaggaga

SEQ ID NO: 103 - DNA, 25 bp, Homo sapiens
caagcagtgttcatggagttcattg

SEQ ID NO: 104 - DNA, 25 bp, Homo sapiens
tggaccaaggaagccctgaaatgaa

SEQ ID NO: 105 - DNA, 24 bp, Homo sapiens
tggtaggcgcaggtgtgatgctgc

SEQ ID NO: 106 - DNA, 24 bp, Homo sapiens
ctggtaggcgcaggtgtgatgctg

SEQ ID NO: 107 - DNA, 24 bp, Homo sapiens
ggtaggcgcaggtgtgatgctgct

SEQ ID NO: 108 - DNA, 24 bp, Homo sapiens
gagttgttgcctgggctggacgtg

SEQ ID NO: 109 - DNA, 24 bp, Homo sapiens
gctcttcgcgctctcgtttcattt

SEQ ID NO: 110 - DNA, 24 bp, Homo sapiens
ctactactcggacaagtacttcga

SEQ ID NO: 111 - DNA, 24 bp, Homo sapiens
aaggcctagaagaaaaccatgagc

SEQ ID NO: 112 - DNA, 24 bp, Homo sapiens
caaggcctagaagaaaaccatgag

SEQ ID NO: 113 - DNA, 24 bp, Homo sapiens
aggcctagaagaaaaccatgagct

SEQ ID NO: 114 - DNA, 23 bp, Homo sapiens
aagtgaatgtgcctgaggagtct

SEQ ID NO: 115 - DNA, 25 bp, Homo sapiens
agttgcttgctggaattgttgtgga

SEQ ID NO: 116 - DNA, 25 bp, Homo sapiens
ctcacagaaggagaacttgaagagt

SEQ ID NO: 117 - DNA, 25 bp, Homo sapiens
atggaagtgcctgtcatggtagtaa

SEQ ID NO: 118 - DNA, 25 bp, Homo sapiens
gcgagtgagtaggttaagcacaagt

SEQ ID NO: 119 - DNA, 25 bp, Homo sapiens
cgaagaagtcctgtcacctgaaggc

SEQ ID NO: 120 - DNA, 24 bp, Homo sapiens
caataagctgcagccaggctccgt

SEQ ID NO: 121 - DNA, 24 bp, Homo sapiens
tccgtgaagaagatcaatgagtca

SEQ ID NO: 122 - DNA, 24 bp, Homo sapiens
ctccgtgaagaagatcaatgagtc

SEQ ID NO: 123 - DNA, 24 bp, Homo sapiens
ccgtgaagaagatcaatgagtcaa

SEQ ID NO: 124 - DNA, 25 bp, Homo sapiens
atgagtcaacccaaaattggcacca

SEQ ID NO: 125 - DNA, 24 bp, Homo sapiens
atcggcaacaacttcatggacggc

SEQ ID NO: 126 - DNA, 24 bp, Homo sapiens
gctggagaacatcggcaacttcat

SEQ ID NO: 127 - DNA, 24 bp, Homo sapiens
ttgagaacaccaaccatacacagg

SEQ ID NO: 128 - DNA, 24 bp, Homo sapiens
ggcgaagacgaaaggaaacaaggt

SEQ ID NO: 129 - DNA, 24 bp, Homo sapiens
gagaagggcggaacatcattgggc

SEQ ID NO: 130 - DNA, 24 bp, Homo sapiens
ggaccaagcggcagatcttcgagc

SEQ ID NO: 131 - DNA, 24 bp, Homo sapiens
gcactgcgacacgctcaatgtcag

SEQ ID NO: 132 - DNA, 24 bp, Homo sapiens
gcatgacggtgtatgggctgccac

SEQ ID NO: 133 - DNA, 25 bp, Homo sapiens
catttgtgagcaaacatgcggtaaa

SEQ ID NO: 134 - DNA, 23 bp, Homo sapiens
aaacgcacagcaagtcacccgaa

SEQ ID NO: 135 - DNA, 23 bp, Homo sapiens
tcacagtttgtaacagacgtgga

SEQ ID NO: 136 - DNA, 25 bp, Homo sapiens
ccaaatgaaggacatgacccgcttg

SEQ ID NO: 137 - DNA, 25 bp, Homo sapiens
cagcaaagcaaggtggagcaagaga

SEQ ID NO: 138 - DNA, 23 bp, Homo sapiens
cgtcggctcagaggtctccagaa

SEQ ID NO: 139 - DNA, 23 bp, Homo sapiens
cgggactaggagagcgggacggg

SEQ ID NO: 140 - DNA, 23 bp, Homo sapiens
gagggagcagccagccaagagcc

SEQ ID NO: 141 - DNA, 25 bp, Homo sapiens
atgctgaccatcggtaacggacatt

SEQ ID NO: 142 - DNA, 24 bp, Homo sapiens
agagcatgcagcgtcagggcctac

SEQ ID NO: 143 - DNA, 24 bp, Homo sapiens
gagagcatgcagcgtcagggccta

SEQ ID NO: 144 - DNA, 24 bp, Homo sapiens
gagcatgcagcgtcagggcctact

SEQ ID NO: 145 - DNA, 23 bp, Homo sapiens
gaggctatggggcagcagcagaa

SEQ ID NO: 146 - DNA, 25 bp, Homo sapiens
tgtatgctggcaatggcggactatt

SEQ ID NO: 147 - DNA, 25 bp, Homo sapiens
ggattacaatgagctggctgtgagg

SEQ ID NO: 148 - DNA, 23 bp, Homo sapiens
ggatggcctacactgtccagggc

SEQ ID NO: 149 - DNA, 25 bp, Homo sapiens
gactgcggacctcatggacttcttc

SEQ ID NO: 150 - DNA, 23 bp, Homo sapiens
cggcatcagcaaggtcttctctg

SEQ ID NO: 151 - DNA, 23 bp, Homo sapiens
tgagacagcacagccaacctagc

SEQ ID NO: 152 - DNA, 24 bp, Homo sapiens
cttcctggaggtgacacttgatgg

SEQ ID NO: 153 - DNA, 25 bp, Homo sapiens
tctggttactgttctaaggctgtgc

SEQ ID NO: 154 - DNA, 24 bp, Homo sapiens
gattgtccgtaggcccatactaga

SEQ ID NO: 155 - DNA, 24 bp, Homo sapiens
tgattgtccgtaggcccatactag

SEQ ID NO: 156 - DNA, 24 bp, Homo sapiens
attgtccgtaggcccatactagag

SEQ ID NO: 157 - DNA, 25 bp, Homo sapiens
tgttatactgaaccaggccagagca

SEQ ID NO: 158 - DNA, 25 bp, Homo sapiens
tgagggcaatggacaaggaaggaat

SEQ ID NO: 159 - DNA, 25 bp, Homo sapiens
agaagagggaaaacagaaaacctga

SEQ ID NO: 160 - DNA, 24 bp, Homo sapiens
cccctgggcaaaaaggagagatgg

SEQ ID NO: 161 - DNA, 24 bp, Homo sapiens
acttcttccaaacttatggagcca

SEQ ID NO: 162 - DNA, 24 bp, Homo sapiens
gacttcttccaaacttatggagcc

SEQ ID NO: 163 - DNA, 24 bp, Homo sapiens
cttcttccaaacttatggagccat

SEQ ID NO: 164 - DNA, 24 bp, Homo sapiens
ggaaggaatttgcatcttcttcaa

SEQ ID NO: 165 - DNA, 24 bp, Homo sapiens
cggaaggaatttgcatcttcttca

SEQ ID NO: 166 - DNA, 24 bp, Homo sapiens
gaaggaatttgcatcttcttcaac

SEQ ID NO: 167 - DNA, 24 bp, Homo sapiens
aactcaactggaagcacacgaggc

SEQ ID NO: 168 - DNA, 23 bp, Homo sapiens
gctcactcacctgcctccactct

SEQ ID NO: 169 - DNA, 23 bp, Homo sapiens
gctccagtggcaactcttctccg

SEQ ID NO: 170 - DNA, 24 bp, Homo sapiens
taaccaagaaaaacaaacgagatg

SEQ ID NO: 171 - DNA, 24 bp, Homo sapiens
acctcaaaccaggtggctatggta

SEQ ID NO: 172 - DNA, 24 bp, Homo sapiens
aacctcaaaccaggtggctatggt

SEQ ID NO: 173 - DNA, 24 bp, Homo sapiens
cctcaaaccaggtggctatggtat

SEQ ID NO: 174 - DNA, 24 bp, Homo sapiens
tcactgagagaattgtcactgaaa

SEQ ID NO: 175 - DNA, 24 bp, Homo sapiens
gtcactgagagaattgtcactgaa

SEQ ID NO: 176 - DNA, 24 bp, Homo sapiens
cactgagagaattgtcactgaaac

SEQ ID NO: 177 - DNA, 25 bp, Homo sapiens
ccacaagacttacatccttaccacc

SEQ ID NO: 178 - DNA, 24 bp, Homo sapiens
atgcgtatgaagggagctccagtg

SEQ ID NO: 179 - DNA, 24 bp, Homo sapiens
catgcgtatgaagggagctccagt

SEQ ID NO: 180 - DNA, 24 bp, Homo sapiens
tgcgtatgaagggagctccagtgg

SEQ ID NO: 181 - DNA, 24 bp, Homo sapiens
ggctgatcaaagaaagaaggcata

SEQ ID NO: 182 - DNA, 24 bp, Homo sapiens
tggctgatcaaagaaagaaggcat

SEQ ID NO: 183 - DNA, 24 bp, Homo sapiens
gctgatcaaagaaagaaggcatac

SEQ ID NO: 184 - DNA, 25 bp, Homo sapiens
aaaagatggcttatgaaaatcgtcg

SEQ ID NO: 185 - DNA, 25 bp, Homo sapiens
gcatatcgtaatatcaaggaactgg

SEQ ID NO: 186 - DNA, 25 bp, Homo sapiens
aaggcattgtcacttgcttgagagc

SEQ ID NO: 187 - DNA, 25 bp, Homo sapiens
aaatctggatgacaaagcatatcgt

SEQ ID NO: 188 - DNA, 25 bp, Homo sapiens
tggaaaattatgctgaaaacacaca

SEQ ID NO: 189 - DNA, 24 bp, Homo sapiens
gccgccatgcccaagtgtcccaag

SEQ ID NO: 190 - DNA, 24 bp, Homo sapiens
aaggaggtgtacttcgccgagagg

SEQ ID NO: 191 - DNA, 24 bp, Homo sapiens
tgagcacgaaggcaaaccctactg

SEQ ID NO: 192 - DNA, 24 bp, Homo sapiens
ttggctttggaggtcggtgagctg

SEQ ID NO: 193 - DNA, 24 bp, Homo sapiens
cttggctttggaggtcggtgagct

SEQ ID NO: 194 - DNA, 24 bp, Homo sapiens
tggctttggaggtcggtgagctgg

SEQ ID NO: 195 - DNA, 25 bp, Homo sapiens
aggcatccaagaggtcactgtcaac

SEQ ID NO: 196 - DNA, 24 bp, Homo sapiens
cgaggagcgtgagcagatcaagac

SEQ ID NO: 197 - DNA, 24 bp, Homo sapiens
ttcctggagcagcagaacaaggtt

SEQ ID NO: 198 - DNA, 24 bp, Homo sapiens
ttcatcgacaaggtgcggttcctg

SEQ ID NO: 199 - DNA, 24 bp, Homo sapiens
cttcatcgacaaggtgcggttcct

SEQ ID NO: 200 - DNA, 24 bp, Homo sapiens
tcatcgacaaggtgcggttcctgg

SEQ ID NO: 201 - DNA, 24 bp, Homo sapiens
tatctgcccacagggatgatgtga

SEQ ID NO: 202 - DNA, 24 bp, Homo sapiens
gtatctgcccacagggatgatgtg

SEQ ID NO: 203 - DNA, 24 bp, Homo sapiens
atctgcccacagggatgatgtgaa

SEQ ID NO: 204 - DNA, 24 bp, Homo sapiens
ccaggtggagcatgacgggcagcc

SEQ ID NO: 205 - DNA, 24 bp, Homo sapiens
cagcaaaagccatgacctgaaggt

SEQ ID NO: 206 - DNA, 24 bp, Homo sapiens
agcagggctcaaataccgccgctg

SEQ ID NO: 207 - DNA, 24 bp, Homo sapiens
gacagaagaaagcccagggctcca

SEQ ID NO: 208 - DNA, 24 bp, Homo sapiens
agacagaagaaagcccagggctcc

SEQ ID NO: 209 - DNA, 24 bp, Homo sapiens
acagaagaaagcccagggctccac

SEQ ID NO: 210 - DNA, 24 bp, Homo sapiens
cagccagcggtcagcaaaagccat

SEQ ID NO: 211 - DNA, 24 bp, Homo sapiens
gtctcagcccacccgaaggagcag

SEQ ID NO: 212 - DNA, 24 bp, Homo sapiens
tatattgtggtgggtgtggtgtgc

SEQ ID NO: 213 - DNA, 24 bp, Homo sapiens
tcacatatgcagacctgaacctgc

SEQ ID NO: 214 - DNA, 24 bp, Homo sapiens
atcacatatgcagacctgaacctg

SEQ ID NO: 215 - DNA, 24 bp, Homo sapiens
cacatatgcagacctgaacctgcc

SEQ ID NO: 216 - DNA, 24 bp, Homo sapiens
ttcttctacaaggttgcatgagcc

SEQ ID NO: 217 - DNA, 24 bp, Homo sapiens
cttcttctacaaggttgcatgagc

SEQ ID NO: 218 - DNA, 24 bp, Homo sapiens
tcttctacaaggttgcatgagccc

SEQ ID NO: 219 - DNA, 24 bp, Homo sapiens
gcctcaaccgttacagagaacaag

SEQ ID NO: 220 - DNA, 24 bp, Homo sapiens
gctggctcctggtgaatgtatctg

SEQ ID NO: 221 - DNA, 24 bp, Homo sapiens
ataccgccgctgagaacactggat

SEQ ID NO: 222 - DNA, 24 bp, Homo sapiens
gctccacttcttctacaaggttgc

SEQ ID NO: 223 - DNA, 24 bp, Homo sapiens
ccaacaaccacacggagtatgcca

SEQ ID NO: 224 - DNA, 24 bp, Homo sapiens
cctcacctatgctgacctggacat

SEQ ID NO: 225 - DNA, 24 bp, Homo sapiens
caggtcagccactccctggagaca

SEQ ID NO: 226 - DNA, 24 bp, Homo sapiens
tcaggtcagccactccctggagac

SEQ ID NO: 227 - DNA, 24 bp, Homo sapiens
aggtcagccactccctggagacac

SEQ ID NO: 228 - DNA, 24 bp, Homo sapiens
gggactgacttggccatgttctca

SEQ ID NO: 229 - DNA, 24 bp, Homo sapiens
ctgtggtaagtccagcctgcccag

SEQ ID NO: 230 - DNA, 24 bp, Homo sapiens
tgagggctgcctcttgacagtgca

SEQ ID NO: 231 - DNA, 24 bp, Homo sapiens
tctctgtcaacctggatgtgaagc

SEQ ID NO: 232 - DNA, 24 bp, Homo sapiens
tctccccagaggaactcaaagtta

SEQ ID NO: 233 - DNA, 24 bp, Homo sapiens
tgttgggagatgtgattgaggtgc

SEQ ID NO: 234 - DNA, 24 bp, Homo sapiens
ggactctcagagatgcgcctggag

SEQ ID NO: 235 - DNA, 24 bp, Homo sapiens
tggactctcagagatgcgcctgga

SEQ ID NO: 236 - DNA, 24 bp, Homo sapiens
gactctcagagatgcgcctggaga

SEQ ID NO: 237 - DNA, 24 bp, Homo sapiens
gaagagcgccaggatgaacatggt

SEQ ID NO: 238 - DNA, 24 bp, Homo sapiens
tgaagagcgccaggatgaacatgg

SEQ ID NO: 239 - DNA, 24 bp, Homo sapiens
aagagcgccaggatgaacatggtt

SEQ ID NO: 240 - DNA, 24 bp, Homo sapiens
ttccacaggaaataccggatccca

SEQ ID NO: 241 - DNA, 24 bp, Homo sapiens
gtagaccctctcaccattacttca

SEQ ID NO: 242 - DNA, 24 bp, Homo sapiens
tcatctgatggggtcctcactgtg

SEQ ID NO: 243 - DNA, 24 bp, Homo sapiens
cttcggagagcacctgttggagtc

SEQ ID NO: 244 - DNA, 24 bp, Homo sapiens
ccctgagtcccttctaccttcggc

SEQ ID NO: 245 - DNA, 24 bp, Homo sapiens
tgacactggactctcagagatgcg

SEQ ID NO: 246 - DNA, 24 bp, Homo sapiens
actgggtatgtgtcacattgccaa

SEQ ID NO: 247 - DNA, 24 bp, Homo sapiens
agtctccatgaactgctggtgagc

SEQ ID NO: 248 - DNA, 24 bp, Homo sapiens
ccctgacatcaccattccagaagc

SEQ ID NO: 249 - DNA, 24 bp, Homo sapiens
ctctgtcaacctggatgtgaagca

SEQ ID NO: 250 - DNA, 24 bp, Homo sapiens
accctctcaccattacttcatccc

SEQ ID NO: 251 - DNA, 24 bp, Homo sapiens
cagggagttccacaggaaataccg

SEQ ID NO: 252 - DNA, 24 bp, Homo sapiens
gctgatgtagaccctctcaccatt

SEQ ID NO: 253 - DNA, 24 bp, Homo sapiens
cctgtcatctgatggggtcctcac

SEQ ID NO: 254 - DNA, 24 bp, Homo sapiens
cacattgccaaatcccggatcaca

SEQ ID NO: 255 - DNA, 24 bp, Homo sapiens
catgaactgctggtgagctaggat

SEQ ID NO: 256 - DNA, 24 bp, Homo sapiens
cctcactgtgaatggaccaaggaa

SEQ ID NO: 257 - DNA, 24 bp, Homo sapiens
tgaagagaagcctgctgtcaccgc

SEQ ID NO: 258 - DNA, 24 bp, Homo sapiens
gtaccacttctcctgcttctggaa

SEQ ID NO: 259 - DNA, 24 bp, Homo sapiens
ttgaggtggatgggttctctgagc

SEQ ID NO: 260 - DNA, 24 bp, Homo sapiens
caggatggaattggtagcaaggca

SEQ ID NO: 261 - DNA, 24 bp, Homo sapiens
ggaggatggcggagtcttcggata

SEQ ID NO: 262 - DNA, 24 bp, Homo sapiens
agcagaaagtcaagaagacagcgg

SEQ ID NO: 263 - DNA, 23 bp, Homo sapiens
caaggatcacagtgcagatgcca

SEQ ID NO: 264 - DNA, 23 bp, Homo sapiens
gagaggagaacggctgtgagtgc

SEQ ID NO: 265 - DNA, 25 bp, Homo sapiens
atcgcctgtcggatcatctatcggt

SEQ ID NO: 266 - DNA, 25 bp, Homo sapiens
cttcctcacccgccacttcatcttc

SEQ ID NO: 267 - DNA, 24 bp, Homo sapiens
gccactactaccactactcagacc

SEQ ID NO: 268 - DNA, 24 bp, Homo sapiens
cctccttcatccagacagcaggtc

SEQ ID NO: 269 - DNA, 25 bp, Homo sapiens
ttaaggagtcacagtgccatcacat

SEQ ID NO: 270 - DNA, 25 bp, Homo sapiens
acatctccacaatggtgcaaggatc

SEQ ID NO: 271 - DNA, 25 bp, Homo sapiens
ccagagttcatcacaaggtcctaca

SEQ ID NO: 272 - DNA, 23 bp, Homo sapiens
cgtccaggtgatctgccacacag

SEQ ID NO: 273 - DNA, 24 bp, Homo sapiens
agcagtaccttcaccacaacctcg

SEQ ID NO: 274 - DNA, 24 bp, Homo sapiens
tgccacccagaggatgttctaccg

SEQ ID NO: 275 - DNA, 25 bp, Homo sapiens
tccaggaaatccaactcaaagaagc

SEQ ID NO: 276 - DNA, 25 bp, Homo sapiens
tgaagaggtggcttgtaagttggtg

SEQ ID NO: 277 - DNA, 23 bp, Homo sapiens
ggatgcacagaggaacgagctga

SEQ ID NO: 278 - DNA, 25 bp, Homo sapiens
ccaggactaccattgacctcagagc

SEQ ID NO: 279 - DNA, 24 bp, Homo sapiens
aaattgatcccaccaggtcccacg

SEQ ID NO: 280 - DNA, 25 bp, Homo sapiens
gttagcttctccatcctcaccacat

SEQ ID NO: 281 - DNA, 24 bp, Homo sapiens
ttcggtgtgaaggtgggatgcagg

SEQ ID NO: 282 - DNA, 24 bp, Homo sapiens
tttcggtgtgaaggtgggatgcag

SEQ ID NO: 283 - DNA, 24 bp, Homo sapiens
tcggtgtgaaggtgggatgcaggc

SEQ ID NO: 284 - DNA, 24 bp, Homo sapiens
ctgcattctcaggttgctggcaga

SEQ ID NO: 285 - DNA, 24 bp, Homo sapiens
cctgcattctcaggttgctggcag

SEQ ID NO: 286 - DNA, 24 bp, Homo sapiens
tgcattctcaggttgctggcagac

SEQ ID NO: 287 - DNA, 25 bp, Homo sapiens
gcccagatgtggaaagtggtgaatc

SEQ ID NO: 288 - DNA, 24 bp, Homo sapiens
acggaggagatcgagtggctgaag

SEQ ID NO: 289 - DNA, 25 bp, Homo sapiens
tcccattcagcaccttccagtttct

SEQ ID NO: 290 - DNA, 25 bp, Homo sapiens
gaatgactttacccaaaaccccagg

SEQ ID NO: 291 - DNA, 25 bp, Homo sapiens
tggagtaacagcacaattttggcaa

SEQ ID NO: 292 - DNA, 25 bp, Homo sapiens
acagaggtgattgtacttcagaatg

SEQ ID NO: 293 - DNA, 25 bp, Homo sapiens
atattgccgaagtggatggggagat

SEQ ID NO: 294 - DNA, 23 bp, Homo sapiens
atcacatgtcagcaggatgctaa

SEQ ID NO: 295 - DNA, 24 bp, Homo sapiens
gaaatgagaggttccgaggatgcg

SEQ ID NO: 296 - DNA, 25 bp, Homo sapiens
gctgatccaggaacaactgcggtat

SEQ ID NO: 297 - DNA, 24 bp, Homo sapiens
aaccgagaacatgaacttgctggc

SEQ ID NO: 298 - DNA, 24 bp, Homo sapiens
aaccacgaagaggagatgaaggct

SEQ ID NO: 299 - DNA, 24 bp, Homo sapiens
gaaccacgaagaggagatgaaggc

SEQ ID NO: 300 - DNA, 24 bp, Homo sapiens
accacgaagaggagatgaaggctc

SEQ ID NO: 301 - DNA, 23 bp, Homo sapiens
ccagactccccagtgctctatag

SEQ ID NO: 302 - DNA, 23 bp, Homo sapiens
gagtgaagcagctctggtgagaa

SEQ ID NO: 303 - DNA, 24 bp, Homo sapiens
tgaagcctctgatgatggacagaa

SEQ ID NO: 304 - DNA, 24 bp, Homo sapiens
caggggaaggtgggcgcaggtgag

SEQ ID NO: 305 - DNA, 25 bp, Homo sapiens
ggcagagcgatggagtccttagtat

SEQ ID NO: 306 - DNA, 25 bp, Homo sapiens
tgacagatgaagaaggagcagaata

SEQ ID NO: 307 - DNA, 25 bp, Homo sapiens
ttacaactcctgattcccgcatggt

SEQ ID NO: 308 - DNA, 25 bp, Homo sapiens
actctgatcaacttctggccagtag

SEQ ID NO: 309 - DNA, 24 bp, Homo sapiens
ggaagaaaacaggaatctgcaagc

SEQ ID NO: 310 - DNA, 24 bp, Homo sapiens
aggaagaaaacaggaatctgcaag

SEQ ID NO: 311 - DNA, 24 bp, Homo sapiens
gaagaaaacaggaatctgcaagca

SEQ ID NO: 312 - DNA, 25 bp, Homo sapiens
gagtcctgtctcagattgatgttgc

SEQ ID NO: 313 - DNA, 25 bp, Homo sapiens
tgagtgaagtgaagtctgaagtgga

SEQ ID NO: 314 - DNA, 25 bp, Homo sapiens
aatgtcttgacagaatggctggcag

SEQ ID NO: 315 - DNA, 24 bp, Homo sapiens
tgtagatggacagaagaccgctgg

SEQ ID NO: 316 - DNA, 25 bp, Homo sapiens
aagacatccttctcaaatggcaacg

SEQ ID NO: 317 - DNA, 24 bp, Homo sapiens
cagtgacccagaagacggaagcat

SEQ ID NO: 318 - DNA, 25 bp, Homo sapiens
aacaccctccttcactcccaaatgc

SEQ ID NO: 319 - DNA, 25 bp, Homo sapiens
tgatgtccagttgccactttcccac

SEQ ID NO: 320 - DNA, 25 bp, Homo sapiens
acagccactaattgccttacaagcc

SEQ ID NO: 321 - DNA, 24 bp, Homo sapiens
caacatggaaacgtgagtagtagc

SEQ ID NO: 322 - DNA, 24 bp, Homo sapiens
acaacatggaaacgtgagtagtag

SEQ ID NO: 323 - DNA, 24 bp, Homo sapiens
aacatggaaacgtgagtagtagca

SEQ ID NO: 324 - DNA, 24 bp, Homo sapiens
actgaaagagttgaatgactggct

SEQ ID NO: 325 - DNA, 25 bp, Homo sapiens
aacagaagaaagaacaaggaaaatg

SEQ ID NO: 326 - DNA, 25 bp, Homo sapiens
gagcctcttggacctgatcttgaag

SEQ ID NO: 327 - DNA, 25 bp, Homo sapiens
gagcccatttccttcacagcatttg

SEQ ID NO: 328 - DNA, 25 bp, Homo sapiens
ttggcagttcattgatggagagtga

SEQ ID NO: 329 - DNA, 25 bp, Homo sapiens
atcgtggcttctttctgctgaggac

SEQ ID NO: 330 - DNA, 25 bp, Homo sapiens
ctctcactcacatggtggtggtagt

SEQ ID NO: 331 - DNA, 25 bp, Homo sapiens
tctagtggagatcacgcaactgctg

SEQ ID NO: 332 - DNA, 23 bp, Homo sapiens
gtagctagcatggaaaaacaaag

SEQ ID NO: 333 - DNA, 24 bp, Homo sapiens
gaatgcctcagggtagctagcatg

SEQ ID NO: 334 - DNA, 24 bp, Homo sapiens
ggaatgcctcagggtagctagcat

SEQ ID NO: 335 - DNA, 24 bp, Homo sapiens
aatgcctcagggtagctagcatgg

SEQ ID NO: 336 - DNA, 25 bp, Homo sapiens
acaagacatccttctcaaatggcaa

SEQ ID NO: 337 - DNA, 25 bp, Homo sapiens
tgtcaccaccactcagccatcacta

SEQ ID NO: 338 - DNA, 25 bp, Homo sapiens
aacagtaactacggtgaccacaagg

SEQ ID NO: 339 - DNA, 25 bp, Homo sapiens
tcagattcgcatattggcacagacc

SEQ ID NO: 340 - DNA, 23 bp, Homo sapiens
atgaagaggctgtaaggaggcaa

SEQ ID NO: 341 - DNA, 25 bp, Homo sapiens
cattcattgacaagcagttggcagc

SEQ ID NO: 342 - DNA, 24 bp, Homo sapiens
caggaagcccagaaaatccaatct

SEQ ID NO: 343 - DNA, 24 bp, Homo sapiens
tcaggaagcccagaaaatccaatc

SEQ ID NO: 344 - DNA, 24 bp, Homo sapiens
aggaagcccagaaaatccaatctg

SEQ ID NO: 345 - DNA, 25 bp, Homo sapiens
gcacgaatggatgacacaagctgaa

SEQ ID NO: 346 - DNA, 23 bp, Homo sapiens
gctccacctgtagcacaagaggc

SEQ ID NO: 347 - DNA, 23 bp, Homo sapiens
tggctctgcactaggctgaatgg

SEQ ID NO: 348 - DNA, 25 bp, Homo sapiens
gaacaggaagtagtacagtcacagc

SEQ ID NO: 349 - DNA, 25 bp, Homo sapiens
gtggtatcagtacaagaggcaggct

SEQ ID NO: 350 - DNA, 25 bp, Homo sapiens
ctcctgaaatgcttggatgacattg

SEQ ID NO: 351 - DNA, 25 bp, Homo sapiens
aagcagcaaacttgatggcaaaccg

SEQ ID NO: 352 - DNA, 25 bp, Homo sapiens
aattgcttgaaccactggaggctga

SEQ ID NO: 353 - DNA, 25 bp, Homo sapiens
cacagatgagagaaagcgagaggaa

SEQ ID NO: 354 - DNA, 23 bp, Homo sapiens
gctgagggcttgtctgaggatgg

SEQ ID NO: 355 - DNA, 24 bp, Homo sapiens
gccaactcagatccagctcagcaa

SEQ ID NO: 356 - DNA, 25 bp, Homo sapiens
acgatgatggtgatgactgaagaca

SEQ ID NO: 357 - DNA, 25 bp, Homo sapiens
ggacgacttcttactcatgttagcc

SEQ ID NO: 358 - DNA, 25 bp, Homo sapiens
catcagagcatcttcacacatcagt

SEQ ID NO: 359 - DNA, 25 bp, Homo sapiens
tgcttcattctctgttgagttcctc

SEQ ID NO: 360 - DNA, 25 bp, Homo sapiens
agtggtatcagtacaagaggcaggc

SEQ ID NO: 361 - DNA, 24 bp, Homo sapiens
aattagccagcctacctgagccca

SEQ ID NO: 362 - DNA, 24 bp, Homo sapiens
agcattgaagccatccaggaagtg

SEQ ID NO: 363 - DNA, 23 bp, Homo sapiens
ggctgcttatgtcaccacctctg

SEQ ID NO: 364 - DNA, 24 bp, Homo sapiens
ctccactggcaggtcaaaaatgta

SEQ ID NO: 365 - DNA, 24 bp, Homo sapiens
cctccactggcaggtcaaaaatgt

SEQ ID NO: 366 - DNA, 24 bp, Homo sapiens
tccactggcaggtcaaaaatgtaa

SEQ ID NO: 367 - DNA, 25 bp, Homo sapiens
acctcttcagtgacctacaggatgg

SEQ ID NO: 368 - DNA, 25 bp, Homo sapiens
gaacaatgtcaacaaggcactgcgg

SEQ ID NO: 369 - DNA, 25 bp, Homo sapiens
actgactcttggtttgatttggaat

SEQ ID NO: 370 - DNA, 24 bp, Homo sapiens
tgaagaacagtgcctttttagtgc

SEQ ID NO: 371 - DNA, 25 bp, Homo sapiens
cagatcacggtcagtctagcacagg

SEQ ID NO: 372 - DNA, 25 bp, Homo sapiens
ggttaatgtaatcaacttcaccacc

SEQ ID NO: 373 - DNA, 23 bp, Homo sapiens
tctgatggcctggctttgaatgc

SEQ ID NO: 374 - DNA, 25 bp, Homo sapiens
ggaatataatcctccactggcaggt

SEQ ID NO: 375 - DNA, 24 bp, Homo sapiens
aatgtaatcaacttcaccaccagc

SEQ ID NO: 376 - DNA, 25 bp, Homo sapiens
ggaagtactgacatcgtagatggaa

SEQ ID NO: 377 - DNA, 25 bp, Homo sapiens
ccaaaagaaaaaggatccacaagag

SEQ ID NO: 378 - DNA, 23 bp, Homo sapiens
cctcctagacctcctcgaaggcc

SEQ ID NO: 379 - DNA, 24 bp, Homo sapiens
ggctttagacctccaccatccaaa

SEQ ID NO: 380 - DNA, 23 bp, Homo sapiens
gactcgccctcgctccatctacc

SEQ ID NO: 381 - DNA, 24 bp, Homo sapiens
ggaggcttctgtcattgctcacac

SEQ ID NO: 382 - DNA, 24 bp, Homo sapiens
cccatcttcaaggtgtttgatgcg

SEQ ID NO: 383 - DNA, 24 bp, Homo sapiens
ccccatcttcaaggtgtttgatgc

SEQ ID NO: 384 - DNA, 24 bp, Homo sapiens
ccatcttcaaggtgtttgatgcga

SEQ ID NO: 385 - DNA, 24 bp, Homo sapiens
aggagcaaatgatgaccgccaagg

SEQ ID NO: 386 - DNA, 24 bp, Homo sapiens
accatctttcccaatgccgaactg

SEQ ID NO: 387 - DNA, 24 bp, Homo sapiens
ccctttgaccagatgaacggagtg

SEQ ID NO: 388 - DNA, 24 bp, Homo sapiens
ctgacactccaggtagcgagggag

SEQ ID NO: 389 - DNA, 24 bp, Homo sapiens
tctgacactccaggtagcgaggga

SEQ ID NO: 390 - DNA, 24 bp, Homo sapiens
tgacactccaggtagcgagggagt

SEQ ID NO: 391 - DNA, 24 bp, Homo sapiens
gtctacctccagacatccttgaaa

SEQ ID NO: 392 - DNA, 24 bp, Homo sapiens
tgtctacctccagacatccttgaa

SEQ ID NO: 393 - DNA, 24 bp, Homo sapiens
tctacctccagacatccttgaaat

SEQ ID NO: 394 - DNA, 24 bp, Homo sapiens
aggaagagttcccctttgctttag

SEQ ID NO: 395 - DNA, 24 bp, Homo sapiens
aaggaagagttcccctttgcttta

SEQ ID NO: 396 - DNA, 24 bp, Homo sapiens
ggaagagttcccctttgctttagg

SEQ ID NO: 397 - DNA, 24 bp, Homo sapiens
acaggagaaggatgtgtctacctc

SEQ ID NO: 398 - DNA, 24 bp, Homo sapiens
aattgctgagtacaatgctccttg

SEQ ID NO: 399 - DNA, 24 bp, Homo sapiens
actacgagacggatgagtttgcaa

SEQ ID NO: 400 - DNA, 24 bp, Homo sapiens
tactacgagacggatgagtttgca

SEQ ID NO: 401 - DNA, 24 bp, Homo sapiens
ctacgagacggatgagtttgcaat

SEQ ID NO: 402 - DNA, 24 bp, Homo sapiens
cttgcagcaaagatcttggaaatg

SEQ ID NO: 403 - DNA, 24 bp, Homo sapiens
ccttgcagcaaagatcttggaaat

SEQ ID NO: 404 - DNA, 24 bp, Homo sapiens
ttgcagcaaagatcttggaaatgc

SEQ ID NO: 405 - DNA, 24 bp, Homo sapiens
cggacagaagtcagcagcaaccat

SEQ ID NO: 406 - DNA, 24 bp, Homo sapiens
tgagcttgttcttcacggttctgc

SEQ ID NO: 407 - DNA, 24 bp, Homo sapiens
tgaaaccagccatagtgaaagtct

SEQ ID NO: 408 - DNA, 23 bp, Homo sapiens
tgcttgaagaccacaaggctgaa

SEQ ID NO: 409 - DNA, 24 bp, Homo sapiens
atgagtttgcaattgctgagtaca

SEQ ID NO: 410 - DNA, 24 bp, Homo sapiens
tttgtccatcaggtggtgaggttt

SEQ ID NO: 411 - DNA, 24 bp, Homo sapiens
ctttgtccatcaggtggtgaggtt

SEQ ID NO: 412 - DNA, 24 bp, Homo sapiens
ttgtccatcaggtggtgaggtttc

SEQ ID NO: 413 - DNA, 24 bp, Homo sapiens
atccctgaaactgccaccaaatgt

SEQ ID NO: 414 - DNA, 24 bp, Homo sapiens
tgtggagagcagaatatggtcctc

SEQ ID NO: 415 - DNA, 24 bp, Homo sapiens
ttggctatctcaacactggttacc

SEQ ID NO: 416 - DNA, 24 bp, Homo sapiens
tcctgtcgctcggttgctcatcta

SEQ ID NO: 417 - DNA, 24 bp, Homo sapiens
cacaaagtctcccagcctcacacg

SEQ ID NO: 418 - DNA, 24 bp, Homo sapiens
tgtggaccaaagcgtgctgctcat

SEQ ID NO: 419 - DNA, 24 bp, Homo sapiens
agcaggaagacatgaagggccatt

SEQ ID NO: 420 - DNA, 24 bp, Homo sapiens
aagcaggaagacatgaagggccat

SEQ ID NO: 421 - DNA, 24 bp, Homo sapiens
gcaggaagacatgaagggccattt

SEQ ID NO: 422 - DNA, 24 bp, Homo sapiens
tcggcgtcctcggtttacaacctg

SEQ ID NO: 423 - DNA, 24 bp, Homo sapiens
ctcggcgtcctcggtttacaacct

SEQ ID NO: 424 - DNA, 24 bp, Homo sapiens
cggcgtcctcggtttacaacctgc

SEQ ID NO: 425 - DNA, 24 bp, Homo sapiens
tttgtccaccttgagcccatgtct

SEQ ID NO: 426 - DNA, 24 bp, Homo sapiens
ccatactcagacagtccaggcaca

SEQ ID NO: 427 - DNA, 24 bp, Homo sapiens
atctgataatggcaaagggaggca

SEQ ID NO: 428 - DNA, 25 bp, Homo sapiens
ttgaatgaccaggacgatgaagact

SEQ ID NO: 429 - DNA, 24 bp, Homo sapiens
aagtgcttccttggagtctgtcag

SEQ ID NO: 430 - DNA, 24 bp, Homo sapiens
tcactgacctggaggcggagaatg

SEQ ID NO: 431 - DNA, 24 bp, Homo sapiens
aatcgcatcgcacaatggcagagt

SEQ ID NO: 432 - DNA, 24 bp, Homo sapiens
tggaggaatttgttcttcccaagt

SEQ ID NO: 433 - DNA, 24 bp, Homo sapiens
gtggaggaatttgttcttcccaag

SEQ ID NO: 434 - DNA, 24 bp, Homo sapiens
ggaggaatttgttcttcccaagtt

SEQ ID NO: 435 - DNA, 24 bp, Homo sapiens
gagatgaatgtatcagtgtgtggc

SEQ ID NO: 436 - DNA, 24 bp, Homo sapiens
gtatagtgacgcttccgactgcca

SEQ ID NO: 437 - DNA, 24 bp, Homo sapiens
gctgaagaggaaggagtatgaaat

SEQ ID NO: 438 - DNA, 24 bp, Homo sapiens
tccacactgagaccactgagaagg

SEQ ID NO: 439 - DNA, 24 bp, Homo sapiens
gttctcctccagctccttctttct

SEQ ID NO: 440 - DNA, 24 bp, Homo sapiens
tgttctcctccagctccttctttc

SEQ ID NO: 441 - DNA, 24 bp, Homo sapiens
ttctcctccagctccttctttctg

SEQ ID NO: 442 - DNA, 24 bp, Homo sapiens
gtcgccttcgctgtcccaaagtct

SEQ ID NO: 443 - DNA, 24 bp, Homo sapiens
tgtcgccttcgctgtcccaaagtc

SEQ ID NO: 444 - DNA, 24 bp, Homo sapiens
tcgccttcgctgtcccaaagtctt

SEQ ID NO: 445 - DNA, 24 bp, Homo sapiens
atgatgagcagtttgtaccagact

SEQ ID NO: 446 - DNA, 24 bp, Homo sapiens
cagcaagtgccttacatggtcacc

SEQ ID NO: 447 - DNA, 24 bp, Homo sapiens
acagagatctggctcatgattcag

SEQ ID NO: 448 - DNA, 24 bp, Homo sapiens
atggtcaccaatagtcagcgtggg

SEQ ID NO: 449 - DNA, 24 bp, Homo sapiens
catggtcaccaatagtcagcgtgg

SEQ ID NO: 450 - DNA, 24 bp, Homo sapiens
tggtcaccaatagtcagcgtggga

SEQ ID NO: 451 - DNA, 24 bp, Homo sapiens
gcagtttgtaccagactatcaggc

SEQ ID NO: 452 - DNA, 24 bp, Homo sapiens
aactcatacaccgaaacctgaccg

SEQ ID NO: 453 - DNA, 24 bp, Homo sapiens
cgaagagcagcagcatggatggat

SEQ ID NO: 454 - DNA, 24 bp, Homo sapiens
acgagaaaccaacaaatgtcagga

SEQ ID NO: 455 - DNA, 24 bp, Homo sapiens
tcaattacaggaaacatggcttgc

SEQ ID NO: 456 - DNA, 24 bp, Homo sapiens
agtcaacttcaagaggcttggtta

SEQ ID NO: 457 - DNA, 24 bp, Homo sapiens
cagtcaacttcaagaggcttggtt

SEQ ID NO: 458 - DNA, 24 bp, Homo sapiens
gtcaacttcaagaggcttggttag

SEQ ID NO: 459 - DNA, 24 bp, Homo sapiens
tcaattccaatttgttgccatcct

SEQ ID NO: 460 - DNA, 24 bp, Homo sapiens
agtcctgggtctctgtcatcattt

SEQ ID NO: 461 - DNA, 24 bp, Homo sapiens
gatctggctcacgattctgaagag

SEQ ID NO: 462 - DNA, 24 bp, Homo sapiens
ggatctcagtcaacttcaagaggc

SEQ ID NO: 463 - DNA, 24 bp, Homo sapiens
gctgaagcacaagttcctgatgat

SEQ ID NO: 464 - DNA, 24 bp, Homo sapiens
ccgatgcgtgccagggtgattccg

SEQ ID NO: 465 - DNA, 24 bp, Homo sapiens
aacaagccaggcgtctacaccgat

SEQ ID NO: 466 - DNA, 24 bp, Homo sapiens
tccttggtgattccgcagtgagag

SEQ ID NO: 467 - DNA, 24 bp, Homo sapiens
acctgtcctggaagtcctacctgg

SEQ ID NO: 468 - DNA, 24 bp, Homo sapiens
gcaggacaacagaggatggacagt

SEQ ID NO: 469 - DNA, 24 bp, Homo sapiens
agcacctcctactccatcaacaca

SEQ ID NO: 470 - DNA, 24 bp, Homo sapiens
aagccaccaccagaagagaatgga

SEQ ID NO: 471 - DNA, 24 bp, Homo sapiens
gaagccaccaccagaagagaatgg

SEQ ID NO: 472 - DNA, 24 bp, Homo sapiens
agccaccaccagaagagaatggag

SEQ ID NO: 473 - DNA, 24 bp, Homo sapiens
cccgaggtgaaggtgggtgtctct

SEQ ID NO: 474 - DNA, 24 bp, Homo sapiens
ccccgaggtgaaggtgggtgtctc

SEQ ID NO: 475 - DNA, 24 bp, Homo sapiens
ccgaggtgaaggtgggtgtctctg

SEQ ID NO: 476 - DNA, 25 bp, Homo sapiens
aaacttgctctggctggaatagggc

SEQ ID NO: 477 - DNA, 24 bp, Homo sapiens
acttccacttccgcacagatgagc

SEQ ID NO: 478 - DNA, 25 bp, Homo sapiens
ccttcatctcctgcccgagtgacta

SEQ ID NO: 479 - DNA, 24 bp, Homo sapiens
tgaaaccacccaccgagcctattg

SEQ ID NO: 480 - DNA, 25 bp, Homo sapiens
tccaggagcgagaatcaaagaagaa

SEQ ID NO: 481 - DNA, 25 bp, Homo sapiens
atttcattccagaccttgccctact

SEQ ID NO: 482 - DNA, 24 bp, Homo sapiens
cggagagaactggtgcataaggca

SEQ ID NO: 483 - DNA, 24 bp, Homo sapiens
acggagagaactggtgcataaggc

SEQ ID NO: 484 - DNA, 24 bp, Homo sapiens
ggagagaactggtgcataaggcaa

SEQ ID NO: 485 - DNA, 24 bp, Homo sapiens
acgcaagtaccagggtctggagat

SEQ ID NO: 486 - DNA, 24 bp, Homo sapiens
agcctctgactgtgcctgtatctc

SEQ ID NO: 487 - DNA, 23 bp, Homo sapiens
tctccactcgattccactgctaa

SEQ ID NO: 488 - DNA, 24 bp, Homo sapiens
attcatggtttgaggagaaggcca

SEQ ID NO: 489 - DNA, 24 bp, Homo sapiens
gattcatggtttgaggagaaggcc

SEQ ID NO: 490 - DNA, 24 bp, Homo sapiens
ttcatggtttgaggagaaggccaa

SEQ ID NO: 491 - DNA, 24 bp, Homo sapiens
ccccctccacaggatatagaagac

SEQ ID NO: 492 - DNA, 24 bp, Homo sapiens
gccccctccacaggatatagaaga

SEQ ID NO: 493 - DNA, 24 bp, Homo sapiens
cccctccacaggatatagaagact

SEQ ID NO: 494 - DNA, 24 bp, Homo sapiens
tagtgggaaaaagttggaggatga

SEQ ID NO: 495 - DNA, 24 bp, Homo sapiens
ttagtgggaaaaagttggaggatg

SEQ ID NO: 496 - DNA, 24 bp, Homo sapiens
agtgggaaaaagttggaggatgaa

SEQ ID NO: 497 - DNA, 25 bp, Homo sapiens
agaagacttagatcactacgagatg

SEQ ID NO: 498 - DNA, 24 bp, Homo sapiens
gcatttaactgcaaactgttgtcg

SEQ ID NO: 499 - DNA, 24 bp, Homo sapiens
agcatttaactgcaaactgttgtc

SEQ ID NO: 500 - DNA, 24 bp, Homo sapiens
catttaactgcaaactgttgtcgt

SEQ ID NO: 501 - DNA, 25 bp, Homo sapiens
aagtgcattaattccttccacgacc

SEQ ID NO: 502 - DNA, 23 bp, Homo sapiens
ggtctgagcatcctatctccagg

SEQ ID NO: 503 - DNA, 23 bp, Homo sapiens
agctgccacctcgtcctgtgcaa

SEQ ID NO: 504 - DNA, 25 bp, Homo sapiens
tgatgagatgtgtatagcaaggtct

SEQ ID NO: 505 - DNA, 25 bp, Homo sapiens
ttgccactgtcctcaggaatcttga

SEQ ID NO: 506 - DNA, 25 bp, Homo sapiens
acggatgattgagaatgccagcgag

SEQ ID NO: 507 - DNA, 24 bp, Homo sapiens
gacctacctaagaatgcttccagg

SEQ ID NO: 508 - DNA, 24 bp, Homo sapiens
agacctacctaagaatgcttccag

SEQ ID NO: 509 - DNA, 24 bp, Homo sapiens
acctacctaagaatgcttccagga

SEQ ID NO: 510 - DNA, 24 bp, Homo sapiens
cgggtctctgaaatccacagcctt

SEQ ID NO: 511 - DNA, 24 bp, Homo sapiens
tcgggtctctgaaatccacagcct

SEQ ID NO: 512 - DNA, 24 bp, Homo sapiens
gggtctctgaaatccacagccttg

SEQ ID NO: 513 - DNA, 24 bp, Homo sapiens
aagcaagacaaacagcaaacaggc

SEQ ID NO: 514 - DNA, 24 bp, Homo sapiens
gaagcaagacaaacagcaaacagg

SEQ ID NO: 515 - DNA, 24 bp, Homo sapiens
agcaagacaaacagcaaacaggca

SEQ ID NO: 516 - DNA, 25 bp, Homo sapiens
atcaataatggtgtcttctggttgc

SEQ ID NO: 517 - DNA, 25 bp, Homo sapiens
atacagaaggtttcagcagagcagc

SEQ ID NO: 518 - DNA, 23 bp, Homo sapiens
ggctggtgaggcgagaattatcc

SEQ ID NO: 519 - DNA, 25 bp, Homo sapiens
agattgatggagcagttggtggaca

SEQ ID NO: 520 - DNA, 25 bp, Homo sapiens
agtggacaaccttctgagacctgaa

SEQ ID NO: 521 - DNA, 25 bp, Homo sapiens
attgtcctggaagttgccgtactca

SEQ ID NO: 522 - DNA, 24 bp, Homo sapiens
cgctaactatggtcggacggatga

SEQ ID NO: 523 - DNA, 25 bp, Homo sapiens
agatggagaatacagactgctacct

SEQ ID NO: 524 - DNA, 23 bp, Homo sapiens
gccctggactccctatcgtaccg

SEQ ID NO: 525 - DNA, 25 bp, Homo sapiens
tgtggtgtatgatggtgctgtcttc

SEQ ID NO: 526 - DNA, 25 bp, Homo sapiens
ggactagaattaagagtggcgaggc

SEQ ID NO: 527 - DNA, 23 bp, Homo sapiens
ctctgggcatcaaaggagcaggc

SEQ ID NO: 528 - DNA, 25 bp, Homo sapiens
tccaactgtccgcaaataccgtcaa

SEQ ID NO: 529 - DNA, 25 bp, Homo sapiens
tgttgctggttacttgtttcctgcc

SEQ ID NO: 530 - DNA, 25 bp, Homo sapiens
gcttgctggcttcatgttgataact

SEQ ID NO: 531 - DNA, 25 bp, Homo sapiens
gcttcattggacctgttaccttcat

SEQ ID NO: 532 - DNA, 24 bp, Homo sapiens
ctgtgattggagctggggtcagtg

SEQ ID NO: 533 - DNA, 24 bp, Homo sapiens
ctgtgtggatgagggacttgagcc

SEQ ID NO: 534 - DNA, 24 bp, Homo sapiens
tttgagagaactgaagatattgga

SEQ ID NO: 535 - DNA, 24 bp, Homo sapiens
gcaaaaacaaaggagctgatggca

SEQ ID NO: 536 - DNA, 24 bp, Homo sapiens
ggcaaaaacaaaggagctgatggc

SEQ ID NO: 537 - DNA, 24 bp, Homo sapiens
caaaaacaaaggagctgatggcaa

SEQ ID NO: 538 - DNA, 24 bp, Homo sapiens
tggaggttcaaagagaatgtggaa

SEQ ID NO: 539 - DNA, 24 bp, Homo sapiens
gtggaggttcaaagagaatgtgga

SEQ ID NO: 540 - DNA, 24 bp, Homo sapiens
ggaggttcaaagagaatgtggaag

SEQ ID NO: 541 - DNA, 24 bp, Homo sapiens
agccgccaatacaagcatccagat

SEQ ID NO: 542 - DNA, 24 bp, Homo sapiens
aacgcatcctggtgattggaatgg

SEQ ID NO: 543 - DNA, 24 bp, Homo sapiens
ttatcagcaccaggcatggcacct

SEQ ID NO: 544 - DNA, 24 bp, Homo sapiens
atggctatccttgggactcagtgt

SEQ ID NO: 545 - DNA, 24 bp, Homo sapiens
cccggtttcgttctatgctccgca

SEQ ID NO: 546 - DNA, 25 bp, Homo sapiens
ggatgatgacaatgaggctactgga

SEQ ID NO: 547 - DNA, 23 bp, Homo sapiens
ggcaggcacatcatggacaagtt

SEQ ID NO: 548 - DNA, 25 bp, Homo sapiens
tctccgccaattcaccttgactctg

SEQ ID NO: 549 - DNA, 25 bp, Homo sapiens
gtgtgctgcttatggaattggaggt

SEQ ID NO: 550 - DNA, 25 bp, Homo sapiens
tggtgaagaagcagatgagcgagaa

SEQ ID NO: 551 - DNA, 25 bp, Homo sapiens
ggctgaagaagtccatccacaacct

SEQ ID NO: 552 - DNA, 23 bp, Homo sapiens
gacagaggcaggtgattcagagg

SEQ ID NO: 553 - DNA, 23 bp, Homo sapiens
gacagagatgacggctcggtgta

SEQ ID NO: 554 - DNA, 24 bp, Homo sapiens
cgaaggaggacacagaaggacggt

SEQ ID NO: 555 - DNA, 24 bp, Homo sapiens
acatgccgtcagaattcagaaaca

SEQ ID NO: 556 - DNA, 24 bp, Homo sapiens
aacatgccgtcagaattcagaaac

SEQ ID NO: 557 - DNA, 24 bp, Homo sapiens
catgccgtcagaattcagaaacaa

SEQ ID NO: 558 - DNA, 23 bp, Homo sapiens
ggctgactggctgcgggactatc

SEQ ID NO: 559 - DNA, 25 bp, Homo sapiens
gagatagtgatctgggctgagcacg

SEQ ID NO: 560 - DNA, 23 bp, Homo sapiens
gtgtgtctgaccgtggttcctgg

SEQ ID NO: 561 - DNA, 23 bp, Homo sapiens
gcggacagtaggaatgaccaggc

SEQ ID NO: 562 - DNA, 24 bp, Homo sapiens
cacagagaacagggcaaggagcag

SEQ ID NO: 563 - DNA, 24 bp, Homo sapiens
agacttctgtcaggcaactccagt

SEQ ID NO: 564 - DNA, 24 bp, Homo sapiens
gagcagcacatccatcaggcacat

SEQ ID NO: 565 - DNA, 23 bp, Homo sapiens
tcagaggcatcagaccacccagc

SEQ ID NO: 566 - DNA, 25 bp, Homo sapiens
gtgattgactgcctggaggatgaga

SEQ ID NO: 567 - DNA, 23 bp, Homo sapiens
gcaggtgaagaccggcctcagtt

SEQ ID NO: 568 - DNA, 25 bp, Homo sapiens
atgttcagctcactggatatcgagt

SEQ ID NO: 569 - DNA, 25 bp, Homo sapiens
ccaaggagaagaccggaccaatgaa

SEQ ID NO: 570 - DNA, 24 bp, Homo sapiens
cttgctcctgacagctcatccgtg

SEQ ID NO: 571 - DNA, 25 bp, Homo sapiens
agaggcataaggttcgggaagaggt

SEQ ID NO: 572 - DNA, 25 bp, Homo sapiens
ggcttgaaccaacctacggatgact

SEQ ID NO: 573 - DNA, 24 bp, Homo sapiens
cattatgccgttggagatgagtgg

SEQ ID NO: 574 - DNA, 25 bp, Homo sapiens
tccaatccagagaaccatcaagcca

SEQ ID NO: 575 - DNA, 25 bp, Homo sapiens
acaccttgaatgacaatgctcggag

SEQ ID NO: 576 - DNA, 24 bp, Homo sapiens
cccagtccacagctattcctgcac

SEQ ID NO: 577 - DNA, 24 bp, Homo sapiens
acccagtccacagctattcctgca

SEQ ID NO: 578 - DNA, 24 bp, Homo sapiens
ccagtccacagctattcctgcacc

SEQ ID NO: 579 - DNA, 25 bp, Homo sapiens
tggttgtatcaggacttatggtggc

SEQ ID NO: 580 - DNA, 23 bp, Homo sapiens
gtgagtgtctatgctcttaagga

SEQ ID NO: 581 - DNA, 23 bp, Homo sapiens
gacaagcagaccagctcagggag

SEQ ID NO: 582 - DNA, 24 bp, Homo sapiens
ccactctggagaatgtcagcccac

SEQ ID NO: 583 - DNA, 24 bp, Homo sapiens
accactctggagaatgtcagccca

SEQ ID NO: 584 - DNA, 24 bp, Homo sapiens
cactctggagaatgtcagcccacc

SEQ ID NO: 585 - DNA, 23 bp, Homo sapiens
ctggatatcgagtgcgggtgacc

SEQ ID NO: 586 - DNA, 24 bp, Homo sapiens
gagaagaccggaccaatgaaagaa

SEQ ID NO: 587 - DNA, 23 bp, Homo sapiens
tccaagttgatgccgttccagcc

SEQ ID NO: 588 - DNA, 25 bp, Homo sapiens
acaaccaggcactgactacaagatc

SEQ ID NO: 589 - DNA, 24 bp, Homo sapiens
gtgattcatctagatggtgccatg

SEQ ID NO: 590 - DNA, 24 bp, Homo sapiens
tgtgattcatctagatggtgccat

SEQ ID NO: 591 - DNA, 24 bp, Homo sapiens
tgattcatctagatggtgccatga

SEQ ID NO: 592 - DNA, 25 bp, Homo sapiens
acaagattggagagaagtgggaccg

SEQ ID NO: 593 - DNA, 23 bp, Homo sapiens
ggccagatgatgagctgcacatg

SEQ ID NO: 594 - DNA, 25 bp, Homo sapiens
aacggaaaaggagaattcaagtgtg

SEQ ID NO: 595 - DNA, 24 bp, Homo sapiens
tcttgggaacggaaaaggagaatt

SEQ ID NO: 596 - DNA, 24 bp, Homo sapiens
atggccagatgatgagctgcacat

SEQ ID NO: 597 - DNA, 24 bp, Homo sapiens
aatggccagatgatgagctgcaca

SEQ ID NO: 598 - DNA, 24 bp, Homo sapiens
tggccagatgatgagctgcacatg

SEQ ID NO: 599 - DNA, 24 bp, Homo sapiens
agtgtgaccctcatgaggcaacgt

SEQ ID NO: 600 - DNA, 24 bp, Homo sapiens
aagtgtgaccctcatgaggcaacg

SEQ ID NO: 601 - DNA, 24 bp, Homo sapiens
gtgtgaccctcatgaggcaacgtg

SEQ ID NO: 602 - DNA, 25 bp, Homo sapiens
tggtgccatgacaatggtgtgaact

SEQ ID NO: 603 - DNA, 24 bp, Homo sapiens
ttggagagaagtgggaccgtcagg

SEQ ID NO: 604 - DNA, 23 bp, Homo sapiens
atgatgggaagacataccacgta

SEQ ID NO: 605 - DNA, 25 bp, Homo sapiens
cagtggcagaaggaatatctcggtg

SEQ ID NO: 606 - DNA, 23 bp, Homo sapiens
cctgcacatgctttggaggccag

SEQ ID NO: 607 - DNA, 24 bp, Homo sapiens
ccatcatcccagctgttcctcctc

SEQ ID NO: 608 - DNA, 24 bp, Homo sapiens
accatcatcccagctgttcctcct

SEQ ID NO: 609 - DNA, 24 bp, Homo sapiens
catcatcccagctgttcctcctcc

SEQ ID NO: 610 - DNA, 24 bp, Homo sapiens
actcaggaagcatcgttgtgtccg

SEQ ID NO: 611 - DNA, 25 bp, Homo sapiens
cgtctacaccatccaagtcctgaga

SEQ ID NO: 612 - DNA, 24 bp, Homo sapiens
ccggcctggagtacaatgtcagtg

SEQ ID NO: 613 - DNA, 23 bp, Homo sapiens
cgacgcctccactgccattgatg

SEQ ID NO: 614 - DNA, 25 bp, Homo sapiens
cgtaggagaacagtggcagaaggaa

SEQ ID NO: 615 - DNA, 25 bp, Homo sapiens
tgagtgtctccagtgtctacgaaca

SEQ ID NO: 616 - DNA, 25 bp, Homo sapiens
acagagtatgtggtcagcatcgttg

SEQ ID NO: 617 - DNA, 23 bp, Homo sapiens
acctggaagttgttgctgcgacc

SEQ ID NO: 618 - DNA, 23 bp, Homo sapiens
ggacttcctatgtggtcggagaa

SEQ ID NO: 619 - DNA, 23 bp, Homo sapiens
caaggctggatgatggtagattg

SEQ ID NO: 620 - DNA, 23 bp, Homo sapiens
cctgggagaaggcagcggacgca

SEQ ID NO: 621 - DNA, 24 bp, Homo sapiens
gcaagcccatagctgagaagtgtt

SEQ ID NO: 622 - DNA, 24 bp, Homo sapiens
tgcaagcccatagctgagaagtgt

SEQ ID NO: 623 - DNA, 24 bp, Homo sapiens
caagcccatagctgagaagtgttt

SEQ ID NO: 624 - DNA, 25 bp, Homo sapiens
agaattggagacacctggagcaaga

SEQ ID NO: 625 - DNA, 25 bp, Homo sapiens
gaggagagtggaagtgtgagaggca

SEQ ID NO: 626 - DNA, 23 bp, Homo sapiens
tgcagaccacatcgagcggatct

SEQ ID NO: 627 - DNA, 24 bp, Homo sapiens
cacaaacaacagcgcctgatgccc

SEQ ID NO: 628 - DNA, 24 bp, Homo sapiens
tcacaaacaacagcgcctgatgcc

SEQ ID NO: 629 - DNA, 24 bp, Homo sapiens
acaaacaacagcgcctgatgcccc

SEQ ID NO: 630 - DNA, 25 bp, Homo sapiens
tgacagagaagattcccgagagtaa

SEQ ID NO: 631 - DNA, 25 bp, Homo sapiens
tccaatccagaggaacaagcatgtc

SEQ ID NO: 632 - DNA, 23 bp, Homo sapiens
aactggagtgatgttagcagacc

SEQ ID NO: 633 - DNA, 24 bp, Homo sapiens
tccagcttcagctcaactcacagc

SEQ ID NO: 634 - DNA, 24 bp, Homo sapiens
agcatcaccctgggagtttcctga

SEQ ID NO: 635 - DNA, 24 bp, Homo sapiens
gctgcacattgcctgttctgcttc

SEQ ID NO: 636 - DNA, 25 bp, Homo sapiens
tttctgatgttccgagggacctgga

SEQ ID NO: 637 - DNA, 23 bp, Homo sapiens
cgacccccaccagcctactgatc

SEQ ID NO: 638 - DNA, 25 bp, Homo sapiens
gatgctcctgctgtcacagtgagat

SEQ ID NO: 639 - DNA, 25 bp, Homo sapiens
catcactgtgtatgctgtcactggc

SEQ ID NO: 640 - DNA, 25 bp, Homo sapiens
gcaagtgaccgatgttcaggacaac

SEQ ID NO: 641 - DNA, 25 bp, Homo sapiens
tgtcaagtggctgccttcaagttcc

SEQ ID NO: 642 - DNA, 25 bp, Homo sapiens
tggtgtgaactacaagattggagag

SEQ ID NO: 643 - DNA, 25 bp, Homo sapiens
cctacggatgactcgtgctttgacc

SEQ ID NO: 644 - DNA, 25 bp, Homo sapiens
agtgcttaggctttggaagtggtca

SEQ ID NO: 645 - DNA, 25 bp, Homo sapiens
ctcagggagttgtcaccactctgga

SEQ ID NO: 646 - DNA, 25 bp, Homo sapiens
tgctactgagaccaccatcaccatt

SEQ ID NO: 647 - DNA, 23 bp, Homo sapiens
actcaggtcacacccacaagcct

SEQ ID NO: 648 - DNA, 23 bp, Homo sapiens
caccacccaatgttcagctcact

SEQ ID NO: 649 - DNA, 25 bp, Homo sapiens
aaagaaatcaaccttgctcctgaca

SEQ ID NO: 650 - DNA, 24 bp, Homo sapiens
aaggacactttgacaagcagacca

SEQ ID NO: 651 - DNA, 24 bp, Homo sapiens
gcaccaccccagacattactggtt

SEQ ID NO: 652 - DNA, 24 bp, Homo sapiens
agcaccaccccagacattactggt

SEQ ID NO: 653 - DNA, 24 bp, Homo sapiens
caccaccccagacattactggtta

SEQ ID NO: 654 - DNA, 25 bp, Homo sapiens
cctgacactggagtgctcacagtct

SEQ ID NO: 655 - DNA, 24 bp, Homo sapiens
ccactgacctgcgattcaccaaca

SEQ ID NO: 656 - DNA, 23 bp, Homo sapiens
caccatgcgtgtcacctgggctc

SEQ ID NO: 657 - DNA, 25 bp, Homo sapiens
tccattgatttaaccaacttcctgg

SEQ ID NO: 658 - DNA, 25 bp, Homo sapiens
actggtggttacatgttagagtgtg

SEQ ID NO: 659 - DNA, 24 bp, Homo sapiens
aatggaaaaggagaatggacctgc

SEQ ID NO: 660 - DNA, 25 bp, Homo sapiens
ggtgaccatcgctatgtgaacaact

SEQ ID NO: 661 - DNA, 23 bp, Homo sapiens
gccgcttcaccaaggagaccacc

SEQ ID NO: 662 - DNA, 25 bp, Homo sapiens
gtactcctccagcattcagaactct

SEQ ID NO: 663 - DNA, 24 bp, Homo sapiens
acatggagaacggtggtgaccatc

SEQ ID NO: 664 - DNA, 24 bp, Homo sapiens
cacatggagaacggtggtgaccat

SEQ ID NO: 665 - DNA, 24 bp, Homo sapiens
catggagaacggtggtgaccatcg

SEQ ID NO: 666 - DNA, 25 bp, Homo sapiens
cggacaccatgaagagatactccat

SEQ ID NO: 667 - DNA, 25 bp, Homo sapiens
actccatgtacctgacacccaaagg

SEQ ID NO: 668 - DNA, 23 bp, Homo sapiens
ccggacatcataccagccctcgt

SEQ ID NO: 669 - DNA, 24 bp, Homo sapiens
aggagacaaaaccaggagcagcac

SEQ ID NO: 670 - DNA, 23 bp, Homo sapiens
gacatctcccgtctcaacagccc

SEQ ID NO: 671 - DNA, 23 bp, Homo sapiens
tggaaggatgggccagcttgcag

SEQ ID NO: 672 - DNA, 24 bp, Homo sapiens
gttgcatatcagggtgctcaagga

SEQ ID NO: 673 - DNA, 24 bp, Homo sapiens
tgttgcatatcagggtgctcaagg

SEQ ID NO: 674 - DNA, 24 bp, Homo sapiens
ttgcatatcagggtgctcaaggat

SEQ ID NO: 675 - DNA, 24 bp, Homo sapiens
gaccaagtgaaggtgatcatggat

SEQ ID NO: 676 - DNA, 24 bp, Homo sapiens
ggaccaagtgaaggtgatcatgga

SEQ ID NO: 677 - DNA, 24 bp, Homo sapiens
accaagtgaaggtgatcatggatg

SEQ ID NO: 678 - DNA, 24 bp, Homo sapiens
aaggtgatcatggatgctctggat

SEQ ID NO: 679 - DNA, 23 bp, Homo sapiens
gccaaggtgctgcatgaggacaa

SEQ ID NO: 680 - DNA, 23 bp, Homo sapiens
agctgcatagcatcagcgactct

SEQ ID NO: 681 - DNA, 23 bp, Homo sapiens
ctccaggtagccagcagacagaa

SEQ ID NO: 682 - DNA, 25 bp, Homo sapiens
atgaggatggtgatggtgatgatga

SEQ ID NO: 683 - DNA, 25 bp, Homo sapiens
ggatgacgaggaatggaagccaaca

SEQ ID NO: 684 - DNA, 25 bp, Homo sapiens
tggagaagaatcagtccctggtaga

SEQ ID NO: 685 - DNA, 23 bp, Homo sapiens
taagtcgtggtctgagcgaggca

SEQ ID NO: 686 - DNA, 25 bp, Homo sapiens
agacagcccagatgttggagaggat

SEQ ID NO: 687 - DNA, 24 bp, Homo sapiens
acacacatccttcagcagctgaga

SEQ ID NO: 688 - DNA, 24 bp, Homo sapiens
aacacacatccttcagcagctgag

SEQ ID NO: 689 - DNA, 24 bp, Homo sapiens
cacacatccttcagcagctgagaa

SEQ ID NO: 690 - DNA, 24 bp, Homo sapiens
tgaaacagggtctccacaagaggg

SEQ ID NO: 691 - DNA, 24 bp, Homo sapiens
tgggtttttaacaagcgtcttaca

SEQ ID NO: 692 - DNA, 24 bp, Homo sapiens
tgtatgcggcaggcgagaagattc

SEQ ID NO: 693 - DNA, 24 bp, Homo sapiens
gccaacaagagcattgaggacagc

SEQ ID NO: 694 - DNA, 24 bp, Homo sapiens
agattcgtgggactgatgagatga

SEQ ID NO: 695 - DNA, 24 bp, Homo sapiens
acctgctgagagtgtttgaagagt

SEQ ID NO: 696 - DNA, 24 bp, Homo sapiens
agattactcttggtggaaggctct

SEQ ID NO: 697 - DNA, 24 bp, Homo sapiens
gagaagtggaaggatcgactcggt

SEQ ID NO: 698 - DNA, 24 bp, Homo sapiens
agtcagaagtctggcaggaactcg

SEQ ID NO: 699 - DNA, 24 bp, Homo sapiens
agccgcccgaagccctccaaggcc

SEQ ID NO: 700 - DNA, 24 bp, Homo sapiens
gagccgcccgaagccctccaaggc

SEQ ID NO: 701 - DNA, 24 bp, Homo sapiens
gccgcccgaagccctccaaggcca

SEQ ID NO: 702 - DNA, 24 bp, Homo sapiens
acatgaactacagcctccacttgg

SEQ ID NO: 703 - DNA, 24 bp, Homo sapiens
cagccaccatatacctccgacagc

SEQ ID NO: 704 - DNA, 24 bp, Homo sapiens
cttcactctggatgcccgcctcgt

SEQ ID NO: 705 - DNA, 24 bp, Homo sapiens
ggagtcagttcaacgtcgaggtcg

SEQ ID NO: 706 - DNA, 24 bp, Homo sapiens
acagggctgaggatgaggagaacc

SEQ ID NO: 707 - DNA, 24 bp, Homo sapiens
acccagaagaccgtgccttgcccg

SEQ ID NO: 708 - DNA, 24 bp, Homo sapiens
ggcctgaaggacttgccctaacag

SEQ ID NO: 709 - DNA, 24 bp, Homo sapiens
gctttccctgcctggctttgagaa

SEQ ID NO: 710 - DNA, 24 bp, Homo sapiens
ggacccagaagaccgtgccttgcc

SEQ ID NO: 711 - DNA, 24 bp, Homo sapiens
gttcaacgtcgaggtcggcagaag

SEQ ID NO: 712 - DNA, 24 bp, Homo sapiens
agctttccctgcctggctttgaga

SEQ ID NO: 713 - DNA, 24 bp, Homo sapiens
tcacagcaggatataacaaatttc

SEQ ID NO: 714 - DNA, 24 bp, Homo sapiens
ccaattttggtggagaacccgtac

SEQ ID NO: 715 - DNA, 24 bp, Homo sapiens
cccaattttggtggagaacccgta

SEQ ID NO: 716 - DNA, 24 bp, Homo sapiens
caattttggtggagaacccgtaca

SEQ ID NO: 717 - DNA, 24 bp, Homo sapiens
agagcctcaacaactacctggtga

SEQ ID NO: 718 - DNA, 24 bp, Homo sapiens
cttcagccccttggtgtgagcagc

SEQ ID NO: 719 - DNA, 24 bp, Homo sapiens
cgctgactctggacattgcaagta

SEQ ID NO: 720 - DNA, 24 bp, Homo sapiens
gcatttcagagagtaacatggact

SEQ ID NO: 721 - DNA, 24 bp, Homo sapiens
ccaccatatacctccgacagcgct

SEQ ID NO: 722 - DNA, 24 bp, Homo sapiens
caatgaccacactgatgatcgggt

SEQ ID NO: 723 - DNA, 24 bp, Homo sapiens
caacaccaactgcttcatcaaggc

SEQ ID NO: 724 - DNA, 24 bp, Homo sapiens
gcagttgctcactacagttcctta

SEQ ID NO: 725 - DNA, 24 bp, Homo sapiens
gaacctgcattggagtgacgaccg

SEQ ID NO: 726 - DNA, 24 bp, Homo sapiens
agaacctgcattggagtgacgacc

SEQ ID NO: 727 - DNA, 24 bp, Homo sapiens
aacctgcattggagtgacgaccgt

SEQ ID NO: 728 - DNA, 24 bp, Homo sapiens
gccaaagatagggggacaacaaag

SEQ ID NO: 729 - DNA, 24 bp, Homo sapiens
agccaaagatagggggacaacaaa

SEQ ID NO: 730 - DNA, 24 bp, Homo sapiens
ccaaagatagggggacaacaaagg

SEQ ID NO: 731 - DNA, 24 bp, Homo sapiens
gactggaacacctgcggcttgctc

SEQ ID NO: 732 - DNA, 24 bp, Homo sapiens
cctggtggtgttgtcctgggtttc

SEQ ID NO: 733 - DNA, 24 bp, Homo sapiens
atcatcaacagctccatctccagc

SEQ ID NO: 734 - DNA, 24 bp, Homo sapiens
cgttgactacagtgacttgacaat

SEQ ID NO: 735 - DNA, 24 bp, Homo sapiens
tgccataggtcttcaacaggacaa

SEQ ID NO: 736 - DNA, 24 bp, Homo sapiens
ctcttctccaatggcacggtcctg

SEQ ID NO: 737 - DNA, 24 bp, Homo sapiens
actctcaaagggtctgtggttcca

SEQ ID NO: 738 - DNA, 24 bp, Homo sapiens
ttctttgccacccacccaccctta

SEQ ID NO: 739 - DNA, 24 bp, Homo sapiens
tcagccacaggtcccagtagaaga

SEQ ID NO: 740 - DNA, 24 bp, Homo sapiens
agaaggtaaaaggggagcgtagga

SEQ ID NO: 741 - DNA, 24 bp, Homo sapiens
gagaaggtaaaaggggagcgtagg

SEQ ID NO: 742 - DNA, 24 bp, Homo sapiens
gaaggtaaaaggggagcgtaggaa

SEQ ID NO: 743 - DNA, 23 bp, Homo sapiens
gcagtggataagaaggaggcagg

SEQ ID NO: 744 - DNA, 25 bp, Homo sapiens
gccaccaagaaggaagaggagaaga

SEQ ID NO: 745 - DNA, 24 bp, Homo sapiens
gacaggaacacaggcttgagcagg

SEQ ID NO: 746 - DNA, 23 bp, Homo sapiens
ctggtggcaagagtggcgagaag

SEQ ID NO: 747 - DNA, 24 bp, Homo sapiens
ggagcgtaggaacacagacaccag

SEQ ID NO: 748 - DNA, 25 bp, Homo sapiens
gaagccaaggatgacagcaagacca

SEQ ID NO: 749 - DNA, 24 bp, Homo sapiens
agaccaagacagatgccaagaatg

SEQ ID NO: 750 - DNA, 24 bp, Homo sapiens
gagaccaagacagatgccaagaat

SEQ ID NO: 751 - DNA, 24 bp, Homo sapiens
gaccaagacagatgccaagaatgg

SEQ ID NO: 752 - DNA, 24 bp, Homo sapiens
atgtccatggatgaaagcaagcaa

SEQ ID NO: 753 - DNA, 24 bp, Homo sapiens
gatgtccatggatgaaagcaagca

SEQ ID NO: 754 - DNA, 24 bp, Homo sapiens
tgtccatggatgaaagcaagcaag

SEQ ID NO: 755 - DNA, 24 bp, Homo sapiens
ctcttcaaaaaggtgggtgcaggc

SEQ ID NO: 756 - DNA, 24 bp, Homo sapiens
tctcttcaaaaaggtgggtgcagg

SEQ ID NO: 757 - DNA, 24 bp, Homo sapiens
tcttcaaaaaggtgggtgcaggct

SEQ ID NO: 758 - DNA, 24 bp, Homo sapiens
ctgatgatggcgattctttggatg

SEQ ID NO: 759 - DNA, 24 bp, Homo sapiens
gctgatgatggcgattctttggat

SEQ ID NO: 760 - DNA, 24 bp, Homo sapiens
tgatgatggcgattctttggatgg

SEQ ID NO: 761 - DNA, 25 bp, Homo sapiens
acaagactgaagatggagaggcact

SEQ ID NO: 762 - DNA, 25 bp, Homo sapiens
ggaggagttggaagacgaagctgtg

SEQ ID NO: 763 - DNA, 25 bp, Homo sapiens
tcaactgacagatggagtggatgtt

SEQ ID NO: 764 - DNA, 25 bp, Homo sapiens
gcgaaaccgagatccctcaaagacc

SEQ ID NO: 765 - DNA, 23 bp, Homo sapiens
tgcctccaggtgtttgaatcgct

SEQ ID NO: 766 - DNA, 24 bp, Homo sapiens
gtcaactgacagatggagtggatg

SEQ ID NO: 767 - DNA, 24 bp, Homo sapiens
tgtcaactgacagatggagtggat

SEQ ID NO: 768 - DNA, 24 bp, Homo sapiens
tcaactgacagatggagtggatgt

SEQ ID NO: 769 - DNA, 25 bp, Homo sapiens
gccagcttcctcaccttctagcaag

SEQ ID NO: 770 - DNA, 23 bp, Homo sapiens
acaagtcgtttagccgcctcagc

SEQ ID NO: 771 - DNA, 24 bp, Homo sapiens
aagcaccatgagcagagtcacagt

SEQ ID NO: 772 - DNA, 23 bp, Homo sapiens
cgcagccgagatcgccacataaa

SEQ ID NO: 773 - DNA, 25 bp, Homo sapiens
gaggcactagattgtaagaagaggc

SEQ ID NO: 774 - DNA, 24 bp, Homo sapiens
agaggagtaagagttagacggact

SEQ ID NO: 775 - DNA, 24 bp, Homo sapiens
gcagcaacactcattcagtcaaac

SEQ ID NO: 776 - DNA, 24 bp, Homo sapiens
acagcaaagatactgggcaatgaa

SEQ ID NO: 777 - DNA, 24 bp, Homo sapiens
ttgttcacaggaagcagagtatca

SEQ ID NO: 778 - DNA, 24 bp, Homo sapiens
gaaatgtgctgccctacggattca

SEQ ID NO: 779 - DNA, 24 bp, Homo sapiens
ccttcagatggctgtgtatcggag

SEQ ID NO: 780 - DNA, 24 bp, Homo sapiens
catattcaacacatgcacagggca

SEQ ID NO: 781 - DNA, 24 bp, Homo sapiens
acatattcaacacatgcacagggc

SEQ ID NO: 782 - DNA, 24 bp, Homo sapiens
atattcaacacatgcacagggcag

SEQ ID NO: 783 - DNA, 24 bp, Homo sapiens
aattctccatagaaagtgacacgg

SEQ ID NO: 784 - DNA, 24 bp, Homo sapiens
caattctccatagaaagtgacacg

SEQ ID NO: 785 - DNA, 24 bp, Homo sapiens
attctccatagaaagtgacacgga

SEQ ID NO: 786 - DNA, 25 bp, Homo sapiens
tgaatggactgatgtgttctaagcc

SEQ ID NO: 787 - DNA, 24 bp, Homo sapiens
cactaaatggaggacagtcacgga

SEQ ID NO: 788 - DNA, 25 bp, Homo sapiens
gcagagttgattgaggagtatgagg

SEQ ID NO: 789 - DNA, 23 bp, Homo sapiens
atcctaccagacctcgaccaaaa

SEQ ID NO: 790 - DNA, 24 bp, Homo sapiens
tttgaggaccaaatctgtaccccc

SEQ ID NO: 791 - DNA, 24 bp, Homo sapiens
ttttgaggaccaaatctgtacccc

SEQ ID NO: 792 - DNA, 24 bp, Homo sapiens
ttgaggaccaaatctgtacccccg

SEQ ID NO: 793 - DNA, 25 bp, Homo sapiens
aagaagatccacagtaccagcagca

SEQ ID NO: 794 - DNA, 25 bp, Homo sapiens
gcaaatacctgatgaagagggcatt

SEQ ID NO: 795 - DNA, 25 bp, Homo sapiens
ggatttccaagagatgttgcccagg

SEQ ID NO: 796 - DNA, 25 bp, Homo sapiens
aaaggaactgggtggctgtgacaag

SEQ ID NO: 797 - DNA, 24 bp, Homo sapiens
aatggaggacagtcacggagatcc

SEQ ID NO: 798 - DNA, 25 bp, Homo sapiens
tgacatcagcatggcagttgacaac

SEQ ID NO: 799 - DNA, 25 bp, Homo sapiens
cataattggtggtcctggctctggc

SEQ ID NO: 800 - DNA, 25 bp, Homo sapiens
ggatttacacatctctcaactggcg

SEQ ID NO: 801 - DNA, 25 bp, Homo sapiens
gcgtgaggaactggcatcagaatct

SEQ ID NO: 802 - DNA, 25 bp, Homo sapiens
gcttcctgattgacggctatcctcg

SEQ ID NO: 803 - DNA, 24 bp, Homo sapiens
ttttcataattggtggtcctggct

SEQ ID NO: 804 - DNA, 24 bp, Homo sapiens
attttcataattggtggtcctggc

SEQ ID NO: 805 - DNA, 24 bp, Homo sapiens
tttcataattggtggtcctggctc

SEQ ID NO: 806 - DNA, 24 bp, Homo sapiens
ttcggacgcaggattggagaccca

SEQ ID NO: 807 - DNA, 24 bp, Homo sapiens
gttcggacgcaggattggagaccc

SEQ ID NO: 808 - DNA, 24 bp, Homo sapiens
tcggacgcaggattggagacccac

SEQ ID NO: 809 - DNA, 25 bp, Homo sapiens
ccttcgatgatattggacactggag

SEQ ID NO: 810 - DNA, 25 bp, Homo sapiens
atgaagatcagggtgatgaccagtt

SEQ ID NO: 811 - DNA, 25 bp, Homo sapiens
tggagaggacactatgggaggtttc

SEQ ID NO: 812 - DNA, 23 bp, Homo sapiens
caccatgaccaaccgccttctcc

SEQ ID NO: 813 - DNA, 23 bp, Homo sapiens
acaccaccaagaccatcgccaag

SEQ ID NO: 814 - DNA, 23 bp, Homo sapiens
agcctactaccgagcgtccatcc

SEQ ID NO: 815 - DNA, 24 bp, Homo sapiens
catgtttgttagaatggaaacaga

SEQ ID NO: 816 - DNA, 24 bp, Homo sapiens
gcatgtttgttagaatggaaacag

SEQ ID NO: 817 - DNA, 24 bp, Homo sapiens
atgtttgttagaatggaaacagaa

SEQ ID NO: 818 - DNA, 24 bp, Homo sapiens
ggtgatctgtatggactgctcggc

SEQ ID NO: 819 - DNA, 23 bp, Homo sapiens
ctcggcagacaccatgaccaacc

SEQ ID NO: 820 - DNA, 23 bp, Homo sapiens
aaggagccggagcagcctgcctg

SEQ ID NO: 821 - DNA, 24 bp, Homo sapiens
cagctacacaagataaatgcagag

SEQ ID NO: 822 - DNA, 24 bp, Homo sapiens
acagctacacaagataaatgcaga

SEQ ID NO: 823 - DNA, 24 bp, Homo sapiens
agctacacaagataaatgcagagg

SEQ ID NO: 824 - DNA, 24 bp, Homo sapiens
ccagaggacgtttttcttcaactc

SEQ ID NO: 825 - DNA, 25 bp, Homo sapiens
gctattgactctattttctgaaggc

SEQ ID NO: 826 - DNA, 25 bp, Homo sapiens
gcatgtttgttagaatggaaacaga

SEQ ID NO: 827 - DNA, 25 bp, Homo sapiens
actcatgtctcctgactgaccaagg

SEQ ID NO: 828 - DNA, 25 bp, Homo sapiens
tcaaggtcaagagttgggcagaagc

SEQ ID NO: 829 - DNA, 23 bp, Homo sapiens
gcactcacggcacacacactttg

SEQ ID NO: 830 - DNA, 25 bp, Homo sapiens
gccacactcagagctagtcagtaca

SEQ ID NO: 831 - DNA, 24 bp, Homo sapiens
gtgccagtctgtgtccgttgtgat

SEQ ID NO: 832 - DNA, 24 bp, Homo sapiens
ctgatcatctggttctcctctcat

SEQ ID NO: 833 - DNA, 24 bp, Homo sapiens
cctgatcatctggttctcctctca

SEQ ID NO: 834 - DNA, 24 bp, Homo sapiens
tgatcatctggttctcctctcatt

SEQ ID NO: 835 - DNA, 23 bp, Homo sapiens
gacagcactgtttgcttcccagc

SEQ ID NO: 836 - DNA, 25 bp, Homo sapiens
tgtgtgagaggtgtctggaaatcat

SEQ ID NO: 837 - DNA, 24 bp, Homo sapiens
aggccgctgcaggtaggcacggcc

SEQ ID NO: 838 - DNA, 24 bp, Homo sapiens
caggccgctgcaggtaggcacggc

SEQ ID NO: 839 - DNA, 24 bp, Homo sapiens
ggccgctgcaggtaggcacggccc

SEQ ID NO: 840 - DNA, 24 bp, Homo sapiens
tgaggaactgatggaggacacgca

SEQ ID NO: 841 - DNA, 25 bp, Homo sapiens
cggtggaagagatggaggcagaaga

SEQ ID NO: 842 - DNA, 24 bp, Homo sapiens
gcggtggaagagatggaggcagaa

SEQ ID NO: 843 - DNA, 24 bp, Homo sapiens
cgcggtggaagagatggaggcaga

SEQ ID NO: 844 - DNA, 24 bp, Homo sapiens
cggtggaagagatggaggcagaag

SEQ ID NO: 845 - DNA, 25 bp, Homo sapiens
agcatcatcagaagtgaacctggca

SEQ ID NO: 846 - DNA, 25 bp, Homo sapiens
cacaatgagaccaacacagacacga

SEQ ID NO: 847 - DNA, 25 bp, Homo sapiens
tcacaagataaccaacaaccagact

SEQ ID NO: 848 - DNA, 24 bp, Homo sapiens
gctgtgccaaccgtatggaaaaat

SEQ ID NO: 849 - DNA, 24 bp, Homo sapiens
agctgtgccaaccgtatggaaaaa

SEQ ID NO: 850 - DNA, 24 bp, Homo sapiens
ctgtgccaaccgtatggaaaaatt

SEQ ID NO: 851 - DNA, 23 bp, Homo sapiens
atgctggcgagcgcgataagaag

SEQ ID NO: 852 - DNA, 23 bp, Homo sapiens
gccaagaaaaagacggacaagaa

SEQ ID NO: 853 - DNA, 24 bp, Homo sapiens
gctggttattcagaagaggagtgt

SEQ ID NO: 854 - DNA, 24 bp, Homo sapiens
gtctacagtaacaccatccagtca

SEQ ID NO: 855 - DNA, 24 bp, Homo sapiens
aagatagactttggtgactcagcc

SEQ ID NO: 856 - DNA, 25 bp, Homo sapiens
gtttaagagtcgggaagattgctgc

SEQ ID NO: 857 - DNA, 25 bp, Homo sapiens
tcactgacactccagactaaagcag

SEQ ID NO: 858 - DNA, 24 bp, Homo sapiens
ttactgacagtggtgagcatcctt

SEQ ID NO: 859 - DNA, 25 bp, Homo sapiens
actgggcttacttaaaggatgcgag

SEQ ID NO: 860 - DNA, 23 bp, Homo sapiens
gcaggcttaccaggatatcaaag

SEQ ID NO: 861 - DNA, 25 bp, Homo sapiens
agaacaggaactgcaagatatccag

SEQ ID NO: 862 - DNA, 24 bp, Homo sapiens
gcacgtggaaaggacaacaacata

SEQ ID NO: 863 - DNA, 24 bp, Homo sapiens
tgcacgtggaaaggacaacaacat

SEQ ID NO: 864 - DNA, 24 bp, Homo sapiens
cacgtggaaaggacaacaacatac

SEQ ID NO: 865 - DNA, 24 bp, Homo sapiens
tctgcagtcatggtttgctgagct

SEQ ID NO: 866 - DNA, 24 bp, Homo sapiens
ctctgcagtcatggtttgctgagc

SEQ ID NO: 867 - DNA, 24 bp, Homo sapiens
ctgcagtcatggtttgctgagcta

SEQ ID NO: 868 - DNA, 24 bp, Homo sapiens
ggcaccaagactgtgaggcagaac

SEQ ID NO: 869 - DNA, 24 bp, Homo sapiens
ggacaacattgagacagccaacag

SEQ ID NO: 870 - DNA, 24 bp, Homo sapiens
acaaacgccttctgttcccagtat

SEQ ID NO: 871 - DNA, 24 bp, Homo sapiens
cgccatcgtcttcaatgcttctct

SEQ ID NO: 872 - DNA, 24 bp, Homo sapiens
agcctttaggaagagtgcgagaga

SEQ ID NO: 873 - DNA, 24 bp, Homo sapiens
ttttctggattttggggactcgcc

SEQ ID NO: 874 - DNA, 24 bp, Homo sapiens
gcaaataggtggtctcttcatccg

SEQ ID NO: 875 - DNA, 25 bp, Homo sapiens
tggacagagaagcatgcaagacaga

SEQ ID NO: 876 - DNA, 25 bp, Homo sapiens
aggctgatgaggaagagatgcttga

SEQ ID NO: 877 - DNA, 25 bp, Homo sapiens
acccatttgaacctcctcagatccg

SEQ ID NO: 878 - DNA, 23 bp, Homo sapiens
cactccaatttatcatccaaaca

SEQ ID NO: 879 - DNA, 25 bp, Homo sapiens
ctgctggaaggatttgtctggatgt

SEQ ID NO: 880 - DNA, 24 bp, Homo sapiens
aagccagccttcctcaagaatgcc

SEQ ID NO: 881 - DNA, 23 bp, Homo sapiens
ctcaacatcgcaactgtgttgac

SEQ ID NO: 882 - DNA, 23 bp, Homo sapiens
tcagctgctcatgtcagaaccca

SEQ ID NO: 883 - DNA, 23 bp, Homo sapiens
atgacccgctcatggctgacata

SEQ ID NO: 884 - DNA, 25 bp, Homo sapiens
gctgaatgtgcggaatctgtttgag

SEQ ID NO: 885 - DNA, 25 bp, Homo sapiens
cagttggcgaaggactttgaggatt

SEQ ID NO: 886 - DNA, 25 bp, Homo sapiens
tggcagcattcaactaagcgaggag

SEQ ID NO: 887 - DNA, 25 bp, Homo sapiens
tgatgctgaatgtgcggaatctgtt

SEQ ID NO: 888 - DNA, 25 bp, Homo sapiens
cgggtggagattctcagtgaaggaa

SEQ ID NO: 889 - DNA, 24 bp, Homo sapiens
tcctccttctgcccgtatgtccac

SEQ ID NO: 890 - DNA, 24 bp, Homo sapiens
aaatcgctacttccctgcctttga

SEQ ID NO: 891 - DNA, 24 bp, Homo sapiens
actccagtcttatctccagcttcc

SEQ ID NO: 892 - DNA, 24 bp, Homo sapiens
caacctgcccacagtgaagaagtt

SEQ ID NO: 893 - DNA, 24 bp, Homo sapiens
tgttgattgtgcctgttgtgaagc

SEQ ID NO: 894 - DNA, 24 bp, Homo sapiens
acaactcctattcgctgacttagt

SEQ ID NO: 895 - DNA, 24 bp, Homo sapiens
ttgatgttccagcaagtgccaatg

SEQ ID NO: 896 - DNA, 24 bp, Homo sapiens
gccattctcaactacattgccagc

SEQ ID NO: 897 - DNA, 24 bp, Homo sapiens
gcacgaagctcaaggatctcaaga

SEQ ID NO: 898 - DNA, 24 bp, Homo sapiens
gatcgcagcagggtaagagacacc

SEQ ID NO: 899 - DNA, 24 bp, Homo sapiens
agatcgcagcagggtaagagacac

SEQ ID NO: 900 - DNA, 24 bp, Homo sapiens
atcgcagcagggtaagagacacca

SEQ ID NO: 901 - DNA, 24 bp, Homo sapiens
catcccagttaccagtgtccttga

SEQ ID NO: 902 - DNA, 24 bp, Homo sapiens
agtggcttctgtttgtcagtctca

SEQ ID NO: 903 - DNA, 24 bp, Homo sapiens
tgtcctttctccttactggcacca

SEQ ID NO: 904 - DNA, 24 bp, Homo sapiens
aggacgcctccattctatgcctgg

SEQ ID NO: 905 - DNA, 24 bp, Homo sapiens
gaaccacctccctgattcttcccg

SEQ ID NO: 906 - DNA, 24 bp, Homo sapiens
cggaagtggaagtgtcgttaatgc

SEQ ID NO: 907 - DNA, 24 bp, Homo sapiens
ggagccgagtctatcttcacactt

SEQ ID NO: 908 - DNA, 24 bp, Homo sapiens
ctatcaagatgcgaattggactgc

SEQ ID NO: 909 - DNA, 24 bp, Homo sapiens
tttgctggcgtcgttggagttaaa

SEQ ID NO: 910 - DNA, 24 bp, Homo sapiens
tttggaaacaatgtcactctggct

SEQ ID NO: 911 - DNA, 24 bp, Homo sapiens
tcatcaggaggagatcgcagcagg

SEQ ID NO: 912 - DNA, 25 bp, Homo sapiens
tcgtcctagtctccctcctcttcgt

SEQ ID NO: 913 - DNA, 23 bp, Homo sapiens
agaccctgccctccaagatgctg

SEQ ID NO: 914 - DNA, 24 bp, Homo sapiens
cctgctgataccaccagacagaga

SEQ ID NO: 915 - DNA, 24 bp, Homo sapiens
agactagatatggaacgagagcga

SEQ ID NO: 916 - DNA, 24 bp, Homo sapiens
tagactagatatggaacgagagcg

SEQ ID NO: 917 - DNA, 24 bp, Homo sapiens
gactagatatggaacgagagcgaa

SEQ ID NO: 918 - DNA, 23 bp, Homo sapiens
gagcggtggcttgttgtcagagg

SEQ ID NO: 919 - DNA, 25 bp, Homo sapiens
aactcttcttcgtggacactggctc

SEQ ID NO: 920 - DNA, 23 bp, Homo sapiens
ccttcgggttgacctcatcctcg

SEQ ID NO: 921 - DNA, 24 bp, Homo sapiens
gcgcacgagcggtggcttgttgtc

SEQ ID NO: 922 - DNA, 24 bp, Homo sapiens
agcgcacgagcggtggcttgttgt

SEQ ID NO: 923 - DNA, 24 bp, Homo sapiens
cgcacgagcggtggcttgttgtca

SEQ ID NO: 924 - DNA, 23 bp, Homo sapiens
gaggcagtggcgttggtgggaag

SEQ ID NO: 925 - DNA, 24 bp, Homo sapiens
cgaaaagcgatgccgattctggtt

SEQ ID NO: 926 - DNA, 23 bp, Homo sapiens
ggctgcggcccacttcggtggac

SEQ ID NO: 927 - DNA, 24 bp, Homo sapiens
agcgatgccgattctggtttcctg

SEQ ID NO: 928 - DNA, 23 bp, Homo sapiens
gctggcggcggcttgctcaggag

SEQ ID NO: 929 - DNA, 23 bp, Homo sapiens
cagttcctggaagacgtgcggct

SEQ ID NO: 930 - DNA, 23 bp, Homo sapiens
aaagcgatgccgattctggtttc

SEQ ID NO: 931 - DNA, 23 bp, Homo sapiens
ctgcggcccacttcggtggaccc

SEQ ID NO: 932 - DNA, 23 bp, Homo sapiens
gttcctggaagacgtgcggctac

SEQ ID NO: 933 - DNA, 24 bp, Homo sapiens
tgaagtcatccaaaggtggtcccg

SEQ ID NO: 934 - DNA, 24 bp, Homo sapiens
atcctaccttcaatccatcctcgg

SEQ ID NO: 935 - DNA, 24 bp, Homo sapiens
tgaagcaaccatcattgacattct

SEQ ID NO: 936 - DNA, 24 bp, Homo sapiens
ggtatcagaattcctcaagcaggc

SEQ ID NO: 937 - DNA, 24 bp, Homo sapiens
cctcggatgtcgctgccttgcata

SEQ ID NO: 938 - DNA, 26 bp, Homo sapiens
tcattgacattctaactaagcgaaac

SEQ ID NO: 939 - DNA, 23 bp, Homo sapiens
gcacagcgtcaacagatcaaagc

SEQ ID NO: 940 - DNA, 22 bp, Homo sapiens
atatctccaggaaacaggaaag

SEQ ID NO: 941 - DNA, 24 bp, Homo sapiens
atgctgatgaacttcgtgctgcca

SEQ ID NO: 942 - DNA, 24 bp, Homo sapiens
gcacagcgtcaacagatcaaagca

SEQ ID NO: 943 - DNA, 24 bp, Homo sapiens
gccaaagacataacctcagacaca

SEQ ID NO: 944 - DNA, 24 bp, Homo sapiens
taatggttaaaggtgtggatgaag

SEQ ID NO: 945 - DNA, 24 bp, Homo sapiens
ataatggttaaaggtgtggatgaa

SEQ ID NO: 946 - DNA, 24 bp, Homo sapiens
aatggttaaaggtgtggatgaagc

SEQ ID NO: 947 - DNA, 24 bp, Homo sapiens
tctcttgctaagggtgaccgatct

SEQ ID NO: 948 - DNA, 24 bp, Homo sapiens
ttctcttgctaagggtgaccgatc

SEQ ID NO: 949 - DNA, 24 bp, Homo sapiens
ctcttgctaagggtgaccgatctg

SEQ ID NO: 950 - DNA, 24 bp, Homo sapiens
aataccatccttaccaccagaagc

SEQ ID NO: 951 - DNA, 24 bp, Homo sapiens
caacttcgcagagtgtttcagaaa

SEQ ID NO: 952 - DNA, 24 bp, Homo sapiens
acaaagttctggacctggagttga

SEQ ID NO: 953 - DNA, 24 bp, Homo sapiens
tgaaaatgaagagcaggaatatgt

SEQ ID NO: 954 - DNA, 24 bp, Homo sapiens
agcccttacaggtcaccttgagga

SEQ ID NO: 955 - DNA, 24 bp, Homo sapiens
gccttggaactgatgaagatactc

SEQ ID NO: 956 - DNA, 24 bp, Homo sapiens
gaaacaggaaagcccctggatgaa

SEQ ID NO: 957 - DNA, 24 bp, Homo sapiens
ggaaacaggaaagcccctggatga

SEQ ID NO: 958 - DNA, 24 bp, Homo sapiens
aaacaggaaagcccctggatgaaa

SEQ ID NO: 959 - DNA, 24 bp, Homo sapiens
ccaaagacataacctcagacacat

SEQ ID NO: 960 - DNA, 24 bp, Homo sapiens
tctacagagaggaactgaagagag

SEQ ID NO: 961 - DNA, 24 bp, Homo sapiens
gtctacagagaggaactgaagaga

SEQ ID NO: 962 - DNA, 24 bp, Homo sapiens
ctacagagaggaactgaagagaga

SEQ ID NO: 963 - DNA, 24 bp, Homo sapiens
tggttaaaggtgtggatgaagcaa

SEQ ID NO: 964 - DNA, 26 bp, Homo sapiens
ttggtgtgaatgaagacttggctgat

SEQ ID NO: 965 - DNA, 24 bp, Homo sapiens
acagatggggcacggatgaagaca

SEQ ID NO: 966 - DNA, 24 bp, Homo sapiens
aaaggacattgtggacagcataaa

SEQ ID NO: 967 - DNA, 24 bp, Homo sapiens
gccatagttaattgtgtgaggaac

SEQ ID NO: 968 - DNA, 25 bp, Homo sapiens
agtcagaacttcgcattaacaaagc

SEQ ID NO: 969 - DNA, 25 bp, Homo sapiens
ggctgattctggagagtatatgtgc

SEQ ID NO: 970 - DNA, 25 bp, Homo sapiens
aatgacagtgcctctgccaatatca

SEQ ID NO: 971 - DNA, 25 bp, Homo sapiens
tggagcaagatgtactgagaatgtg

SEQ ID NO: 972 - DNA, 24 bp, Homo sapiens
tgcctctgccaatatcaccatcgt

SEQ ID NO: 973 - DNA, 25 bp, Homo sapiens
ggtatgccagcctcaactgaaggag

SEQ ID NO: 974 - DNA, 25 bp, Homo sapiens
tcatctacatctacatccaccactg

SEQ ID NO: 975 - DNA, 24 bp, Homo sapiens
cctccttgtggtcggcatcatgtg

SEQ ID NO: 976 - DNA, 25 bp, Homo sapiens
cgtcatctccagtgagcatattgtt

SEQ ID NO: 977 - DNA, 25 bp, Homo sapiens
ccaccagtcactatacttccacagc

SEQ ID NO: 978 - DNA, 25 bp, Homo sapiens
caccagtcactatacttccacagcc

SEQ ID NO: 979 - DNA, 24 bp, Homo sapiens
tggagcaacggacacactgaaagc

SEQ ID NO: 980 - DNA, 25 bp, Homo sapiens
actctgtaatcgtgatgtcatccgt

SEQ ID NO: 981 - DNA, 23 bp, Homo sapiens
aacgagatcatcactggtatgcc

SEQ ID NO: 982 - DNA, 23 bp, Homo sapiens
tggtgatcgctgccaaaactacg

SEQ ID NO: 983 - DNA, 25 bp, Homo sapiens
agccatcttgtaaaatgtgcggaga

SEQ ID NO: 984 - DNA, 23 bp, Homo sapiens
cccctcgagatacttgtgcaagt

SEQ ID NO: 985 - DNA, 25 bp, Homo sapiens
gggagtgcttcatggtgaaagacct

SEQ ID NO: 986 - DNA, 24 bp, Homo sapiens
ctggtgatcgctgccaaaactacg

SEQ ID NO: 987 - DNA, 24 bp, Homo sapiens
agttgtgcttcagatcaagtggaa

SEQ ID NO: 988 - DNA, 25 bp, Homo sapiens
aagccttaagcagtctcttgaggag

SEQ ID NO: 989 - DNA, 25 bp, Homo sapiens
tcaacaggaatagagaacacaacga

SEQ ID NO: 990 - DNA, 24 bp, Homo sapiens
acctcctccctaatgctcaccttt

SEQ ID NO: 991 - DNA, 24 bp, Homo sapiens
tctgaaccctttcgctggctttcc

SEQ ID NO: 992 - DNA, 25 bp, Homo sapiens
atcctcctgttctgaaaccttagtt

SEQ ID NO: 993 - DNA, 24 bp, Homo sapiens
agatatttgttggtggctttggtg

SEQ ID NO: 994 - DNA, 24 bp, Homo sapiens
aagatatttgttggtggctttggt

SEQ ID NO: 995 - DNA, 24 bp, Homo sapiens
gatatttgttggtggctttggtgg

SEQ ID NO: 996 - DNA, 24 bp, Homo sapiens
ccagacctacacgcgctaccagac

SEQ ID NO: 997 - DNA, 24 bp, Homo sapiens
gccgacgaggaggacgatgatgaa

SEQ ID NO: 998 - DNA, 24 bp, Homo sapiens
cggacagtcggaaaagcgtcttta

SEQ ID NO: 999 - DNA, 24 bp, Homo sapiens
gcgcctgccccggtaccagtacct

SEQ ID NO: 1000 - DNA, 24 bp, Homo sapiens
cgcgcctgccccggtaccagtacc

SEQ ID NO: 1001 - DNA, 24 bp, Homo sapiens
cgcctgccccggtaccagtacctg

SEQ ID NO: 1002 - DNA, 24 bp, Homo sapiens
atggacgaactgctggagctatgc

SEQ ID NO: 1003 - DNA, 25 bp, Homo sapiens
cagagtgagtgacttggagctggaa

SEQ ID NO: 1004 - DNA, 25 bp, Homo sapiens
aatggaaggatctgatggtcatgct

SEQ ID NO: 1005 - DNA, 24 bp, Homo sapiens
cgagcacaactgggagacctccca

SEQ ID NO: 1006 - DNA, 24 bp, Homo sapiens
gcgagcacaactgggagacctccc

SEQ ID NO: 1007 - DNA, 24 bp, Homo sapiens
gagcacaactgggagacctcccat

SEQ ID NO: 1008 - DNA, 24 bp, Homo sapiens
aggatttcgctgatgtggtttgtt

SEQ ID NO: 1009 - DNA, 24 bp, Homo sapiens
tggtgaggtggactgcattacagg

SEQ ID NO: 1010 - DNA, 24 bp, Homo sapiens
gaggaaagcgagcacaactgggag

SEQ ID NO: 1011 - DNA, 24 bp, Homo sapiens
tctttcagtgtgtgaatgggaaat

SEQ ID NO: 1012 - DNA, 24 bp, Homo sapiens
tttctcagatgaaagcctgtgatg

SEQ ID NO: 1013 - DNA, 24 bp, Homo sapiens
tcaatgattgtggagaccaaagtg

SEQ ID NO: 1014 - DNA, 24 bp, Homo sapiens
cacagaaagcagattctccaatgg

SEQ ID NO: 1015 - DNA, 24 bp, Homo sapiens
acacagaaagcagattctccaatg

SEQ ID NO: 1016 - DNA, 24 bp, Homo sapiens
acagaaagcagattctccaatgga

SEQ ID NO: 1017 - DNA, 24 bp, Homo sapiens
tgtgttgtaaagcatgccaaggca

SEQ ID NO: 1018 - DNA, 24 bp, Homo sapiens
ctgtgttgtaaagcatgccaaggc

SEQ ID NO: 1019 - DNA, 24 bp, Homo sapiens
gtgttgtaaagcatgccaaggcaa

SEQ ID NO: 1020 - DNA, 24 bp, Homo sapiens
caaatcgggtgtttgcattccaag

SEQ ID NO: 1021 - DNA, 24 bp, Homo sapiens
tcaatgcaatggtgaggtggactg

SEQ ID NO: 1022 - DNA, 24 bp, Homo sapiens
aggggaagatgaagttggctgtgc

SEQ ID NO: 1023 - DNA, 24 bp, Homo sapiens
catgccaaggcaaaggcttccatt

SEQ ID NO: 1024 - DNA, 24 bp, Homo sapiens
cgggtgtttgcattccaagccagt

SEQ ID NO: 1025 - DNA, 24 bp, Homo sapiens
agtaccagatcatgccacaggtcc

SEQ ID NO: 1026 - DNA, 24 bp, Homo sapiens
aattcagaatggattgatgcctgc

SEQ ID NO: 1027 - DNA, 24 bp, Homo sapiens
gggtcagagttaaagccagggttg

SEQ ID NO: 1028 - DNA, 24 bp, Homo sapiens
cgcaagtagagggagtgcaggaaa

SEQ ID NO: 1029 - DNA, 25 bp, Homo sapiens
ggacagttcagagatcaggatcagc

SEQ ID NO: 1030 - DNA, 24 bp, Homo sapiens
aaccaagagacacaattacgcagg

SEQ ID NO: 1031 - DNA, 24 bp, Homo sapiens
gaagcagagggacaaccagaaggc

SEQ ID NO: 1032 - DNA, 24 bp, Homo sapiens
tgtctgctctgcatatatgtctct

SEQ ID NO: 1033 - DNA, 24 bp, Homo sapiens
ctgtctgctctgcatatatgtctc

SEQ ID NO: 1034 - DNA, 24 bp, Homo sapiens
gtctgctctgcatatatgtctctt

SEQ ID NO: 1035 - DNA, 25 bp, Homo sapiens
ataaaggaaaatgacttgtaaggtc

SEQ ID NO: 1036 - DNA, 24 bp, Homo sapiens
tcctggcctcagagcttcctgggg

SEQ ID NO: 1037 - DNA, 24 bp, Homo sapiens
ttcctggcctcagagcttcctggg

SEQ ID NO: 1038 - DNA, 24 bp, Homo sapiens
cctggcctcagagcttcctgggga

SEQ ID NO: 1039 - DNA, 23 bp, Homo sapiens
cagctccaccactgtgcacttag

SEQ ID NO: 1040 - DNA, 25 bp, Homo sapiens
ggcaacagaaaccaagagacacaat

SEQ ID NO: 1041 - DNA, 24 bp, Homo sapiens
ataagtcctttcaattccaccagg

SEQ ID NO: 1042 - DNA, 24 bp, Homo sapiens
cataagtcctttcaattccaccag

SEQ ID NO: 1043 - DNA, 24 bp, Homo sapiens
taagtcctttcaattccaccaggg

SEQ ID NO: 1044 - DNA, 24 bp, Homo sapiens
tatttagaagcagagggacaacca

SEQ ID NO: 1045 - DNA, 24 bp, Homo sapiens
gtatttagaagcagagggacaacc

SEQ ID NO: 1046 - DNA, 24 bp, Homo sapiens
atttagaagcagagggacaaccag

SEQ ID NO: 1047 - DNA, 25 bp, Homo sapiens
gtcagccttgacctaatgaggtagc

SEQ ID NO: 1048 - DNA, 23 bp, Homo sapiens
tgcagcccaaggacagttcagag

SEQ ID NO: 1049 - DNA, 23 bp, Homo sapiens
atcagctttgaaggctggattct

SEQ ID NO: 1050 - DNA, 25 bp, Homo sapiens
acactctcttctccattccctagca

SEQ ID NO: 1051 - DNA, 24 bp, Homo sapiens
gcccacggtttcagctagacaatg

SEQ ID NO: 1052 - DNA, 23 bp, Homo sapiens
cctggaccacgaggctgattcct

SEQ ID NO: 1053 - DNA, 24 bp, Homo sapiens
gagattttgcagtttatcctgagt

SEQ ID NO: 1054 - DNA, 24 bp, Homo sapiens
tgagattttgcagtttatcctgag

SEQ ID NO: 1055 - DNA, 24 bp, Homo sapiens
agattttgcagtttatcctgagtg

SEQ ID NO: 1056 - DNA, 24 bp, Homo sapiens
tctggagtgttcatgtgttatgcc

SEQ ID NO: 1057 - DNA, 24 bp, Homo sapiens
aacctgaacaccagcagtggatct

SEQ ID NO: 1058 - DNA, 24 bp, Homo sapiens
gcaccgaaggaggcacttacacat

SEQ ID NO: 1059 - DNA, 24 bp, Homo sapiens
agatgctctgcttctgtactgcca

SEQ ID NO: 1060 - DNA, 24 bp, Homo sapiens
aatggcacggttgaatgtaaggct

SEQ ID NO: 1061 - DNA, 24 bp, Homo sapiens
ttgtgtctgtgtccaaagcaagct

SEQ ID NO: 1062 - DNA, 24 bp, Homo sapiens
gggaagaattcacagtgacgtgca

SEQ ID NO: 1063 - DNA, 24 bp, Homo sapiens
gtgtctagttctgtgtactcaacg

SEQ ID NO: 1064 - DNA, 24 bp, Homo sapiens
gaaaacagtcagactaaactacag

SEQ ID NO: 1065 - DNA, 24 bp, Homo sapiens
agaaaacagtcagactaaactaca

SEQ ID NO: 1066 - DNA, 24 bp, Homo sapiens
aaaacagtcagactaaactacagg

SEQ ID NO: 1067 - DNA, 24 bp, Homo sapiens
ggacttgaggtttattcctgaccc

SEQ ID NO: 1068 - DNA, 24 bp, Homo sapiens
accatcggctctgtctgcattgtt

SEQ ID NO: 1069 - DNA, 24 bp, Homo sapiens
ccaggagggcaagtcagtgctgtc

SEQ ID NO: 1070 - DNA, 24 bp, Homo sapiens
gctggcatcacggtgacttcaatt

SEQ ID NO: 1071 - DNA, 24 bp, Homo sapiens
cgttgactatcagttcagcgagag

SEQ ID NO: 1072 - DNA, 24 bp, Homo sapiens
tgtttgttagagatcctgccaagc

SEQ ID NO: 1073 - DNA, 24 bp, Homo sapiens
gtgtttgttagagatcctgccaag

SEQ ID NO: 1074 - DNA, 24 bp, Homo sapiens
gtttgttagagatcctgccaagct

SEQ ID NO: 1075 - DNA, 24 bp, Homo sapiens
ccgtctccaccatccatccatcca

SEQ ID NO: 1076 - DNA, 24 bp, Homo sapiens
ggcgacgagattaggctgttatgc

SEQ ID NO: 1077 - DNA, 24 bp, Homo sapiens
aagcagaatgaatggatcacggaa

SEQ ID NO: 1078 - DNA, 24 bp, Homo sapiens
aagaagacaacgacacgctggtcc

SEQ ID NO: 1079 - DNA, 24 bp, Homo sapiens
acccagaagtgaccaattattccc

SEQ ID NO: 1080 - DNA, 24 bp, Homo sapiens
acagaaccttcactgataaatggg

SEQ ID NO: 1081 - DNA, 24 bp, Homo sapiens
aacgttgactatcagttcagcgag

SEQ ID NO: 1082 - DNA, 24 bp, Homo sapiens
tgattctggagtgttcatgtgtta

SEQ ID NO: 1083 - DNA, 24 bp, Homo sapiens
aatacttttggatcagcaaatgtc

SEQ ID NO: 1084 - DNA, 24 bp, Homo sapiens
tacgacaggctcgtgaatggcatg

SEQ ID NO: 1085 - DNA, 24 bp, Homo sapiens
agcaggattcccagagcccacaat

SEQ ID NO: 1086 - DNA, 24 bp, Homo sapiens
tttttgtccaggaactgagcagag

SEQ ID NO: 1087 - DNA, 24 bp, Homo sapiens
cactcctttgctgattggtttcgt

SEQ ID NO: 1088 - DNA, 24 bp, Homo sapiens
acagtggaaggttgttgaggagat

SEQ ID NO: 1089 - DNA, 24 bp, Homo sapiens
acatagacccaacacaacttcctt

SEQ ID NO: 1090 - DNA, 24 bp, Homo sapiens
ggctgagttttgggaaaaccctgg

SEQ ID NO: 1091 - DNA, 24 bp, Homo sapiens
aggctgagttttgggaaaaccctg

SEQ ID NO: 1092 - DNA, 24 bp, Homo sapiens
gctgagttttgggaaaaccctggg

SEQ ID NO: 1093 - DNA, 24 bp, Homo sapiens
ccgtttggaaagctagtggttcag

SEQ ID NO: 1094 - DNA, 24 bp, Homo sapiens
gctttcgggaaggttgttgaggca

SEQ ID NO: 1095 - DNA, 24 bp, Homo sapiens
agccgagtgcccatttgacagaac

SEQ ID NO: 1096 - DNA, 24 bp, Homo sapiens
attgtgaatctacttggagcctgc

SEQ ID NO: 1097 - DNA, 24 bp, Homo sapiens
ttggtgctgttgaggaggagctga

SEQ ID NO: 1098 - DNA, 24 bp, Homo sapiens
ttgaccagtgtaaatctgacctgc

SEQ ID NO: 1099 - DNA, 24 bp, Homo sapiens
tggatcgtaagaaggcagttgacc

SEQ ID NO: 1100 - DNA, 24 bp, Homo sapiens
atatcccaacaggtacgacaccac

SEQ ID NO: 1101 - DNA, 24 bp, Homo sapiens
gatatcccaacaggtacgacacca

SEQ ID NO: 1102 - DNA, 24 bp, Homo sapiens
tatcccaacaggtacgacaccaca

SEQ ID NO: 1103 - DNA, 24 bp, Homo sapiens
actccagcagcagtgggggtgtcg

SEQ ID NO: 1104 - DNA, 24 bp, Homo sapiens
gggctctggcttcagtgcaagcag

SEQ ID NO: 1105 - DNA, 24 bp, Homo sapiens
gggtagcagctccagcgtcaaatt

SEQ ID NO: 1106 - DNA, 24 bp, Homo sapiens
gtcttgccggaggtagcagtggaa

SEQ ID NO: 1107 - DNA, 24 bp, Homo sapiens
ggtcttgccggaggtagcagtgga

SEQ ID NO: 1108 - DNA, 24 bp, Homo sapiens
tcttgccggaggtagcagtggaag

SEQ ID NO: 1109 - DNA, 24 bp, Homo sapiens
tgctgcaagtcactgccttccaag

SEQ ID NO: 1110 - DNA, 24 bp, Homo sapiens
tttgtctccaccacctcctcctcc

SEQ ID NO: 1111 - DNA, 24 bp, Homo sapiens
gctaagaacctgctgcaagtcact

SEQ ID NO: 1112 - DNA, 24 bp, Homo sapiens
cctcttctaggcagttgctcaagc

SEQ ID NO: 1113 - DNA, 24 bp, Homo sapiens
gtggagaaggagttggaccagtca

SEQ ID NO: 1114 - DNA, 24 bp, Homo sapiens
cgaggaatgcagactcagtggaga

SEQ ID NO: 1115 - DNA, 24 bp, Homo sapiens
gcgaggaatgcagactcagtggag

SEQ ID NO: 1116 - DNA, 24 bp, Homo sapiens
gaggaatgcagactcagtggagaa

SEQ ID NO: 1117 - DNA, 24 bp, Homo sapiens
gcgtaccactgctgagaatgagtt

SEQ ID NO: 1118 - DNA, 24 bp, Homo sapiens
gctgaagaaggatgtagatgctgc

SEQ ID NO: 1119 - DNA, 24 bp, Homo sapiens
atgctgaagaaggatgtagatgct

SEQ ID NO: 1120 - DNA, 24 bp, Homo sapiens
gatgctgaagaaggatgtagatgc

SEQ ID NO: 1121 - DNA, 24 bp, Homo sapiens
tgctgaagaaggatgtagatgctg

SEQ ID NO: 1122 - DNA, 24 bp, Homo sapiens
tcaacaagcgtaccactgctgaga

SEQ ID NO: 1123 - DNA, 24 bp, Homo sapiens
tgacacctcagtggtcctctccat

SEQ ID NO: 1124 - DNA, 24 bp, Homo sapiens
caaccgcaacctggacctggatag

SEQ ID NO: 1125 - DNA, 24 bp, Homo sapiens
cagtatgaggagattgccaaccgc

SEQ ID NO: 1126 - DNA, 24 bp, Homo sapiens
cagaacctggagccgttgttcgag

SEQ ID NO: 1127 - DNA, 24 bp, Homo sapiens
atcaacaacctcaggaggcagctg

SEQ ID NO: 1128 - DNA, 24 bp, Homo sapiens
gctgagaaacatgcaggacctggt

SEQ ID NO: 1129 - DNA, 24 bp, Homo sapiens
gtgctggtgctggaggcggctatg

SEQ ID NO: 1130 - DNA, 24 bp, Homo sapiens
ctggtggtggctttgggctcggtg

SEQ ID NO: 1131 - DNA, 24 bp, Homo sapiens
ctggctttggaggtggcttcggtg

SEQ ID NO: 1132 - DNA, 24 bp, Homo sapiens
aggacctggtggaagacttcaaga

SEQ ID NO: 1133 - DNA, 24 bp, Homo sapiens
gtcaagaaacagtgcgccaatctg

SEQ ID NO: 1134 - DNA, 24 bp, Homo sapiens
tgtcaagaaacagtgcgccaatct

SEQ ID NO: 1135 - DNA, 24 bp, Homo sapiens
tcaagaaacagtgcgccaatctgc

SEQ ID NO: 1136 - DNA, 24 bp, Homo sapiens
ctttggaggtggcttcggtggccc

SEQ ID NO: 1137 - DNA, 24 bp, Homo sapiens
gctttggaggtggcttcggtggcc

SEQ ID NO: 1138 - DNA, 24 bp, Homo sapiens
tttggaggtggcttcggtggccct

SEQ ID NO: 1139 - DNA, 24 bp, Homo sapiens
gaggtatccaagaggtcactgtca

SEQ ID NO: 1140 - DNA, 24 bp, Homo sapiens
tccatcagcactagaggaggcagc

SEQ ID NO: 1141 - DNA, 24 bp, Homo sapiens
ggtagtggatttggtttcggcggt

SEQ ID NO: 1142 - DNA, 24 bp, Homo sapiens
ttcatcgacaaggtgcggtttctg

SEQ ID NO: 1143 - DNA, 24 bp, Homo sapiens
cttcatcgacaaggtgcggtttct

SEQ ID NO: 1144 - DNA, 24 bp, Homo sapiens
tcatcgacaaggtgcggtttctgg

SEQ ID NO: 1145 - DNA, 24 bp, Homo sapiens
caggtcaacgtggagatggatgcc

SEQ ID NO: 1146 - DNA, 24 bp, Homo sapiens
ggcagagatgagggagcagtacga

SEQ ID NO: 1147 - DNA, 23 bp, Homo sapiens
gaaccgccgggatgctgaggaat

SEQ ID NO: 1148 - DNA, 24 bp, Homo sapiens
gaggaggccaacgctgacctggag

SEQ ID NO: 1149 - DNA, 24 bp, Homo sapiens
ggaggaggccaacgctgacctgga

SEQ ID NO: 1150 - DNA, 24 bp, Homo sapiens
aggaggccaacgctgacctggagg

SEQ ID NO: 1151 - DNA, 23 bp, Homo sapiens
ctatggaggcggcgtgagctgtg

SEQ ID NO: 1152 - DNA, 23 bp, Homo sapiens
tggtagtggctttggaggtggct

SEQ ID NO: 1153 - DNA, 23 bp, Homo sapiens
ttggaggtggctatggaggtggc

SEQ ID NO: 1154 - DNA, 23 bp, Homo sapiens
gaggtgaagatccgtgactggca

SEQ ID NO: 1155 - DNA, 24 bp, Homo sapiens
gacaagatcctgaccgccaccatt

SEQ ID NO: 1156 - DNA, 23 bp, Homo sapiens
tcatcctggagattgacaatgcc

SEQ ID NO: 1157 - DNA, 24 bp, Homo sapiens
tcatcctggagattgacaatgcca

SEQ ID NO: 1158 - DNA, 24 bp, Homo sapiens
ccagttctcctctggatcgcagtc

SEQ ID NO: 1159 - DNA, 24 bp, Homo sapiens
catccagagatgtgacctcctcca

SEQ ID NO: 1160 - DNA, 24 bp, Homo sapiens
tcatccagagatgtgacctcctcc

SEQ ID NO: 1161 - DNA, 24 bp, Homo sapiens
atccagagatgtgacctcctccag

SEQ ID NO: 1162 - DNA, 24 bp, Homo sapiens
tggcagagaagaaccgcaaggatg

SEQ ID NO: 1163 - DNA, 24 bp, Homo sapiens
caggagatgattggcagcgtggag

SEQ ID NO: 1164 - DNA, 24 bp, Homo sapiens
ggagcagcagaaccaggagtacaa

SEQ ID NO: 1165 - DNA, 24 bp, Homo sapiens
atccgcaccaaggtcatggatgtg

SEQ ID NO: 1166 - DNA, 24 bp, Homo sapiens
tgtccacccacgagcaggtccttc

SEQ ID NO: 1167 - DNA, 24 bp, Homo sapiens
ttcttcaccaagacagaggagctg

SEQ ID NO: 1168 - DNA, 24 bp, Homo sapiens
gttcttcaccaagacagaggagct

SEQ ID NO: 1169 - DNA, 24 bp, Homo sapiens
tcttcaccaagacagaggagctga

SEQ ID NO: 1170 - DNA, 24 bp, Homo sapiens
tgtcaatgtggagatggacgctgc

SEQ ID NO: 1171 - DNA, 24 bp, Homo sapiens
gacctgagccgcattctgaacgag

SEQ ID NO: 1172 - DNA, 24 bp, Homo sapiens
ctggagaacagcctggaggagacc

SEQ ID NO: 1173 - DNA, 24 bp, Homo sapiens
gaacagcctggaggagaccaaagg

SEQ ID NO: 1174 - DNA, 24 bp, Homo sapiens
cagctcagcatgaaagcatccctg

SEQ ID NO: 1175 - DNA, 24 bp, Homo sapiens
ccagctcagcatgaaagcatccct

SEQ ID NO: 1176 - DNA, 24 bp, Homo sapiens
agctcagcatgaaagcatccctgg

SEQ ID NO: 1177 - DNA, 24 bp, Homo sapiens
cgctactgcatgcagctggcccag

SEQ ID NO: 1178 - DNA, 24 bp, Homo sapiens
tcgctactgcatgcagctggccca

SEQ ID NO: 1179 - DNA, 24 bp, Homo sapiens
gctactgcatgcagctggcccaga

SEQ ID NO: 1180 - DNA, 24 bp, Homo sapiens
caccaagacagaggagctgaaccg

SEQ ID NO: 1181 - DNA, 24 bp, Homo sapiens
catgcagaacctggagattgagct

SEQ ID NO: 1182 - DNA, 24 bp, Homo sapiens
ctggcttgggtggtggctttggtg

SEQ ID NO: 1183 - DNA, 24 bp, Homo sapiens
gctggcttgggtggtggctttggt

SEQ ID NO: 1184 - DNA, 24 bp, Homo sapiens
tggcttgggtggtggctttggtgg

SEQ ID NO: 1185 - DNA, 24 bp, Homo sapiens
agaccattgaggacctgaggaaca

SEQ ID NO: 1186 - DNA, 24 bp, Homo sapiens
tccgcaccaagtatgagacagagt

SEQ ID NO: 1187 - DNA, 24 bp, Homo sapiens
ctgaggaacaagattctcacagcc

SEQ ID NO: 1188 - DNA, 24 bp, Homo sapiens
cctgaggaacaagattctcacagc

SEQ ID NO: 1189 - DNA, 24 bp, Homo sapiens
tgaggaacaagattctcacagcca

SEQ ID NO: 1190 - DNA, 24 bp, Homo sapiens
cttccgcaccaagtatgagacaga

SEQ ID NO: 1191 - DNA, 24 bp, Homo sapiens
acttccgcaccaagtatgagacag

SEQ ID NO: 1192 - DNA, 24 bp, Homo sapiens
ttccgcaccaagtatgagacagag

SEQ ID NO: 1193 - DNA, 24 bp, Homo sapiens
ctttgctggtggtgatgggcttct

SEQ ID NO: 1194 - DNA, 24 bp, Homo sapiens
caacgccgacctggaagtgaagat

SEQ ID NO: 1195 - DNA, 24 bp, Homo sapiens
gagtgtggaagccgacatcaatgg

SEQ ID NO: 1196 - DNA, 24 bp, Homo sapiens
ggtgctggacgaactgaccctggc

SEQ ID NO: 1197 - DNA, 24 bp, Homo sapiens
gacaatgccaatgtccttctgcag

SEQ ID NO: 1198 - DNA, 24 bp, Homo sapiens
tgcccgtctggccgcggatgactt

SEQ ID NO: 1199 - DNA, 24 bp, Homo sapiens
atgcccgtctggccgcggatgact

SEQ ID NO: 1200 - DNA, 24 bp, Homo sapiens
gcccgtctggccgcggatgacttc

SEQ ID NO: 1201 - DNA, 24 bp, Homo sapiens
gcatgagtgtggaagccgacatca

SEQ ID NO: 1202 - DNA, 24 bp, Homo sapiens
tgcgcagggtgctggacgaactga

SEQ ID NO: 1203 - DNA, 24 bp, Homo sapiens
acagccacagtggacaatgccaat

SEQ ID NO: 1204 - DNA, 24 bp, Homo sapiens
gccaatgtccttctgcagattgac

SEQ ID NO: 1205 - DNA, 24 bp, Homo sapiens
tgccaatgtccttctgcagattga

SEQ ID NO: 1206 - DNA, 24 bp, Homo sapiens
ccaatgtccttctgcagattgaca

SEQ ID NO: 1207 - DNA, 24 bp, Homo sapiens
ctgtctcatcctcccgcttctcct

SEQ ID NO: 1208 - DNA, 24 bp, Homo sapiens
gtgctggcttgggtggtggctttg

SEQ ID NO: 1209 - DNA, 24 bp, Homo sapiens
cctggacaaggtgcgtgctctgga

SEQ ID NO: 1210 - DNA, 24 bp, Homo sapiens
atcacagacctgagacgcacgatg

SEQ ID NO: 1211 - DNA, 24 bp, Homo sapiens
cgatgcgagatggaggctcagaac

SEQ ID NO: 1212 - DNA, 24 bp, Homo sapiens
gcaggagatcgctacttaccgcag

SEQ ID NO: 1213 - DNA, 24 bp, Homo sapiens
aaccacgaagaggagatgaaggag

SEQ ID NO: 1214 - DNA, 24 bp, Homo sapiens
gaaccacgaagaggagatgaagga

SEQ ID NO: 1215 - DNA, 24 bp, Homo sapiens
accacgaagaggagatgaaggagt

SEQ ID NO: 1216 - DNA, 24 bp, Homo sapiens
gctgcggacgacttcaggctcaag

SEQ ID NO: 1217 - DNA, 24 bp, Homo sapiens
tgaggctgacatcaacggcttgcg

SEQ ID NO: 1218 - DNA, 24 bp, Homo sapiens
ccagaatgcgactacagccaatac

SEQ ID NO: 1219 - DNA, 24 bp, Homo sapiens
atggctggcattggcatcagggaa

SEQ ID NO: 1220 - DNA, 24 bp, Homo sapiens
ccaggatgccaagatggctggcat

SEQ ID NO: 1221 - DNA, 24 bp, Homo sapiens
gccaggatgccaagatggctggca

SEQ ID NO: 1222 - DNA, 24 bp, Homo sapiens
caggatgccaagatggctggcatt

SEQ ID NO: 1223 - DNA, 24 bp, Homo sapiens
gcatcagggaagcctcttcaggag

SEQ ID NO: 1224 - DNA, 24 bp, Homo sapiens
ggcatcagggaagcctcttcagga

SEQ ID NO: 1225 - DNA, 24 bp, Homo sapiens
catcagggaagcctcttcaggagg

SEQ ID NO: 1226 - DNA, 24 bp, Homo sapiens
gatgctgcttgacataaagacacg

SEQ ID NO: 1227 - DNA, 24 bp, Homo sapiens
gtagcagcagcaatttccacatca

SEQ ID NO: 1228 - DNA, 24 bp, Homo sapiens
agagtcagtggatggacaggtggt

SEQ ID NO: 1229 - DNA, 24 bp, Homo sapiens
aggtggaagccgaagtatctcagc

SEQ ID NO: 1230 - DNA, 24 bp, Homo sapiens
tcagggtcaggaggaggatatggg

SEQ ID NO: 1231 - DNA, 24 bp, Homo sapiens
cttcaggctcaagtatgagaatga

SEQ ID NO: 1232 - DNA, 24 bp, Homo sapiens
acttcaggctcaagtatgagaatg

SEQ ID NO: 1233 - DNA, 24 bp, Homo sapiens
ttcaggctcaagtatgagaatgag

SEQ ID NO: 1234 - DNA, 24 bp, Homo sapiens
atcatggccaccaccatcgacaac

SEQ ID NO: 1235 - DNA, 24 bp, Homo sapiens
gtcatcctggagatcgacaatgcc

SEQ ID NO: 1236 - DNA, 24 bp, Homo sapiens
agcctacctgaagaagaaccacga

SEQ ID NO: 1237 - DNA, 24 bp, Homo sapiens
gtcaatgtggagatggacgcagca

SEQ ID NO: 1238 - DNA, 24 bp, Homo sapiens
ggtcatcctggagatcgacaatgc

SEQ ID NO: 1239 - DNA, 24 bp, Homo sapiens
ctccgggacaagatcatggccacc

SEQ ID NO: 1240 - DNA, 24 bp, Homo sapiens
gctccgggacaagatcatggccac

SEQ ID NO: 1241 - DNA, 24 bp, Homo sapiens
tccgggacaagatcatggccacca

SEQ ID NO: 1242 - DNA, 24 bp, Homo sapiens
atgagggtctgtggctttggtgga

SEQ ID NO: 1243 - DNA, 24 bp, Homo sapiens
tacctggacaaggtacgtgccctg

SEQ ID NO: 1244 - DNA, 24 bp, Homo sapiens
ctacctggacaaggtacgtgccct

SEQ ID NO: 1245 - DNA, 24 bp, Homo sapiens
acctggacaaggtacgtgccctgg

SEQ ID NO: 1246 - DNA, 24 bp, Homo sapiens
attaccatgcagaacctcaatgac

SEQ ID NO: 1247 - DNA, 24 bp, Homo sapiens
aattaccatgcagaacctcaatga

SEQ ID NO: 1248 - DNA, 24 bp, Homo sapiens
ttaccatgcagaacctcaatgacc

SEQ ID NO: 1249 - DNA, 24 bp, Homo sapiens
tggtggtctcctctctggcaatga

SEQ ID NO: 1250 - DNA, 24 bp, Homo sapiens
ttcttctgctaggtttgtctcttc

SEQ ID NO: 1251 - DNA, 24 bp, Homo sapiens
cttcttctgctaggtttgtctctt

SEQ ID NO: 1252 - DNA, 24 bp, Homo sapiens
tcttctgctaggtttgtctcttca

SEQ ID NO: 1253 - DNA, 24 bp, Homo sapiens
gccaatgctgacctggaggtgaag

SEQ ID NO: 1254 - DNA, 24 bp, Homo sapiens
accattgaagagctccgggacaag

SEQ ID NO: 1255 - DNA, 24 bp, Homo sapiens
gccaccaccatcgacaactcccgg

SEQ ID NO: 1256 - DNA, 24 bp, Homo sapiens
actcccgggtcatcctggagatcg

SEQ ID NO: 1257 - DNA, 24 bp, Homo sapiens
aactcccgggtcatcctggagatc

SEQ ID NO: 1258 - DNA, 24 bp, Homo sapiens
ctcccgggtcatcctggagatcga

SEQ ID NO: 1259 - DNA, 24 bp, Homo sapiens
ctggctgcggacgacttcaggctc

SEQ ID NO: 1260 - DNA, 24 bp, Homo sapiens
tggtggcgatggtggtctcctctc

SEQ ID NO: 1261 - DNA, 24 bp, Homo sapiens
gactggtaccagaagcagacccca

SEQ ID NO: 1262 - DNA, 24 bp, Homo sapiens
tacctggacaaggtgcgtgctctg

SEQ ID NO: 1263 - DNA, 24 bp, Homo sapiens
ctacctggacaaggtgcgtgctct

SEQ ID NO: 1264 - DNA, 24 bp, Homo sapiens
acctggacaaggtgcgtgctctgg

SEQ ID NO: 1265 - DNA, 24 bp, Homo sapiens
gcagccgatgacttcaggaccaag

SEQ ID NO: 1266 - DNA, 24 bp, Homo sapiens
gaaccacgaggaggagatgcttgc

SEQ ID NO: 1267 - DNA, 24 bp, Homo sapiens
gatgggcttctggtgggcagtgag

SEQ ID NO: 1268 - DNA, 24 bp, Homo sapiens
catgcagaacctcaatgaccgcct

SEQ ID NO: 1269 - DNA, 24 bp, Homo sapiens
ccaacgccgacctggaagtgaaga

SEQ ID NO: 1270 - DNA, 24 bp, Homo sapiens
gggtgctggctttggtggtggttt

SEQ ID NO: 1271 - DNA, 24 bp, Homo sapiens
tgggtgctggctttggtggtggtt

SEQ ID NO: 1272 - DNA, 24 bp, Homo sapiens
ggtgctggctttggtggtggtttt

SEQ ID NO: 1273 - DNA, 24 bp, Homo sapiens
actggtaccagaggcagcggccca

SEQ ID NO: 1274 - DNA, 24 bp, Homo sapiens
gactggtaccagaggcagcggccc

SEQ ID NO: 1275 - DNA, 24 bp, Homo sapiens
ctggtaccagaggcagcggcccag

SEQ ID NO: 1276 - DNA, 24 bp, Homo sapiens
ggcaacctggcggagacagagaac

SEQ ID NO: 1277 - DNA, 24 bp, Homo sapiens
ggagcagcagaaccaggaatacaa

SEQ ID NO: 1278 - DNA, 24 bp, Homo sapiens
agaaccggtgaccacccgtcaggt

SEQ ID NO: 1279 - DNA, 24 bp, Homo sapiens
ttgtggaagaggtccaggatggca

SEQ ID NO: 1280 - DNA, 24 bp, Homo sapiens
tctcctcccgcgagcaggtccacc

SEQ ID NO: 1281 - DNA, 24 bp, Homo sapiens
caggggctgattggcagcgtggag

SEQ ID NO: 1282 - DNA, 24 bp, Homo sapiens
ccaggggctgattggcagcgtgga

SEQ ID NO: 1283 - DNA, 24 bp, Homo sapiens
aggggctgattggcagcgtggagg

SEQ ID NO: 1284 - DNA, 24 bp, Homo sapiens
atcaatgtggagatggacgctgcc

SEQ ID NO: 1285 - DNA, 24 bp, Homo sapiens
agcaagacagaggaactgaaccgc

SEQ ID NO: 1286 - DNA, 24 bp, Homo sapiens
atgcaggccttggagatagagctg

SEQ ID NO: 1287 - DNA, 24 bp, Homo sapiens
gagtgagatctcggagctccggcg

SEQ ID NO: 1288 - DNA, 24 bp, Homo sapiens
agagtgagatctcggagctccggc

SEQ ID NO: 1289 - DNA, 24 bp, Homo sapiens
agtgagatctcggagctccggcgc

SEQ ID NO: 1290 - DNA, 24 bp, Homo sapiens
aaccacgaggaggagatgaacgcc

SEQ ID NO: 1291 - DNA, 24 bp, Homo sapiens
gaaccacgaggaggagatgaacgc

SEQ ID NO: 1292 - DNA, 24 bp, Homo sapiens
accacgaggaggagatgaacgccc

SEQ ID NO: 1293 - DNA, 24 bp, Homo sapiens
tacctggacaaggtgcgtgccctg

SEQ ID NO: 1294 - DNA, 24 bp, Homo sapiens
ctacctggacaaggtgcgtgccct

SEQ ID NO: 1295 - DNA, 24 bp, Homo sapiens
acctggacaaggtgcgtgccctgg

SEQ ID NO: 1296 - DNA, 24 bp, Homo sapiens
gaggtgaagatccgtgactggtac

SEQ ID NO: 1297 - DNA, 24 bp, Homo sapiens
gaacaagatcctcacagccaccgt

SEQ ID NO: 1298 - DNA, 24 bp, Homo sapiens
tgccaacatcctgctacagattga

SEQ ID NO: 1299 - DNA, 24 bp, Homo sapiens
aatgaccgcctggcctcctacctg

SEQ ID NO: 1300 - DNA, 24 bp, Homo sapiens
caatgaccgcctggcctcctacct

SEQ ID NO: 1301 - DNA, 24 bp, Homo sapiens
atgaccgcctggcctcctacctgg

SEQ ID NO: 1302 - DNA, 24 bp, Homo sapiens
ggctgctggctggaggtgagaagg

SEQ ID NO: 1303 - DNA, 24 bp, Homo sapiens
ccgcctggcctcctacctggacaa

SEQ ID NO: 1304 - DNA, 24 bp, Homo sapiens
accgcctggcctcctacctggaca

SEQ ID NO: 1305 - DNA, 24 bp, Homo sapiens
cgcctggcctcctacctggacaag

SEQ ID NO: 1306 - DNA, 24 bp, Homo sapiens
gcctggcctcctacctggacaagg

SEQ ID NO: 1307 - DNA, 23 bp, Homo sapiens
atggcaaaagatgttgacgtaca

SEQ ID NO: 1308 - DNA, 25 bp, Homo sapiens
tcctgaggctgtcaattgtttagag

SEQ ID NO: 1309 - DNA, 25 bp, Homo sapiens
gtactgcattacggaatctactact

SEQ ID NO: 1310 - DNA, 23 bp, Homo sapiens
ccccgatagcatcttctgggaag

SEQ ID NO: 1311 - DNA, 24 bp, Homo sapiens
aagcagatgatggtggatcggcaa

SEQ ID NO: 1312 - DNA, 25 bp, Homo sapiens
aagaaaaaccagatataccagggac

SEQ ID NO: 1313 - DNA, 24 bp, Homo sapiens
tgcggatcgaagtgtacggatgtg

SEQ ID NO: 1314 - DNA, 24 bp, Homo sapiens
gctgccttctactattgctcctgt

SEQ ID NO: 1315 - DNA, 24 bp, Homo sapiens
gcactacagactccagcctccctt

SEQ ID NO: 1316 - DNA, 24 bp, Homo sapiens
cctgattcggatgctgtgctgatt

SEQ ID NO: 1317 - DNA, 24 bp, Homo sapiens
cagacgccagtgtcctatgaccag

SEQ ID NO: 1318 - DNA, 24 bp, Homo sapiens
aatcacagagagccacaaagcgga

SEQ ID NO: 1319 - DNA, 24 bp, Homo sapiens
gcgtgtggagcagatccgtgacca

SEQ ID NO: 1320 - DNA, 24 bp, Homo sapiens
agcgtgtggagcagatccgtgacc

SEQ ID NO: 1321 - DNA, 24 bp, Homo sapiens
cgtgtggagcagatccgtgaccac

SEQ ID NO: 1322 - DNA, 24 bp, Homo sapiens
gcagctggctgagaaacgagagca

SEQ ID NO: 1323 - DNA, 24 bp, Homo sapiens
agcagctggctgagaaacgagagc

SEQ ID NO: 1324 - DNA, 24 bp, Homo sapiens
cagctggctgagaaacgagagcac

SEQ ID NO: 1325 - DNA, 24 bp, Homo sapiens
tgggagcttatttcttcagacacc

SEQ ID NO: 1326 - DNA, 24 bp, Homo sapiens
gcaggagtccgtcagcaagaaggg

SEQ ID NO: 1327 - DNA, 24 bp, Homo sapiens
tcctcagatcgtcaagtacagtcc

SEQ ID NO: 1328 - DNA, 24 bp, Homo sapiens
ctaagtggattacccaaacaccgc

SEQ ID NO: 1329 - DNA, 24 bp, Homo sapiens
atgtttgaaacgaccatcctggat

SEQ ID NO: 1330 - DNA, 24 bp, Homo sapiens
tcttggaaagcaccctctggaaca

SEQ ID NO: 1331 - DNA, 24 bp, Homo sapiens
ggtcccgttcttgttatcagttgg

SEQ ID NO: 1332 - DNA, 24 bp, Homo sapiens
cctcatcaacagtttgcaggacat

SEQ ID NO: 1333 - DNA, 24 bp, Homo sapiens
acctcatcaacagtttgcaggaca

SEQ ID NO: 1334 - DNA, 24 bp, Homo sapiens
ctcatcaacagtttgcaggacatg

SEQ ID NO: 1335 - DNA, 24 bp, Homo sapiens
cggagttgcaagcaaacgggtttc

SEQ ID NO: 1336 - DNA, 25 bp, Homo sapiens
gttgtattgtggtgcagaactggat

SEQ ID NO: 1337 - DNA, 25 bp, Homo sapiens
gcgtgttgttcctatgtgcttttct

SEQ ID NO: 1338 - DNA, 23 bp, Homo sapiens
gcccaacaacctcgttaaaagtg

SEQ ID NO: 1339 - DNA, 24 bp, Homo sapiens
gttggagccatcagtgggatacgc

SEQ ID NO: 1340 - DNA, 25 bp, Homo sapiens
ccagcatcgtgtacttaccagtgtg

SEQ ID NO: 1341 - DNA, 23 bp, Homo sapiens
gcagtcatggagaaccacctacc

SEQ ID NO: 1342 - DNA, 24 bp, Homo sapiens
tgatctcagcagagttcttcatgt

SEQ ID NO: 1343 - DNA, 24 bp, Homo sapiens
atgatctcagcagagttcttcatg

SEQ ID NO: 1344 - DNA, 24 bp, Homo sapiens
gatctcagcagagttcttcatgtg

SEQ ID NO: 1345 - DNA, 23 bp, Homo sapiens
gctccttcgtctgccagtgctac

SEQ ID NO: 1346 - DNA, 24 bp, Homo sapiens
gctgtggactactgtgcctcagaa

SEQ ID NO: 1347 - DNA, 23 bp, Homo sapiens
gctcctacctttgccagtgccat

SEQ ID NO: 1348 - DNA, 24 bp, Homo sapiens
aacagccaacagtgcaacacagat

SEQ ID NO: 1349 - DNA, 24 bp, Homo sapiens
caacagccaacagtgcaacacaga

SEQ ID NO: 1350 - DNA, 24 bp, Homo sapiens
acagccaacagtgcaacacagata

SEQ ID NO: 1351 - DNA, 25 bp, Homo sapiens
gccattgaggaggaactacaagaga

SEQ ID NO: 1352 - DNA, 25 bp, Homo sapiens
gccgaagacttcagcacaatggatg

SEQ ID NO: 1353 - DNA, 25 bp, Homo sapiens
actccgatggaagacaggactctcc

SEQ ID NO: 1354 - DNA, 24 bp, Homo sapiens
caaaaccttcaggaagccctttgg

SEQ ID NO: 1355 - DNA, 24 bp, Homo sapiens
acaaaaccttcaggaagccctttg

SEQ ID NO: 1356 - DNA, 24 bp, Homo sapiens
aaaaccttcaggaagccctttgga

SEQ ID NO: 1357 - DNA, 24 bp, Homo sapiens
ggtgcgtgtgtctctgtctctcct

SEQ ID NO: 1358 - DNA, 24 bp, Homo sapiens
tctctcacacatcacattcccatg

SEQ ID NO: 1359 - DNA, 24 bp, Homo sapiens
tcaagaaaggcccggaagccccag

SEQ ID NO: 1360 - DNA, 24 bp, Homo sapiens
agggcgtgtggtccctgcccctgt

SEQ ID NO: 1361 - DNA, 24 bp, Homo sapiens
tagggcgtgtggtccctgcccctg

SEQ ID NO: 1362 - DNA, 24 bp, Homo sapiens
gggcgtgtggtccctgcccctgtc

SEQ ID NO: 1363 - DNA, 24 bp, Homo sapiens
ccttgtctccctggttgcctctct

SEQ ID NO: 1364 - DNA, 24 bp, Homo sapiens
tcctgaagcccagcgacacagaag

SEQ ID NO: 1365 - DNA, 24 bp, Homo sapiens
agaaagggagcgaggtcagaggag

SEQ ID NO: 1366 - DNA, 24 bp, Homo sapiens
gcccgtaactttggctctgtccag

SEQ ID NO: 1367 - DNA, 24 bp, Homo sapiens
gcatcctacaaggttgcctacagt

SEQ ID NO: 1368 - DNA, 24 bp, Homo sapiens
tgcgaactggactgagtaccagga

SEQ ID NO: 1369 - DNA, 24 bp, Homo sapiens
ggcagcagtaagatcttccctggc

SEQ ID NO: 1370 - DNA, 24 bp, Homo sapiens
tggcagcagtaagatcttccctgg

SEQ ID NO: 1371 - DNA, 24 bp, Homo sapiens
gcagcagtaagatcttccctggca

SEQ ID NO: 1372 - DNA, 24 bp, Homo sapiens
gcctacagccttaatggacacgaa

SEQ ID NO: 1373 - DNA, 24 bp, Homo sapiens
gcatccctgacaagcagatcacgg

SEQ ID NO: 1374 - DNA, 24 bp, Homo sapiens
tggacaagcagggcaacttcaacg

SEQ ID NO: 1375 - DNA, 24 bp, Homo sapiens
ggaacattgccaactcacagatcg

SEQ ID NO: 1376 - DNA, 24 bp, Homo sapiens
catctgtgcgtgtgaccttcttgg

SEQ ID NO: 1377 - DNA, 24 bp, Homo sapiens
acccagcagcaatgacgataaccc

SEQ ID NO: 1378 - DNA, 24 bp, Homo sapiens
cctcctatgcacggctggacaagc

SEQ ID NO: 1379 - DNA, 24 bp, Homo sapiens
aacctgtttgagacccctgtggag

SEQ ID NO: 1380 - DNA, 24 bp, Homo sapiens
cgaaggaggtgacaggcatcatca

SEQ ID NO: 1381 - DNA, 24 bp, Homo sapiens
gcctgaagaataacagcatccctg

SEQ ID NO: 1382 - DNA, 24 bp, Homo sapiens
gtgagctgaacggatgcgccaatc

SEQ ID NO: 1383 - DNA, 24 bp, Homo sapiens
tgtgagctgaacggatgcgccaat

SEQ ID NO: 1384 - DNA, 24 bp, Homo sapiens
tgagctgaacggatgcgccaatcc

SEQ ID NO: 1385 - DNA, 24 bp, Homo sapiens
cacggcctccagcagctacaagac

SEQ ID NO: 1386 - DNA, 24 bp, Homo sapiens
tcacggcctccagcagctacaaga

SEQ ID NO: 1387 - DNA, 24 bp, Homo sapiens
acggcctccagcagctacaagacc

SEQ ID NO: 1388 - DNA, 24 bp, Homo sapiens
aaacgcggtgcatgtcaacctgtt

SEQ ID NO: 1389 - DNA, 24 bp, Homo sapiens
cctgtggaggctcagtacgtgaga

SEQ ID NO: 1390 - DNA, 24 bp, Homo sapiens
cgctttgagctactgggctgtgag

SEQ ID NO: 1391 - DNA, 24 bp, Homo sapiens
tttcagccttcttcatcccgcaat

SEQ ID NO: 1392 - DNA, 24 bp, Homo sapiens
actttcccactcccatctcacact

SEQ ID NO: 1393 - DNA, 24 bp, Homo sapiens
ggtggacaatggtgaggagggtga

SEQ ID NO: 1394 - DNA, 25 bp, Homo sapiens
tcacgtcaagaagccaaattgacag

SEQ ID NO: 1395 - DNA, 25 bp, Homo sapiens
accgatgaccagttaatctgtgcct

SEQ ID NO: 1396 - DNA, 23 bp, Homo sapiens
gcgatcatcaggtggcagctttg

SEQ ID NO: 1397 - DNA, 23 bp, Homo sapiens
gcattgagcggtcagcatcactc

SEQ ID NO: 1398 - DNA, 23 bp, Homo sapiens
caagcggaacactctctgaagga

SEQ ID NO: 1399 - DNA, 24 bp, Homo sapiens
tcatgcgcgtttcctacagactgc

SEQ ID NO: 1400 - DNA, 24 bp, Homo sapiens
tatcaccgagagagtctccatggc

SEQ ID NO: 1401 - DNA, 24 bp, Homo sapiens
atatcaccgagagagtctccatgg

SEQ ID NO: 1402 - DNA, 24 bp, Homo sapiens
atcaccgagagagtctccatggca

SEQ ID NO: 1403 - DNA, 24 bp, Homo sapiens
gtcaatgcatcacgtcaagaagcc

SEQ ID NO: 1404 - DNA, 25 bp, Homo sapiens
acagaggagtgtgatcttctcattg

SEQ ID NO: 1405 - DNA, 23 bp, Homo sapiens
aagacgacagattattggaacca

SEQ ID NO: 1406 - DNA, 24 bp, Homo sapiens
aggtgatgaggcttcgcaaactgg

SEQ ID NO: 1407 - DNA, 25 bp, Homo sapiens
ttgacagaggagtgtgatcttctca

SEQ ID NO: 1408 - DNA, 25 bp, Homo sapiens
gcaaagacgacagattattggaacc

SEQ ID NO: 1409 - DNA, 23 bp, Homo sapiens
ctggctcagcagattgcaaactg

SEQ ID NO: 1410 - DNA, 23 bp, Homo sapiens
agcggtcagcatcactcatctcc

SEQ ID NO: 1411 - DNA, 25 bp, Homo sapiens
ctctgaaggagaatgatcatgcgcg

SEQ ID NO: 1412 - DNA, 24 bp, Homo sapiens
aagaggaacacagaactggagacc

SEQ ID NO: 1413 - DNA, 25 bp, Homo sapiens
agacgacagattattggaaccaaga

SEQ ID NO: 1414 - DNA, 25 bp, Homo sapiens
gctaaactcatccaaacctgtcaac

SEQ ID NO: 1415 - DNA, 24 bp, Homo sapiens
ccaaaccagcaggaggtgatgaga

SEQ ID NO: 1416 - DNA, 24 bp, Homo sapiens
cccaaaccagcaggaggtgatgag

SEQ ID NO: 1417 - DNA, 24 bp, Homo sapiens
caaaccagcaggaggtgatgagaa

SEQ ID NO: 1418 - DNA, 24 bp, Homo sapiens
aagatggccacaaactcctaagga

SEQ ID NO: 1419 - DNA, 24 bp, Homo sapiens
aaagatggccacaaactcctaagg

SEQ ID NO: 1420 - DNA, 24 bp, Homo sapiens
agatggccacaaactcctaaggaa

SEQ ID NO: 1421 - DNA, 24 bp, Homo sapiens
gacaagcccacgactcacgagaaa

SEQ ID NO: 1422 - DNA, 24 bp, Homo sapiens
tcaagccacagtccaagagaagtc

SEQ ID NO: 1423 - DNA, 24 bp, Homo sapiens
gcactcaggaaacgaacaccatca

SEQ ID NO: 1424 - DNA, 24 bp, Homo sapiens
ggctctagaagacctggctggctt

SEQ ID NO: 1425 - DNA, 24 bp, Homo sapiens
tcttccagacaccaggcactgaca

SEQ ID NO: 1426 - DNA, 24 bp, Homo sapiens
aagaagaggtcctaccagtcggca

SEQ ID NO: 1427 - DNA, 24 bp, Homo sapiens
atggaactgggatggagaggtggc

SEQ ID NO: 1428 - DNA, 24 bp, Homo sapiens
gctcttccagacaccagaccacac

SEQ ID NO: 1429 - DNA, 24 bp, Homo sapiens
actcctaaggaaaaggcccaggct

SEQ ID NO: 1430 - DNA, 24 bp, Homo sapiens
caaaagatggccacaaactcctaa

SEQ ID NO: 1431 - DNA, 24 bp, Homo sapiens
gcaaaagatggccacaaactccta

SEQ ID NO: 1432 - DNA, 24 bp, Homo sapiens
aaaagatggccacaaactcctaag

SEQ ID NO: 1433 - DNA, 24 bp, Homo sapiens
aagtctaactggcagcaagaggca

SEQ ID NO: 1434 - DNA, 24 bp, Homo sapiens
ccaagccacagcccaagagaagtc

SEQ ID NO: 1435 - DNA, 24 bp, Homo sapiens
gcaaatctccaccaccagaatcag

SEQ ID NO: 1436 - DNA, 24 bp, Homo sapiens
gccctgaagaagctcacacagaca

SEQ ID NO: 1437 - DNA, 24 bp, Homo sapiens
cagcagcaagtgtaactggtagca

SEQ ID NO: 1438 - DNA, 24 bp, Homo sapiens
cctagaagacctggctggctggaa

SEQ ID NO: 1439 - DNA, 24 bp, Homo sapiens
actaacaccatcagcaggcaaagc

SEQ ID NO: 1440 - DNA, 24 bp, Homo sapiens
atttacctggcagcaagagacggc

SEQ ID NO: 1441 - DNA, 24 bp, Homo sapiens
aatagcctgcagatctccacaacc

SEQ ID NO: 1442 - DNA, 24 bp, Homo sapiens
aaatagcctgcagatctccacaac

SEQ ID NO: 1443 - DNA, 24 bp, Homo sapiens
atagcctgcagatctccacaacca

SEQ ID NO: 1444 - DNA, 24 bp, Homo sapiens
aaatagcctgcaatctccacaacc

SEQ ID NO: 1445 - DNA, 24 bp, Homo sapiens
aaaatagcctgcaatctccacaac

SEQ ID NO: 1446 - DNA, 24 bp, Homo sapiens
aatagcctgcaatctccacaacca

SEQ ID NO: 1447 - DNA, 24 bp, Homo sapiens
ccaacaatcttcaagccacagtcc

SEQ ID NO: 1448 - DNA, 24 bp, Homo sapiens
tcaggaaagcagacgtagaggaag

SEQ ID NO: 1449 - DNA, 24 bp, Homo sapiens
tccaagccacagtccaagagaagt

SEQ ID NO: 1450 - DNA, 24 bp, Homo sapiens
aggaaacgaacaccatcagcaggc

SEQ ID NO: 1451 - DNA, 24 bp, Homo sapiens
gcacacacccaaaccagcagtaag

SEQ ID NO: 1452 - DNA, 24 bp, Homo sapiens
aagcatttatgggaactccagtgc

SEQ ID NO: 1453 - DNA, 24 bp, Homo sapiens
aaagcatttatgggaactccagtg

SEQ ID NO: 1454 - DNA, 24 bp, Homo sapiens
agcatttatgggaactccagtgca

SEQ ID NO: 1455 - DNA, 24 bp, Homo sapiens
gctcttccagacaccaagtcacac

SEQ ID NO: 1456 - DNA, 24 bp, Homo sapiens
taggaaacaaacgccatcagcagg

SEQ ID NO: 1457 - DNA, 24 bp, Homo sapiens
gcacacacccaaaccagcagtagg

SEQ ID NO: 1458 - DNA, 24 bp, Homo sapiens
tggacctgacagagaacttaaccg

SEQ ID NO: 1459 - DNA, 24 bp, Homo sapiens
ggctctggaagacctgactggctt

SEQ ID NO: 1460 - DNA, 24 bp, Homo sapiens
tctccaccagaatcagcagacacc

SEQ ID NO: 1461 - DNA, 24 bp, Homo sapiens
tgccagtcattacaaccagaacca

SEQ ID NO: 1462 - DNA, 24 bp, Homo sapiens
tagcagtcggcaagttcacacgga

SEQ ID NO: 1463 - DNA, 24 bp, Homo sapiens
gacactccaacaagcacaaagcaa

SEQ ID NO: 1464 - DNA, 24 bp, Homo sapiens
tgaatttaggagcacgaaagtcaa

SEQ ID NO: 1465 - DNA, 24 bp, Homo sapiens
atgaatttaggagcacgaaagtca

SEQ ID NO: 1466 - DNA, 24 bp, Homo sapiens
gaatttaggagcacgaaagtcaaa

SEQ ID NO: 1467 - DNA, 24 bp, Homo sapiens
tgtgctggaagaaatgattgcatc

SEQ ID NO: 1468 - DNA, 24 bp, Homo sapiens
cgacgaaagaattgtcctgcttgc

SEQ ID NO: 1469 - DNA, 25 bp, Homo sapiens
tccaaagccaaagaagaaacagcga

SEQ ID NO: 1470 - DNA, 23 bp, Homo sapiens
ctcggtccttgtcctgctcctca

SEQ ID NO: 1471 - DNA, 25 bp, Homo sapiens
gctgtgagaatgatcgcactctatg

SEQ ID NO: 1472 - DNA, 25 bp, Homo sapiens
cgtcaggaagaaagattgcccatcg

SEQ ID NO: 1473 - DNA, 25 bp, Homo sapiens
ccaatgctacggctaaacctgaaga

SEQ ID NO: 1474 - DNA, 23 bp, Homo sapiens
gcagcctcagccgaacctacaag

SEQ ID NO: 1475 - DNA, 24 bp, Homo sapiens
gcataaaatcagctgctcgactga

SEQ ID NO: 1476 - DNA, 24 bp, Homo sapiens
tgcataaaatcagctgctcgactg

SEQ ID NO: 1477 - DNA, 24 bp, Homo sapiens
cataaaatcagctgctcgactgat

SEQ ID NO: 1478 - DNA, 24 bp, Homo sapiens
gcccagcagtccaactcattgaac

SEQ ID NO: 1479 - DNA, 24 bp, Homo sapiens
ggcatcggcatggtcataggacac

SEQ ID NO: 1480 - DNA, 25 bp, Homo sapiens
catggcttcgatgacaatggcagaa

SEQ ID NO: 1481 - DNA, 24 bp, Homo sapiens
cgagacttaccgcatattacagtg

SEQ ID NO: 1482 - DNA, 24 bp, Homo sapiens
aggatgaacgctggacggatggta

SEQ ID NO: 1483 - DNA, 24 bp, Homo sapiens
acttcctgtatgctgcaactcatg

SEQ ID NO: 1484 - DNA, 24 bp, Homo sapiens
acggccgagagccgagctggagga

SEQ ID NO: 1485 - DNA, 24 bp, Homo sapiens
cacggccgagagccgagctggagg

SEQ ID NO: 1486 - DNA, 24 bp, Homo sapiens
cggccgagagccgagctggaggac

SEQ ID NO: 1487 - DNA, 24 bp, Homo sapiens
gcagaacctcaatgaccgcctggc

SEQ ID NO: 1488 - DNA, 24 bp, Homo sapiens
acagccaccttgaacaatgccaac

SEQ ID NO: 1489 - DNA, 24 bp, Homo sapiens
agagccgacctggagatgcagatt

SEQ ID NO: 1490 - DNA, 24 bp, Homo sapiens
gcctacctgaagaagaaccacgag

SEQ ID NO: 1491 - DNA, 24 bp, Homo sapiens
ctccaccacctatgtcctcacagt

SEQ ID NO: 1492 - DNA, 24 bp, Homo sapiens
tgataggtggtgaaggtttagccc

SEQ ID NO: 1493 - DNA, 24 bp, Homo sapiens
atctgagtcctggctctggcactt

SEQ ID NO: 1494 - DNA, 24 bp, Homo sapiens
tggatgaggaagtgctgatgtcgc

SEQ ID NO: 1495 - DNA, 24 bp, Homo sapiens
tggaactggggttggaccgagcca

SEQ ID NO: 1496 - DNA, 23 bp, Homo sapiens
cgggcacagaaacacagcagcgg

SEQ ID NO: 1497 - DNA, 23 bp, Homo sapiens
cctcaggagatggaacgaatacg

SEQ ID NO: 1498 - DNA, 23 bp, Homo sapiens
cctcttcattcccgtccatgccg

SEQ ID NO: 1499 - DNA, 23 bp, Homo sapiens
ttgagccgggcacagaaacacag

SEQ ID NO: 1500 - DNA, 23 bp, Homo sapiens
agcaacaccagcactgccaacag

SEQ ID NO: 1501 - DNA, 25 bp, Homo sapiens
agctcatctgcgcctttgtttagaa

SEQ ID NO: 1502 - DNA, 24 bp, Homo sapiens
ctgattccactaggaccagactgc

SEQ ID NO: 1503 - DNA, 25 bp, Homo sapiens
cacacaacacttggtttgctcaaca

SEQ ID NO: 1504 - DNA, 25 bp, Homo sapiens
cagagcgagaggagattgaagtgga

SEQ ID NO: 1505 - DNA, 25 bp, Homo sapiens
atggaacgaatacgaatggacagca

SEQ ID NO: 1506 - DNA, 24 bp, Homo sapiens
caacaccagcactgccaacagatc

SEQ ID NO: 1507 - DNA, 23 bp, Homo sapiens
cacaatgagctggaaaagaatcg

SEQ ID NO: 1508 - DNA, 23 bp, Homo sapiens
cagcattcaaagcccccacggag

SEQ ID NO: 1509 - DNA, 24 bp, Homo sapiens
gagcaagctcaggcgaggaaacga

SEQ ID NO: 1510 - DNA, 24 bp, Homo sapiens
agagcaagctcaggcgaggaaacg

SEQ ID NO: 1511 - DNA, 24 bp, Homo sapiens
agcaagctcaggcgaggaaacgag

SEQ ID NO: 1512 - DNA, 24 bp, Homo sapiens
agcagtacaaggagcaggcagaga

SEQ ID NO: 1513 - DNA, 23 bp, Homo sapiens
ctggaggaggcagaggaggagtc

SEQ ID NO: 1514 - DNA, 23 bp, Homo sapiens
catcaacgccaaccgcaggaagc

SEQ ID NO: 1515 - DNA, 25 bp, Homo sapiens
ctagaaggtctggaggacgtagagt

SEQ ID NO: 1516 - DNA, 24 bp, Homo sapiens
aatgcagatggttctgaggaggaa

SEQ ID NO: 1517 - DNA, 24 bp, Homo sapiens
cgagacgcagacttcaatggaacc

SEQ ID NO: 1518 - DNA, 25 bp, Homo sapiens
aacccaacaacaacccagaacaaag

SEQ ID NO: 1519 - DNA, 24 bp, Homo sapiens
acaagtatcacgggagagctggaa

SEQ ID NO: 1520 - DNA, 24 bp, Homo sapiens
cacaagtatcacgggagagctgga

SEQ ID NO: 1521 - DNA, 24 bp, Homo sapiens
caagtatcacgggagagctggaaa

SEQ ID NO: 1522 - DNA, 23 bp, Homo sapiens
gcctccgtgctacacaacctgag

SEQ ID NO: 1523 - DNA, 23 bp, Homo sapiens
gcctcttctgcgtggtggtcaac

SEQ ID NO: 1524 - DNA, 23 bp, Homo sapiens
gcctcacatctacgccatcgcag

SEQ ID NO: 1525 - DNA, 25 bp, Homo sapiens
ggagccaacattgagacctatctgc

SEQ ID NO: 1526 - DNA, 23 bp, Homo sapiens
gccaagccagagacgagaggaca

SEQ ID NO: 1527 - DNA, 25 bp, Homo sapiens
ggagccaaggagaagatgagaagtg

SEQ ID NO: 1528 - DNA, 23 bp, Homo sapiens
gacgagctgcaagccacggagga

SEQ ID NO: 1529 - DNA, 23 bp, Homo sapiens
actgcggctggaagtcaacatgc

SEQ ID NO: 1530 - DNA, 24 bp, Homo sapiens
gttcgaaagggatctccaagcccg

SEQ ID NO: 1531 - DNA, 24 bp, Homo sapiens
agttcgaaagggatctccaagccc

SEQ ID NO: 1532 - DNA, 24 bp, Homo sapiens
ttcgaaagggatctccaagcccgg

SEQ ID NO: 1533 - DNA, 23 bp, Homo sapiens
agaagagccgacaggagctggag

SEQ ID NO: 1534 - DNA, 24 bp, Homo sapiens
cagaactggaagtgcggctaaaga

SEQ ID NO: 1535 - DNA, 24 bp, Homo sapiens
tcagaactggaagtgcggctaaag

SEQ ID NO: 1536 - DNA, 24 bp, Homo sapiens
agaactggaagtgcggctaaagaa

SEQ ID NO: 1537 - DNA, 24 bp, Homo sapiens
agggtgatgccagcgacttccacg

SEQ ID NO: 1538 - DNA, 24 bp, Homo sapiens
gagggtgatgccagcgacttccac

SEQ ID NO: 1539 - DNA, 24 bp, Homo sapiens
gggtgatgccagcgacttccacga

SEQ ID NO: 1540 - DNA, 25 bp, Homo sapiens
gaatcttaccaagctgaaaaacaag

SEQ ID NO: 1541 - DNA, 25 bp, Homo sapiens
gtgctgaagaaggccctggatgaag

SEQ ID NO: 1542 - DNA, 23 bp, Homo sapiens
caggtccaggagatgaggcagaa

SEQ ID NO: 1543 - DNA, 23 bp, Homo sapiens
aggcggtggaggagctcacagag

SEQ ID NO: 1544 - DNA, 24 bp, Homo sapiens
cagttcaagagggccaaggcgaac

SEQ ID NO: 1545 - DNA, 24 bp, Homo sapiens
gcagttcaagagggccaaggcgaa

SEQ ID NO: 1546 - DNA, 24 bp, Homo sapiens
agttcaagagggccaaggcgaacc

SEQ ID NO: 1547 - DNA, 25 bp, Homo sapiens
aaatcgctcagaagaacaatgccct

SEQ ID NO: 1548 - DNA, 23 bp, Homo sapiens
aggaggacctggactcagagcgg

SEQ ID NO: 1549 - DNA, 23 bp, Homo sapiens
tggaagacacactggacagcaca

SEQ ID NO: 1550 - DNA, 23 bp, Homo sapiens
ggaggaccagtccattctatgca

SEQ ID NO: 1551 - DNA, 24 bp, Homo sapiens
gcatgcttcaagatcgggaggacc

SEQ ID NO: 1552 - DNA, 24 bp, Homo sapiens
agcatgcttcaagatcgggaggac

SEQ ID NO: 1553 - DNA, 24 bp, Homo sapiens
catgcttcaagatcgggaggacca

SEQ ID NO: 1554 - DNA, 24 bp, Homo sapiens
cattctatgcacaggcgagtctgg

SEQ ID NO: 1555 - DNA, 24 bp, Homo sapiens
ccattctatgcacaggcgagtctg

SEQ ID NO: 1556 - DNA, 24 bp, Homo sapiens
attctatgcacaggcgagtctgga

SEQ ID NO: 1557 - DNA, 25 bp, Homo sapiens
ggagaatggcaagaaggtcacggtt

SEQ ID NO: 1558 - DNA, 25 bp, Homo sapiens
gaaaaccgaaaacaccaagaaggtc

SEQ ID NO: 1559 - DNA, 23 bp, Homo sapiens
tacctggccgtggtggcctcctc

SEQ ID NO: 1560 - DNA, 25 bp, Homo sapiens
gggcaagaaagacacaagtatcacg

SEQ ID NO: 1561 - DNA, 23 bp, Homo sapiens
aaacacctgcccatctactcgga

SEQ ID NO: 1562 - DNA, 23 bp, Homo sapiens
tacaagggcaagaagaggcacga

SEQ ID NO: 1563 - DNA, 25 bp, Homo sapiens
tcagtgacgatgagaagttcctctt

SEQ ID NO: 1564 - DNA, 25 bp, Homo sapiens
gcagccagcattaaggaggagaagg

SEQ ID NO: 1565 - DNA, 25 bp, Homo sapiens
cggagcgtgagtgcatcaagtacat

SEQ ID NO: 1566 - DNA, 25 bp, Homo sapiens
gatctcggagggagtggagtacatc

SEQ ID NO: 1567 - DNA, 25 bp, Homo sapiens
acatcatgtgtgtcaacaagacggg

SEQ ID NO: 1568 - DNA, 24 bp, Homo sapiens
tgagcgcatcattgacgaggactt

SEQ ID NO: 1569 - DNA, 24 bp, Homo sapiens
ttgagcgcatcattgacgaggact

SEQ ID NO: 1570 - DNA, 24 bp, Homo sapiens
gagcgcatcattgacgaggacttt

SEQ ID NO: 1571 - DNA, 24 bp, Homo sapiens
gatcaagctcatcgactttggtct

SEQ ID NO: 1572 - DNA, 24 bp, Homo sapiens
ggatcaagctcatcgactttggtc

SEQ ID NO: 1573 - DNA, 24 bp, Homo sapiens
atcaagctcatcgactttggtctg

SEQ ID NO: 1574 - DNA, 23 bp, Homo sapiens
ccttgaggctgttgctgaggaaa

SEQ ID NO: 1575 - DNA, 25 bp, Homo sapiens
aaccctatttctctaagaccattcg

SEQ ID NO: 1576 - DNA, 24 bp, Homo sapiens
agaagttgtggagggaagtgctgc

SEQ ID NO: 1577 - DNA, 24 bp, Homo sapiens
tagaatctgaagaagatgtgtccc

SEQ ID NO: 1578 - DNA, 24 bp, Homo sapiens
ctagaatctgaagaagatgtgtcc

SEQ ID NO: 1579 - DNA, 24 bp, Homo sapiens
agaatctgaagaagatgtgtccca

SEQ ID NO: 1580 - DNA, 24 bp, Homo sapiens
gcaagattgaaggatacccagacc

SEQ ID NO: 1581 - DNA, 24 bp, Homo sapiens
tgcaagattgaaggatacccagac

SEQ ID NO: 1582 - DNA, 24 bp, Homo sapiens
caagattgaaggatacccagaccc

SEQ ID NO: 1583 - DNA, 25 bp, Homo sapiens
ctgtgagagccattggaagactgtc

SEQ ID NO: 1584 - DNA, 23 bp, Homo sapiens
tctcagggctcagtggcaggaaa

SEQ ID NO: 1585 - DNA, 23 bp, Homo sapiens
gtcaccaaccagcccgctcaatg

SEQ ID NO: 1586 - DNA, 25 bp, Homo sapiens
agcacctagtgtgatagattatcgg

SEQ ID NO: 1587 - DNA, 25 bp, Homo sapiens
acagcagttgatacctagcagcgtt

SEQ ID NO: 1588 - DNA, 25 bp, Homo sapiens
gcattaatctatgttagttggcacc

SEQ ID NO: 1589 - DNA, 25 bp, Homo sapiens
ccgccacttccagatagactacgat

SEQ ID NO: 1590 - DNA, 25 bp, Homo sapiens
ggatgacgatgccaagtacacctgc

SEQ ID NO: 1591 - DNA, 24 bp, Homo sapiens
aacagtcttggagaagccacctgc

SEQ ID NO: 1592 - DNA, 24 bp, Homo sapiens
gggaagaggaagaagagtgaaaca

SEQ ID NO: 1593 - DNA, 24 bp, Homo sapiens
ggggaagaggaagaagagtgaaac

SEQ ID NO: 1594 - DNA, 24 bp, Homo sapiens
ggaagaggaagaagagtgaaacaa

SEQ ID NO: 1595 - DNA, 25 bp, Homo sapiens
cattggaagactgtcctctatggca

SEQ ID NO: 1596 - DNA, 23 bp, Homo sapiens
tcagggctcagtggcaggaaatc

SEQ ID NO: 1597 - DNA, 24 bp, Homo sapiens
gctttccttgaggctgttgctgag

SEQ ID NO: 1598 - DNA, 24 bp, Homo sapiens
tcgtcatggtcctggagatcgtgt

SEQ ID NO: 1599 - DNA, 24 bp, Homo sapiens
ggcaccaggatcaagctcatcgac

SEQ ID NO: 1600 - DNA, 25 bp, Homo sapiens
cggatgaagaagtacatggcaagaa

SEQ ID NO: 1601 - DNA, 25 bp, Homo sapiens
catctgctacatcctagtcagtggc

SEQ ID NO: 1602 - DNA, 24 bp, Homo sapiens
taggaactgagagtgatgcgactg

SEQ ID NO: 1603 - DNA, 24 bp, Homo sapiens
ctaggaactgagagtgatgcgact

SEQ ID NO: 1604 - DNA, 24 bp, Homo sapiens
aggaactgagagtgatgcgactgt

SEQ ID NO: 1605 - DNA, 24 bp, Homo sapiens
tgagaaggccaagtccccagagaa

SEQ ID NO: 1606 - DNA, 24 bp, Homo sapiens
ctgagaaggccaagtccccagaga

SEQ ID NO: 1607 - DNA, 24 bp, Homo sapiens
gagaaggccaagtccccagagaag

SEQ ID NO: 1608 - DNA, 24 bp, Homo sapiens
tgagaaggccaagtcccctgagaa

SEQ ID NO: 1609 - DNA, 24 bp, Homo sapiens
ctgagaaggccaagtcccctgaga

SEQ ID NO: 1610 - DNA, 24 bp, Homo sapiens
gagaaggccaagtcccctgagaag

SEQ ID NO: 1611 - DNA, 24 bp, Homo sapiens
cggaggaagagtgatggcaagata

SEQ ID NO: 1612 - DNA, 24 bp, Homo sapiens
acttgactatggctccatgacaga

SEQ ID NO: 1613 - DNA, 24 bp, Homo sapiens
acaaagggaaccaaggaaaggcaa

SEQ ID NO: 1614 - DNA, 24 bp, Homo sapiens
atcgagctacttttctcatccaac

SEQ ID NO: 1615 - DNA, 24 bp, Homo sapiens
atatcctccccacctgaatcctca

SEQ ID NO: 1616 - DNA, 24 bp, Homo sapiens
tatgtaccttcttatgacccatcc

SEQ ID NO: 1617 - DNA, 24 bp, Homo sapiens
agaatcctccaggttaccttgagg

SEQ ID NO: 1618 - DNA, 24 bp, Homo sapiens
aagaatcctccaggttaccttgag

SEQ ID NO: 1619 - DNA, 24 bp, Homo sapiens
gaatcctccaggttaccttgagga

SEQ ID NO: 1620 - DNA, 24 bp, Homo sapiens
ccaacacaagctatccttcctcca

SEQ ID NO: 1621 - DNA, 24 bp, Homo sapiens
tcaaataggacacccatcttaccg

SEQ ID NO: 1622 - DNA, 24 bp, Homo sapiens
attacggtttgaacataattggag

SEQ ID NO: 1623 - DNA, 24 bp, Homo sapiens
tccttcaagcagaaacaagcaact

SEQ ID NO: 1624 - DNA, 24 bp, Homo sapiens
agcacgccgagtgaacttgaatct

SEQ ID NO: 1625 - DNA, 24 bp, Homo sapiens
gttgtgaagttgcggtgatccagc

SEQ ID NO: 1626 - DNA, 24 bp, Homo sapiens
cggaaagtgcgttttaaggcgaag

SEQ ID NO: 1627 - DNA, 24 bp, Homo sapiens
tgtctcactcaggatgaatttcac

SEQ ID NO: 1628 - DNA, 24 bp, Homo sapiens
ctgtctcactcaggatgaatttca

SEQ ID NO: 1629 - DNA, 24 bp, Homo sapiens
gtctcactcaggatgaatttcacc

SEQ ID NO: 1630 - DNA, 24 bp, Homo sapiens
gtagtagggaaagtgcctggccat

SEQ ID NO: 1631 - DNA, 24 bp, Homo sapiens
ctgtcttggcaccctctccccatc

SEQ ID NO: 1632 - DNA, 24 bp, Homo sapiens
tgttcagctctgcatctccacagg

SEQ ID NO: 1633 - DNA, 24 bp, Homo sapiens
actccacctccaccttcaccgttg

SEQ ID NO: 1634 - DNA, 24 bp, Homo sapiens
acctccaccttcaccgttgccatt

SEQ ID NO: 1635 - DNA, 24 bp, Homo sapiens
ctatccttcctccagccccatcga

SEQ ID NO: 1636 - DNA, 24 bp, Homo sapiens
ccatccagtccacaaaccagccag

SEQ ID NO: 1637 - DNA, 24 bp, Homo sapiens
tccgactactatgaagaagcctga

SEQ ID NO: 1638 - DNA, 24 bp, Homo sapiens
cccagcaccaccatcccggaatac

SEQ ID NO: 1639 - DNA, 24 bp, Homo sapiens
ttgcacacagtgtcatctcaactc

SEQ ID NO: 1640 - DNA, 24 bp, Homo sapiens
gttgcacacagtgtcatctcaact

SEQ ID NO: 1641 - DNA, 24 bp, Homo sapiens
tgcacacagtgtcatctcaactcg

SEQ ID NO: 1642 - DNA, 24 bp, Homo sapiens
ttgcctatacttggttcaacctgc

SEQ ID NO: 1643 - DNA, 24 bp, Homo sapiens
gcatgagaagcgaatgtcaaagga

SEQ ID NO: 1644 - DNA, 24 bp, Homo sapiens
caaacagaagtgggcatccaggct

SEQ ID NO: 1645 - DNA, 24 bp, Homo sapiens
agagcagtcaaagatgagcttctc

SEQ ID NO: 1646 - DNA, 24 bp, Homo sapiens
cgagaggactttgtgctcaccgtg

SEQ ID NO: 1647 - DNA, 24 bp, Homo sapiens
cgagtgaacttgaatctttggcta

SEQ ID NO: 1648 - DNA, 24 bp, Homo sapiens
gcggggctcagatgactgtaaaat

SEQ ID NO: 1649 - DNA, 24 bp, Homo sapiens
tgtaccccaagccagcacaagatt

SEQ ID NO: 1650 - DNA, 24 bp, Homo sapiens
ctgtaccccaagccagcacaagat

SEQ ID NO: 1651 - DNA, 24 bp, Homo sapiens
gtaccccaagccagcacaagattg

SEQ ID NO: 1652 - DNA, 24 bp, Homo sapiens
ttaaaattcactgtgcccagcaca

SEQ ID NO: 1653 - DNA, 24 bp, Homo sapiens
attaaaattcactgtgcccagcac

SEQ ID NO: 1654 - DNA, 24 bp, Homo sapiens
taaaattcactgtgcccagcacat

SEQ ID NO: 1655 - DNA, 24 bp, Homo sapiens
atgacttcccccagctctgaggta

SEQ ID NO: 1656 - DNA, 24 bp, Homo sapiens
caaacctgcctgtcccaaaccact

SEQ ID NO: 1657 - DNA, 24 bp, Homo sapiens
ttgagccaccaacttcagtgcctt

SEQ ID NO: 1658 - DNA, 24 bp, Homo sapiens
caagccagcacaagattggaccaa

SEQ ID NO: 1659 - DNA, 24 bp, Homo sapiens
gtgcagtacgaggtgggtgcagga

SEQ ID NO: 1660 - DNA, 24 bp, Homo sapiens
tgtgcagtacgaggtgggtgcagg

SEQ ID NO: 1661 - DNA, 24 bp, Homo sapiens
tgcagtacgaggtgggtgcaggag

SEQ ID NO: 1662 - DNA, 24 bp, Homo sapiens
tttctgctcacttcatgggctggc

SEQ ID NO: 1663 - DNA, 25 bp, Homo sapiens
ggacaccacgaacagaagtaatgaa

SEQ ID NO: 1664 - DNA, 25 bp, Homo sapiens
ctatgctgtggtggtgattgcgtct

SEQ ID NO: 1665 - DNA, 23 bp, Homo sapiens
ccgcaacaagcaccgaggagtta

SEQ ID NO: 1666 - DNA, 25 bp, Homo sapiens
gatgtcgtcctggataaggtggcat

SEQ ID NO: 1667 - DNA, 23 bp, Homo sapiens
ttctgctggctggttgtgggctt

SEQ ID NO: 1668 - DNA, 24 bp, Homo sapiens
ggccgctttcgcctgtcccacgtc

SEQ ID NO: 1669 - DNA, 24 bp, Homo sapiens
gggccgctttcgcctgtcccacgt

SEQ ID NO: 1670 - DNA, 24 bp, Homo sapiens
gccgctttcgcctgtcccacgtcc

SEQ ID NO: 1671 - DNA, 25 bp, Homo sapiens
tggagcctaacagtgtagatcctga

SEQ ID NO: 1672 - DNA, 25 bp, Homo sapiens
gacttgtctgaactgatcctggtgg

SEQ ID NO: 1673 - DNA, 24 bp, Homo sapiens
gctgtggtgcttgttggttgatgc

SEQ ID NO: 1674 - DNA, 24 bp, Homo sapiens
actcctgggactgctgttggctta

SEQ ID NO: 1675 - DNA, 24 bp, Homo sapiens
ggtagatgtgggcggtgtttggag

SEQ ID NO: 1676 - DNA, 24 bp, Homo sapiens
ttggcatgaaaggttttgttttgt

SEQ ID NO: 1677 - DNA, 24 bp, Homo sapiens
tttggcatgaaaggttttgttttg

SEQ ID NO: 1678 - DNA, 24 bp, Homo sapiens
tggcatgaaaggttttgttttgtt

SEQ ID NO: 1679 - DNA, 24 bp, Homo sapiens
cctgcagcacatcaattttacccg

SEQ ID NO: 1680 - DNA, 24 bp, Homo sapiens
acctgcagcacatcaattttaccc

SEQ ID NO: 1681 - DNA, 24 bp, Homo sapiens
ctgcagcacatcaattttacccga

SEQ ID NO: 1682 - DNA, 24 bp, Homo sapiens
cttgtctgaactgatcctggtggg

SEQ ID NO: 1683 - DNA, 24 bp, Homo sapiens
acttgtctgaactgatcctggtgg

SEQ ID NO: 1684 - DNA, 24 bp, Homo sapiens
ttgtctgaactgatcctggtgggc

SEQ ID NO: 1685 - DNA, 23 bp, Homo sapiens
ccttctcctggcatcgtggcatt

SEQ ID NO: 1686 - DNA, 25 bp, Homo sapiens
gcttatgtgggactgagaaatctga

SEQ ID NO: 1687 - DNA, 25 bp, Homo sapiens
tgctcctgtgacattatgtggatca

SEQ ID NO: 1688 - DNA, 25 bp, Homo sapiens
tccaagaggctaaatccagtccaga

SEQ ID NO: 1689 - DNA, 23 bp, Homo sapiens
ccgcacctaacctcactgtggag

SEQ ID NO: 1690 - DNA, 24 bp, Homo sapiens
catcaccgaaattttcatcgcaaa

SEQ ID NO: 1691 - DNA, 24 bp, Homo sapiens
acatcaccgaaattttcatcgcaa

SEQ ID NO: 1692 - DNA, 24 bp, Homo sapiens
atcaccgaaattttcatcgcaaac

SEQ ID NO: 1693 - DNA, 25 bp, Homo sapiens
aaggttagaaatcatcaacgaagat

SEQ ID NO: 1694 - DNA, 24 bp, Homo sapiens
tttacccgaaacaaactgacgagt

SEQ ID NO: 1695 - DNA, 23 bp, Homo sapiens
ggtctggtgatgccatagcagcc

SEQ ID NO: 1696 - DNA, 23 bp, Homo sapiens
gtccatgccagtccgcctcagtc

SEQ ID NO: 1697 - DNA, 24 bp, Homo sapiens
cattcggaacattggacagaagcc

SEQ ID NO: 1698 - DNA, 23 bp, Homo sapiens
acactgtttgtgggtttaccgcc

SEQ ID NO: 1699 - DNA, 25 bp, Homo sapiens
gaccttcgctgtgattgctatacgg

SEQ ID NO: 1700 - DNA, 25 bp, Homo sapiens
ggaaatggcaagacagaagagtgga

SEQ ID NO: 1701 - DNA, 25 bp, Homo sapiens
cagcaaatcacatgaacagttccct

SEQ ID NO: 1702 - DNA, 24 bp, Homo sapiens
aaccacctcttcaacaccacggat

SEQ ID NO: 1703 - DNA, 24 bp, Homo sapiens
caggctccattcccttgaagaccc

SEQ ID NO: 1704 - DNA, 25 bp, Homo sapiens
agaagccaataactgagatacagga

SEQ ID NO: 1705 - DNA, 25 bp, Homo sapiens
tcaagcagcgagtcatccagtacct

SEQ ID NO: 1706 - DNA, 25 bp, Homo sapiens
tgtggacattggagtcttagcgtct

SEQ ID NO: 1707 - DNA, 25 bp, Homo sapiens
agaattagaagatgaacatttggca

SEQ ID NO: 1708 - DNA, 24 bp, Homo sapiens
agttccctgctgtctttatatcgg

SEQ ID NO: 1709 - DNA, 24 bp, Homo sapiens
gcacagaggaaagattggaagaca

SEQ ID NO: 1710 - DNA, 24 bp, Homo sapiens
cccattcctctgccaggctctaaa

SEQ ID NO: 1711 - DNA, 24 bp, Homo sapiens
gcaaacatcactgagttaggtggg

SEQ ID NO: 1712 - DNA, 24 bp, Homo sapiens
ctcactctgttgctcaggctggag

SEQ ID NO: 1713 - DNA, 23 bp, Homo sapiens
atatggagccgatggtggtgcca

SEQ ID NO: 1714 - DNA, 25 bp, Homo sapiens
aaccagcatgaagaactacagaacg

SEQ ID NO: 1715 - DNA, 25 bp, Homo sapiens
acacatccattcctgtttcaccaac

SEQ ID NO: 1716 - DNA, 25 bp, Homo sapiens
ttgagagagtcccagagccaccttc

SEQ ID NO: 1717 - DNA, 25 bp, Homo sapiens
tcagtcttggacggagagcagcata

SEQ ID NO: 1718 - DNA, 24 bp, Homo sapiens
aatgcaaagctggtatgagcaatc

SEQ ID NO: 1719 - DNA, 24 bp, Homo sapiens
aaatgcaaagctggtatgagcaat

SEQ ID NO: 1720 - DNA, 24 bp, Homo sapiens
atgcaaagctggtatgagcaatcc

SEQ ID NO: 1721 - DNA, 25 bp, Homo sapiens
atgctgtagatggatggaagaggct

SEQ ID NO: 1722 - DNA, 23 bp, Homo sapiens
accagtcagttgtgcctatgtcc

SEQ ID NO: 1723 - DNA, 25 bp, Homo sapiens
tgattagttctctccaagccattgc

SEQ ID NO: 1724 - DNA, 25 bp, Homo sapiens
gtactgttagctgtttttgtggaca

SEQ ID NO: 1725 - DNA, 25 bp, Homo sapiens
ccctcttgtcaaactggaagctagg

SEQ ID NO: 1726 - DNA, 23 bp, Homo sapiens
agagggatttttatcctttactc

SEQ ID NO: 1727 - DNA, 25 bp, Homo sapiens
ttcatctgacaatctgcttcaagaa

SEQ ID NO: 1728 - DNA, 25 bp, Homo sapiens
aagtgccagaccggaacctatagct

SEQ ID NO: 1729 - DNA, 25 bp, Homo sapiens
aaccaacagcagcacaggatgtatt

SEQ ID NO: 1730 - DNA, 25 bp, Homo sapiens
atgcccctttcccacagtcttttat

SEQ ID NO: 1731 - DNA, 25 bp, Homo sapiens
tgagaatcaggatgaaagtcaaact

SEQ ID NO: 1732 - DNA, 25 bp, Homo sapiens
agatacagatcagcaaccaggaaga

SEQ ID NO: 1733 - DNA, 23 bp, Homo sapiens
caaggagaaggtgcaagactgtc

SEQ ID NO: 1734 - DNA, 24 bp, Homo sapiens
gccaggatctcagagctactgcaa

SEQ ID NO: 1735 - DNA, 23 bp, Homo sapiens
ccaccagacgagcaccaagaagc

SEQ ID NO: 1736 - DNA, 25 bp, Homo sapiens
cctcaggtaacagagattcaaaggt

SEQ ID NO: 1737 - DNA, 24 bp, Homo sapiens
acagatcagcaaccaggaagaagc

SEQ ID NO: 1738 - DNA, 23 bp, Homo sapiens
acagccacttggccatgtcacca

SEQ ID NO: 1739 - DNA, 25 bp, Homo sapiens
gagaaggtgcaagactgtccgtgtg

SEQ ID NO: 1740 - DNA, 24 bp, Homo sapiens
aagcgttcactgaccaagactcca

SEQ ID NO: 1741 - DNA, 25 bp, Homo sapiens
aagtctgcacatgtgaccgtgtctg

SEQ ID NO: 1742 - DNA, 23 bp, Homo sapiens
aaaggcgaggctgtgcttgggac

SEQ ID NO: 1743 - DNA, 24 bp, Homo sapiens
cttctgaggtccgagactggctgg

SEQ ID NO: 1744 - DNA, 24 bp, Homo sapiens
cggttcaagagcatcgttcacgca

SEQ ID NO: 1745 - DNA, 24 bp, Homo sapiens
acggacatcaaacatggttggact

SEQ ID NO: 1746 - DNA, 24 bp, Homo sapiens
aaatggaagctcttaaaaccgtgt

SEQ ID NO: 1747 - DNA, 24 bp, Homo sapiens
acgattgtggtcacctgtgctgtt

SEQ ID NO: 1748 - DNA, 24 bp, Homo sapiens
gaccttcaatggacttaccctgga

SEQ ID NO: 1749 - DNA, 24 bp, Homo sapiens
gtgacggtcttggaagtgagcagt

SEQ ID NO: 1750 - DNA, 24 bp, Homo sapiens
agaatgagcttgaaggcaggcaca

SEQ ID NO: 1751 - DNA, 24 bp, Homo sapiens
ggcgttcctggtcttaggctgtct

SEQ ID NO: 1752 - DNA, 24 bp, Homo sapiens
agagtgaagtgagctggcagtacc

SEQ ID NO: 1753 - DNA, 24 bp, Homo sapiens
tctttggattgaaccctgctgatg

SEQ ID NO: 1754 - DNA, 24 bp, Homo sapiens
tgactacatggacatgaagcaggc

SEQ ID NO: 1755 - DNA, 24 bp, Homo sapiens
tcactctatgatcgtccagcctca

SEQ ID NO: 1756 - DNA, 24 bp, Homo sapiens
accaaagccaccaccaaagacaga

SEQ ID NO: 1757 - DNA, 24 bp, Homo sapiens
gatgatccagacaccgtgggaagc

SEQ ID NO: 1758 - DNA, 24 bp, Homo sapiens
gggattatataggcatgagccact

SEQ ID NO: 1759 - DNA, 24 bp, Homo sapiens
tgggattatataggcatgagccac

SEQ ID NO: 1760 - DNA, 24 bp, Homo sapiens
ggattatataggcatgagccactg

SEQ ID NO: 1761 - DNA, 24 bp, Homo sapiens
ggatgagggtggcatgaggaggtc

SEQ ID NO: 1762 - DNA, 24 bp, Homo sapiens
gtatgccaccaacactgctcacag

SEQ ID NO: 1763 - DNA, 24 bp, Homo sapiens
tgaggacaccagtgaaagaagcca

SEQ ID NO: 1764 - DNA, 24 bp, Homo sapiens
gatttggcatctcctgtcctgggc

SEQ ID NO: 1765 - DNA, 24 bp, Homo sapiens
aaggaggaggagggagaagagaaa

SEQ ID NO: 1766 - DNA, 24 bp, Homo sapiens
gccgcaccatttctgtcactcaca

SEQ ID NO: 1767 - DNA, 24 bp, Homo sapiens
caatgctgctcttcgtgctcacct

SEQ ID NO: 1768 - DNA, 24 bp, Homo sapiens
ggtcttcccagccatctccacgaa

SEQ ID NO: 1769 - DNA, 24 bp, Homo sapiens
ccgaggaggtgaatagtgtggaag

SEQ ID NO: 1770 - DNA, 24 bp, Homo sapiens
aagtggctaaaacattgcacagga

SEQ ID NO: 1771 - DNA, 24 bp, Homo sapiens
gaagtggctaaaacattgcacagg

SEQ ID NO: 1772 - DNA, 24 bp, Homo sapiens
agtggctaaaacattgcacaggag

SEQ ID NO: 1773 - DNA, 24 bp, Homo sapiens
tcaaagcagcaatacgagtctggc

SEQ ID NO: 1774 - DNA, 24 bp, Homo sapiens
gctgatgttaatttcaattctggg

SEQ ID NO: 1775 - DNA, 24 bp, Homo sapiens
tggagcactactacagcatttccg

SEQ ID NO: 1776 - DNA, 24 bp, Homo sapiens
atggtgctgatgattccagattca

SEQ ID NO: 1777 - DNA, 24 bp, Homo sapiens
tccttctcaagtgacttcatgccg

SEQ ID NO: 1778 - DNA, 24 bp, Homo sapiens
catgtgaacattgtggaaccatct

SEQ ID NO: 1779 - DNA, 24 bp, Homo sapiens
ttgaaaacccaggaaaacgtgtat

SEQ ID NO: 1780 - DNA, 24 bp, Homo sapiens
attgaaaacccaggaaaacgtgta

SEQ ID NO: 1781 - DNA, 24 bp, Homo sapiens
tgaaaacccaggaaaacgtgtata

SEQ ID NO: 1782 - DNA, 24 bp, Homo sapiens
tctaagtgtatgtggctctgaaga

SEQ ID NO: 1783 - DNA, 24 bp, Homo sapiens
cgaccactgtttggggagccacaa

SEQ ID NO: 1784 - DNA, 24 bp, Homo sapiens
atctgttattcagctccacctgca

SEQ ID NO: 1785 - DNA, 24 bp, Homo sapiens
aactatccacatccatctaccagc

SEQ ID NO: 1786 - DNA, 24 bp, Homo sapiens
gcagcacacaacattccagaaacc

SEQ ID NO: 1787 - DNA, 24 bp, Homo sapiens
aggagtgtgggatgtaagtcagcc

SEQ ID NO: 1788 - DNA, 24 bp, Homo sapiens
caactgctcttgaacctgctggaa

SEQ ID NO: 1789 - DNA, 24 bp, Homo sapiens
ggactgcctgagctaagtggaatt

SEQ ID NO: 1790 - DNA, 24 bp, Homo sapiens
gcacaaatgtcagccataagccct

SEQ ID NO: 1791 - DNA, 24 bp, Homo sapiens
ccagcaacaggtggtgtgattcca

SEQ ID NO: 1792 - DNA, 24 bp, Homo sapiens
ttcttcctggcagcctgtgagatt

SEQ ID NO: 1793 - DNA, 24 bp, Homo sapiens
tgtgatcgttgtgctgtcagtggt

SEQ ID NO: 1794 - DNA, 24 bp, Homo sapiens
agtgaaatctgacttggcacagca

SEQ ID NO: 1795 - DNA, 24 bp, Homo sapiens
gatcttatcagaaagggctaccat

SEQ ID NO: 1796 - DNA, 24 bp, Homo sapiens
gcggcaaggaggaggcaagttaaa

SEQ ID NO: 1797 - DNA, 24 bp, Homo sapiens
gggaattctcgcccgagcctcttg

SEQ ID NO: 1798 - DNA, 24 bp, Homo sapiens
cgggaattctcgcccgagcctctt

SEQ ID NO: 1799 - DNA, 24 bp, Homo sapiens
ggaattctcgcccgagcctcttga

SEQ ID NO: 1800 - DNA, 25 bp, Homo sapiens
accacagtgatgcaaggcttcaaca

SEQ ID NO: 1801 - DNA, 24 bp, Homo sapiens
ccagagacactcggatagtacagc

SEQ ID NO: 1802 - DNA, 25 bp, Homo sapiens
gctcctccaccttcatcatctacct

SEQ ID NO: 1803 - DNA, 25 bp, Homo sapiens
tggagagcgttgtcaagaacatagc

SEQ ID NO: 1804 - DNA, 23 bp, Homo sapiens
gcacaacagctcaagcaggaacg

SEQ ID NO: 1805 - DNA, 24 bp, Homo sapiens
gaaactcactgtcagagcactccc

SEQ ID NO: 1806 - DNA, 24 bp, Homo sapiens
gggtccctagaagaagctgaagca

SEQ ID NO: 1807 - DNA, 25 bp, Homo sapiens
aattgaagaacgaaggacctcagag

SEQ ID NO: 1808 - DNA, 25 bp, Homo sapiens
actttgtcagaaatccgcttgcctc

SEQ ID NO: 1809 - DNA, 25 bp, Homo sapiens
tctacgacaccaggaggaacaggaa

SEQ ID NO: 1810 - DNA, 24 bp, Homo sapiens
ctacgacaccaggaggaacaggaa

SEQ ID NO: 1811 - DNA, 24 bp, Homo sapiens
tctacgacaccaggaggaacagga

SEQ ID NO: 1812 - DNA, 24 bp, Homo sapiens
tacgacaccaggaggaacaggaat

SEQ ID NO: 1813 - DNA, 24 bp, Homo sapiens
cagctcaagcaggaacgtcaaaaa

SEQ ID NO: 1814 - DNA, 24 bp, Homo sapiens
acagctcaagcaggaacgtcaaaa

SEQ ID NO: 1815 - DNA, 24 bp, Homo sapiens
agctcaagcaggaacgtcaaaaag

SEQ ID NO: 1816 - DNA, 23 bp, Homo sapiens
ctcgtagcacaccccacagaacc

SEQ ID NO: 1817 - DNA, 23 bp, Homo sapiens
aagcagcgaagaacaggaagatg

SEQ ID NO: 1818 - DNA, 25 bp, Homo sapiens
tctggtgatagccttggttctgaag

SEQ ID NO: 1819 - DNA, 25 bp, Homo sapiens
aagaacatagcaaagaaagtccagc

SEQ ID NO: 1820 - DNA, 25 bp, Homo sapiens
cacaccccacagaacccccattatt

SEQ ID NO: 1821 - DNA, 25 bp, Homo sapiens
agcaggtgattgttcggaaggaaga

SEQ ID NO: 1822 - DNA, 25 bp, Homo sapiens
aggctcttaactgctgtgttgatga

SEQ ID NO: 1823 - DNA, 23 bp, Homo sapiens
tgagagagcggtctgagcgagtc

SEQ ID NO: 1824 - DNA, 24 bp, Homo sapiens
cattctcaggttgctggcagactg

SEQ ID NO: 1825 - DNA, 25 bp, Homo sapiens
ggtctgatcctgaacaacaacaagc

SEQ ID NO: 1826 - DNA, 25 bp, Homo sapiens
gaagttgcgaaggctgtatctgtcc

SEQ ID NO: 1827 - DNA, 25 bp, Homo sapiens
tgacggtgttccatatcagaattgc

SEQ ID NO: 1828 - DNA, 24 bp, Homo sapiens
gcgttggtggtcttcgcggcgcaa

SEQ ID NO: 1829 - DNA, 24 bp, Homo sapiens
ggcgttggtggtcttcgcggcgca

SEQ ID NO: 1830 - DNA, 24 bp, Homo sapiens
cgttggtggtcttcgcggcgcaac

SEQ ID NO: 1831 - DNA, 24 bp, Homo sapiens
gcgttggtggtctccgcggcggcg

SEQ ID NO: 1832 - DNA, 24 bp, Homo sapiens
ggcgttggtggtctccgcggcggc

SEQ ID NO: 1833 - DNA, 24 bp, Homo sapiens
cgttggtggtctccgcggcggcga

SEQ ID NO: 1834 - DNA, 23 bp, Homo sapiens
ccaagatgcacgtccgcttcctt

SEQ ID NO: 1835 - DNA, 23 bp, Homo sapiens
gaaaccatggccctctgccactg

SEQ ID NO: 1836 - DNA, 23 bp, Homo sapiens
ttcatggagcactggaagcggaa

SEQ ID NO: 1837 - DNA, 24 bp, Homo sapiens
gactcaactaccgctgggacctca

SEQ ID NO: 1838 - DNA, 25 bp, Homo sapiens
aagaggaagaggaggctgtcaagga

SEQ ID NO: 1839 - DNA, 25 bp, Homo sapiens
gcctacctcactaacttggtctcca

SEQ ID NO: 1840 - DNA, 25 bp, Homo sapiens
atcgtcctcggcgtcatcatctaca

SEQ ID NO: 1841 - DNA, 24 bp, Homo sapiens
cacagccaccgcagtcatcatcaa

SEQ ID NO: 1842 - DNA, 24 bp, Homo sapiens
agtggctcgtgtatgatcagcagc

SEQ ID NO: 1843 - DNA, 25 bp, Homo sapiens
tttgagttggaaaagaaaacggaaa

SEQ ID NO: 1844 - DNA, 24 bp, Homo sapiens
ctcattcactcccacagcagacaa

SEQ ID NO: 1845 - DNA, 25 bp, Homo sapiens
gcagcagaacattgagaattacagg

SEQ ID NO: 1846 - DNA, 25 bp, Homo sapiens
ggtagacagagaagccaagccacac

SEQ ID NO: 1847 - DNA, 25 bp, Homo sapiens
tgaggctgatgactttgagatggct

SEQ ID NO: 1848 - DNA, 25 bp, Homo sapiens
agccaaggtccaagaagtagcaagc

SEQ ID NO: 1849 - DNA, 25 bp, Homo sapiens
tgaatcaggaactgctctctgtggg

SEQ ID NO: 1850 - DNA, 23 bp, Homo sapiens
aagacgacgaactggaggctctc

SEQ ID NO: 1851 - DNA, 23 bp, Homo sapiens
cgctgaccctggctctcaacaag

SEQ ID NO: 1852 - DNA, 24 bp, Homo sapiens
gcatttaccaacctttcaagcctg

SEQ ID NO: 1853 - DNA, 25 bp, Homo sapiens
gatgccaaccatattacctcagtcc

SEQ ID NO: 1854 - DNA, 23 bp, Homo sapiens
agttacggcatctgtggctggat

SEQ ID NO: 1855 - DNA, 25 bp, Homo sapiens
tgttctttgctgaattgccacacac

SEQ ID NO: 1856 - DNA, 25 bp, Homo sapiens
cagttcctcagagaaattgactaca

SEQ ID NO: 1857 - DNA, 25 bp, Homo sapiens
tgatgctatggactcctactacgac

SEQ ID NO: 1858 - DNA, 25 bp, Homo sapiens
tctgacttctttaacaaggctgtgc

SEQ ID NO: 1859 - DNA, 24 bp, Homo sapiens
aattggagcaaggagaagagccat

SEQ ID NO: 1860 - DNA, 25 bp, Homo sapiens
ccagacattgatgatgccttagaga

SEQ ID NO: 1861 - DNA, 25 bp, Homo sapiens
ggcatgaatagtgttccctcaagaa

SEQ ID NO: 1862 - DNA, 25 bp, Homo sapiens
gagttcttccgcttgttgttggctt

SEQ ID NO: 1863 - DNA, 25 bp, Homo sapiens
gcagcacattcttgattggtctcat

SEQ ID NO: 1864 - DNA, 23 bp, Homo sapiens
aatgtgcctggaatcctagcctt

SEQ ID NO: 1865 - DNA, 25 bp, Homo sapiens
tgaaccacctgacattggaacagac

SEQ ID NO: 1866 - DNA, 24 bp, Homo sapiens
tcaagccagaggactgtcaagcca

SEQ ID NO: 1867 - DNA, 25 bp, Homo sapiens
ggatgtgttcagcatatctgtgcca

SEQ ID NO: 1868 - DNA, 24 bp, Homo sapiens
aaagcatgaggaacgtctgggcac

SEQ ID NO: 1869 - DNA, 24 bp, Homo sapiens
cctcagaccagttccacaccacct

SEQ ID NO: 1870 - DNA, 25 bp, Homo sapiens
gacctggagcctataatggaactgg

SEQ ID NO: 1871 - DNA, 23 bp, Homo sapiens
ggtggtggagaagatgcggcacg

SEQ ID NO: 1872 - DNA, 24 bp, Homo sapiens
agtaaattcagggcaagaagcgaa

SEQ ID NO: 1873 - DNA, 24 bp, Homo sapiens
cagtaaattcagggcaagaagcga

SEQ ID NO: 1874 - DNA, 24 bp, Homo sapiens
gtaaattcagggcaagaagcgaaa

SEQ ID NO: 1875 - DNA, 25 bp, Homo sapiens
agcatttgaacaacctcagaccagt

SEQ ID NO: 1876 - DNA, 23 bp, Homo sapiens
cttggctgctggatgctggttct

SEQ ID NO: 1877 - DNA, 24 bp, Homo sapiens
cgaagcctggaggatggaacactg

SEQ ID NO: 1878 - DNA, 25 bp, Homo sapiens
agtcagtggaacaagccgagtaagc

SEQ ID NO: 1879 - DNA, 25 bp, Homo sapiens
ggcagtgactatgaggaccgttact

SEQ ID NO: 1880 - DNA, 25 bp, Homo sapiens
ggatgagtacagcaaccagaacaac

SEQ ID NO: 1881 - DNA, 24 bp, Homo sapiens
ccacagtcagtggaacaagccgag

SEQ ID NO: 1882 - DNA, 24 bp, Homo sapiens
cccacagtcagtggaacaagccga

SEQ ID NO: 1883 - DNA, 24 bp, Homo sapiens
cacagtcagtggaacaagccgagt

SEQ ID NO: 1884 - DNA, 24 bp, Homo sapiens
agcattgcctggttactgtggaga

SEQ ID NO: 1885 - DNA, 24 bp, Homo sapiens
actggtgttatgcttgccttggtt

SEQ ID NO: 1886 - DNA, 24 bp, Homo sapiens
gtgccctttgctgtgtccttggtg

SEQ ID NO: 1887 - DNA, 24 bp, Homo sapiens
ggctgggctggtctcaaacttctg

SEQ ID NO: 1888 - DNA, 25 bp, Homo sapiens
agagaagaagagagggtgagaaaca

SEQ ID NO: 1889 - DNA, 25 bp, Homo sapiens
tggctattgcttcagaattatgtgg

SEQ ID NO: 1890 - DNA, 24 bp, Homo sapiens
acattctttcaggtcctgcatact

SEQ ID NO: 1891 - DNA, 24 bp, Homo sapiens
gacattctttcaggtcctgcatac

SEQ ID NO: 1892 - DNA, 24 bp, Homo sapiens
cattctttcaggtcctgcatactg

SEQ ID NO: 1893 - DNA, 25 bp, Homo sapiens
agagtgaatatgtgtcgcatccaga

SEQ ID NO: 1894 - DNA, 23 bp, Homo sapiens
acttggctgctgtcatccttcat

SEQ ID NO: 1895 - DNA, 24 bp, Homo sapiens
ccgcacaaccatactgttaagcag

SEQ ID NO: 1896 - DNA, 25 bp, Homo sapiens
aaggaccctaccagaagctaaatca

SEQ ID NO: 1897 - DNA, 25 bp, Homo sapiens
caatctcccttaccctgaccaatca

SEQ ID NO: 1898 - DNA, 23 bp, Homo sapiens
attttccagccccttgcctccca

SEQ ID NO: 1899 - DNA, 24 bp, Homo sapiens
tttcccacgaacgtccacttcaaa

SEQ ID NO: 1900 - DNA, 24 bp, Homo sapiens
ctttcccacgaacgtccacttcaa

SEQ ID NO: 1901 - DNA, 24 bp, Homo sapiens
ttcccacgaacgtccacttcaaaa

SEQ ID NO: 1902 - DNA, 25 bp, Homo sapiens
tgtagtaactgacacggttcctgga

SEQ ID NO: 1903 - DNA, 25 bp, Homo sapiens
agatggacagatggatggcttgacc

SEQ ID NO: 1904 - DNA, 23 bp, Homo sapiens
ggttcacagaagactccaagcct

SEQ ID NO: 1905 - DNA, 23 bp, Homo sapiens
ttcatgctgttgctgcttagaaa

SEQ ID NO: 1906 - DNA, 25 bp, Homo sapiens
ggaacgcaatgtgggactaaagagc

SEQ ID NO: 1907 - DNA, 25 bp, Homo sapiens
cagaagtgggatgagtcatgcaact

SEQ ID NO: 1908 - DNA, 25 bp, Homo sapiens
atttcccccttcagatctaacgatt

SEQ ID NO: 1909 - DNA, 25 bp, Homo sapiens
aaggaagttggaatgggagttggcg

SEQ ID NO: 1910 - DNA, 24 bp, Homo sapiens
gtgggttagtggtcctcaggatgt

SEQ ID NO: 1911 - DNA, 24 bp, Homo sapiens
ggtgggttagtggtcctcaggatg

SEQ ID NO: 1912 - DNA, 24 bp, Homo sapiens
tgggttagtggtcctcaggatgtg

SEQ ID NO: 1913 - DNA, 24 bp, Homo sapiens
ggggaaggattggtgctggggcaa

SEQ ID NO: 1914 - DNA, 24 bp, Homo sapiens
tggggaaggattggtgctggggca

SEQ ID NO: 1915 - DNA, 24 bp, Homo sapiens
gggaaggattggtgctggggcaac

SEQ ID NO: 1916 - DNA, 25 bp, Homo sapiens
gcatcctctgtcctgatctaggtgt

SEQ ID NO: 1917 - DNA, 25 bp, Homo sapiens
ggttgttgtagttgtcctggtgcct

SEQ ID NO: 1918 - DNA, 25 bp, Homo sapiens
ctctccctacttgtcccatatttgc

SEQ ID NO: 1919 - DNA, 23 bp, Homo sapiens
accctgacccctaatcccactgc

SEQ ID NO: 1920 - DNA, 24 bp, Homo sapiens
gcagatcacagaggagaagccact

SEQ ID NO: 1921 - DNA, 23 bp, Homo sapiens
gacagacgcctgaggcggccaag

SEQ ID NO: 1922 - DNA, 23 bp, Homo sapiens
gttagctgcccgaatcctcctgg

SEQ ID NO: 1923 - DNA, 24 bp, Homo sapiens
gaccagggacagactcactctgtg

SEQ ID NO: 1924 - DNA, 24 bp, Homo sapiens
ggaccagggacagactcactctgt

SEQ ID NO: 1925 - DNA, 24 bp, Homo sapiens
accagggacagactcactctgtgg

SEQ ID NO: 1926 - DNA, 23 bp, Homo sapiens
caccatggcggagctgcaggagg

SEQ ID NO: 1927 - DNA, 25 bp, Homo sapiens
cctacatcctggcgagatatgctct

SEQ ID NO: 1928 - DNA, 24 bp, Homo sapiens
aataggagcccagccaccatggcg

SEQ ID NO: 1929 - DNA, 24 bp, Homo sapiens
caataggagcccagccaccatggc

SEQ ID NO: 1930 - DNA, 24 bp, Homo sapiens
ataggagcccagccaccatggcgg

SEQ ID NO: 1931 - DNA, 24 bp, Homo sapiens
tgtggagacaccatacggctctgt

SEQ ID NO: 1932 - DNA, 25 bp, Homo sapiens
ccagcgatccttacctaccacgatg

SEQ ID NO: 1933 - DNA, 25 bp, Homo sapiens
agaaccctgacccctaatcccactg

SEQ ID NO: 1934 - DNA, 24 bp, Homo sapiens
cagaggagaagccactgttgccag

SEQ ID NO: 1935 - DNA, 23 bp, Homo sapiens
cctacatcctggcgagatatgct

SEQ ID NO: 1936 - DNA, 24 bp, Homo sapiens
gaggcggccaaggaggctgagtta

SEQ ID NO: 1937 - DNA, 24 bp, Homo sapiens
tgaggcggccaaggaggctgagtt

SEQ ID NO: 1938 - DNA, 24 bp, Homo sapiens
aggcggccaaggaggctgagttag

SEQ ID NO: 1939 - DNA, 24 bp, Homo sapiens
cttttcagccaggaagagctctct

SEQ ID NO: 1940 - DNA, 24 bp, Homo sapiens
tcttttcagccaggaagagctctc

SEQ ID NO: 1941 - DNA, 24 bp, Homo sapiens
ttttcagccaggaagagctctctg

SEQ ID NO: 1942 - DNA, 25 bp, Homo sapiens
gcacccaacctggataacattgaat

SEQ ID NO: 1943 - DNA, 24 bp, Homo sapiens
caacaaccgccgagacctgaactt

SEQ ID NO: 1944 - DNA, 25 bp, Homo sapiens
ctctgtggagacaccatacggctct

SEQ ID NO: 1945 - DNA, 23 bp, Homo sapiens
ttcactgtctatggcacccccaa

SEQ ID NO: 1946 - DNA, 23 bp, Homo sapiens
acgcccagcgatccttacctacc

SEQ ID NO: 1947 - DNA, 25 bp, Homo sapiens
acaataattggagttggtgttggag

SEQ ID NO: 1948 - DNA, 24 bp, Homo sapiens
ggtgtcctgtgatgctggtggtag

SEQ ID NO: 1949 - DNA, 24 bp, Homo sapiens
cagctacaacaaccgccgagacct

SEQ ID NO: 1950 - DNA, 24 bp, Homo sapiens
acagctacaacaaccgccgagacc

SEQ ID NO: 1951 - DNA, 24 bp, Homo sapiens
agctacaacaaccgccgagacctg

SEQ ID NO: 1952 - DNA, 24 bp, Homo sapiens
gaagatgcagtggtggaatgtaac

SEQ ID NO: 1953 - DNA, 24 bp, Homo sapiens
tgaagatgcagtggtggaatgtaa

SEQ ID NO: 1954 - DNA, 24 bp, Homo sapiens
aagatgcagtggtggaatgtaact

SEQ ID NO: 1955 - DNA, 23 bp, Homo sapiens
aagggttggatggattgggcagc

SEQ ID NO: 1956 - DNA, 23 bp, Homo sapiens
ccccacccagacctcgttcctca

SEQ ID NO: 1957 - DNA, 25 bp, Homo sapiens
tctgtggagacaccatacggctctg

SEQ ID NO: 1958 - DNA, 24 bp, Homo sapiens
gctctgtcactttcactgtctatg

SEQ ID NO: 1959 - DNA, 24 bp, Homo sapiens
ggctctgtcactttcactgtctat

SEQ ID NO: 1960 - DNA, 24 bp, Homo sapiens
ctctgtcactttcactgtctatgg

SEQ ID NO: 1961 - DNA, 23 bp, Homo sapiens
gccaaggaggctgagttagctgc

SEQ ID NO: 1962 - DNA, 23 bp, Homo sapiens
ggagaagccactgttgccaggac

SEQ ID NO: 1963 - DNA, 25 bp, Homo sapiens
ggaatgtaactcaaaactggacccc

SEQ ID NO: 1964 - DNA, 25 bp, Homo sapiens
tgaaggtcttgtcctcatcaacatt

SEQ ID NO: 1965 - DNA, 24 bp, Homo sapiens
gcgagatatgctcttaaccacccg

SEQ ID NO: 1966 - DNA, 24 bp, Homo sapiens
ggcgagatatgctcttaaccaccc

SEQ ID NO: 1967 - DNA, 24 bp, Homo sapiens
cgagatatgctcttaaccacccgg

SEQ ID NO: 1968 - DNA, 24 bp, Homo sapiens
gcagcccacaagctaacaggcctc

SEQ ID NO: 1969 - DNA, 24 bp, Homo sapiens
ggcagcccacaagctaacaggcct

SEQ ID NO: 1970 - DNA, 24 bp, Homo sapiens
cagcccacaagctaacaggcctca

SEQ ID NO: 1971 - DNA, 23 bp, Homo sapiens
ttcagttcgaggacatgcaggaa

SEQ ID NO: 1972 - DNA, 24 bp, Homo sapiens
gttggtgttggagctggagcctac

SEQ ID NO: 1973 - DNA, 24 bp, Homo sapiens
cagacctcgttcctcaagatggct

SEQ ID NO: 1974 - DNA, 23 bp, Homo sapiens
aatgtaactcaaaactggacccc

SEQ ID NO: 1975 - DNA, 24 bp, Homo sapiens
gaccccacccagacctcgttcctc

SEQ ID NO: 1976 - DNA, 24 bp, Homo sapiens
ggaccccacccagacctcgttcct

SEQ ID NO: 1977 - DNA, 24 bp, Homo sapiens
accccacccagacctcgttcctca

SEQ ID NO: 1978 - DNA, 25 bp, Homo sapiens
acactgttgaaggtcttgtcctcat

SEQ ID NO: 1979 - DNA, 23 bp, Homo sapiens
ggaacagctacaacaaccgccga

SEQ ID NO: 1980 - DNA, 23 bp, Homo sapiens
aactttgagcgtggaggtgatat

SEQ ID NO: 1981 - DNA, 23 bp, Homo sapiens
agaccaagcacctcatgaagatg

SEQ ID NO: 1982 - DNA, 24 bp, Homo sapiens
gtgatgctggtggtaggagaccaa

SEQ ID NO: 1983 - DNA, 24 bp, Homo sapiens
tgtgatgctggtggtaggagacca

SEQ ID NO: 1984 - DNA, 24 bp, Homo sapiens
tgatgctggtggtaggagaccaag

SEQ ID NO: 1985 - DNA, 23 bp, Homo sapiens
gtgtcctgtgatgctggtggtag

SEQ ID NO: 1986 - DNA, 23 bp, Homo sapiens
cccacccagacctcgttcctcaa

SEQ ID NO: 1987 - DNA, 23 bp, Homo sapiens
tggaccagcttgcagacatgatc

SEQ ID NO: 1988 - DNA, 23 bp, Homo sapiens
agttggtgttggagctggagcct

SEQ ID NO: 1989 - DNA, 24 bp, Homo sapiens
tggcgagatatgctcttaaccacc

SEQ ID NO: 1990 - DNA, 25 bp, Homo sapiens
caggaggtgcagatcacagaggaga

SEQ ID NO: 1991 - DNA, 24 bp, Homo sapiens
acggctctgtcactttcactgtct

SEQ ID NO: 1992 - DNA, 23 bp, Homo sapiens
cccaaacccaaacgcccagcgat

SEQ ID NO: 1993 - DNA, 23 bp, Homo sapiens
ctaccacgatgtgggactcaact

SEQ ID NO: 1994 - DNA, 25 bp, Homo sapiens
catggtcatgtgtttctgtgtgaat

SEQ ID NO: 1995 - DNA, 24 bp, Homo sapiens
gtgtctctccaggaggctgagtta

SEQ ID NO: 1996 - DNA, 24 bp, Homo sapiens
tgtgtctctccaggaggctgagtt

SEQ ID NO: 1997 - DNA, 24 bp, Homo sapiens
tgtctctccaggaggctgagttag

SEQ ID NO: 1998 - DNA, 24 bp, Homo sapiens
agttagctgcccgaatcctcctgg

SEQ ID NO: 1999 - DNA, 23 bp, Homo sapiens
gccaataggagcccagccaccat

SEQ ID NO: 2000 - DNA, 25 bp, Homo sapiens
ccatacggctctgtcactttcactg

SEQ ID NO: 2001 - DNA, 23 bp, Homo sapiens
gcacccccaaacccaaacgccca

SEQ ID NO: 2002 - DNA, 23 bp, Homo sapiens
ggctgagttagctgcccgaatcc

SEQ ID NO: 2003 - DNA, 24 bp, Homo sapiens
gctgccagatgccattgctagaca

SEQ ID NO: 2004 - DNA, 24 bp, Homo sapiens
atggacaccaaccctgatgaggaa

SEQ ID NO: 2005 - DNA, 25 bp, Homo sapiens
ctgcctagctcccataatcctccac

SEQ ID NO: 2006 - DNA, 25 bp, Homo sapiens
tggacaccaaccctgatgaggaatt

SEQ ID NO: 2007 - DNA, 24 bp, Homo sapiens
ccattccacctacatcctcgccta

SEQ ID NO: 2008 - DNA, 24 bp, Homo sapiens
tcctcgcctagtctcctcccatct

SEQ ID NO: 2009 - DNA, 24 bp, Homo sapiens
gggcatttagtgaaagggacagcg

SEQ ID NO: 2010 - DNA, 25 bp, Homo sapiens
gctccaatactgcctatacacagaa

SEQ ID NO: 2011 - DNA, 25 bp, Homo sapiens
aattgggcacgaaagagatgatgat

SEQ ID NO: 2012 - DNA, 25 bp, Homo sapiens
aaggcttccacactattcattcagg

SEQ ID NO: 2013 - DNA, 24 bp, Homo sapiens
aagacactctgttgctggttctgt

SEQ ID NO: 2014 - DNA, 25 bp, Homo sapiens
tgctgagattgagaactgctcttcc

SEQ ID NO: 2015 - DNA, 25 bp, Homo sapiens
aaggcagccatttaccaaacacagg

SEQ ID NO: 2016 - DNA, 24 bp, Homo sapiens
gcttccacagacaccactcgctac

SEQ ID NO: 2017 - DNA, 25 bp, Homo sapiens
tcaacactccttcattactgtcacc

SEQ ID NO: 2018 - DNA, 25 bp, Homo sapiens
gcattcagcttcgagcttccacaga

SEQ ID NO: 2019 - DNA, 24 bp, Homo sapiens
ggcacgaaagagatgatgataatt

SEQ ID NO: 2020 - DNA, 24 bp, Homo sapiens
gggcacgaaagagatgatgataat

SEQ ID NO: 2021 - DNA, 24 bp, Homo sapiens
gcacgaaagagatgatgataattc

SEQ ID NO: 2022 - DNA, 25 bp, Homo sapiens
cgctattgggtgaaagccgaattgc

SEQ ID NO: 2023 - DNA, 24 bp, Homo sapiens
ccaaacctcaagcagaatctaaga

SEQ ID NO: 2024 - DNA, 24 bp, Homo sapiens
cccaaacctcaagcagaatctaag

SEQ ID NO: 2025 - DNA, 24 bp, Homo sapiens
caaacctcaagcagaatctaagaa

SEQ ID NO: 2026 - DNA, 24 bp, Homo sapiens
gcaactggaagaagcaatttggcg

SEQ ID NO: 2027 - DNA, 24 bp, Homo sapiens
acctgaacacagccctgaagacca

SEQ ID NO: 2028 - DNA, 24 bp, Homo sapiens
cacaatgccgaatgccagaagact

SEQ ID NO: 2029 - DNA, 24 bp, Homo sapiens
ctgggaattgtaggtgtggacgtg

SEQ ID NO: 2030 - DNA, 24 bp, Homo sapiens
gcttacattcttgaagacgtgacg

SEQ ID NO: 2031 - DNA, 25 bp, Homo sapiens
caagactctttggcttcctatactt

SEQ ID NO: 2032 - DNA, 23 bp, Homo sapiens
gcacacagtccagaaagaaggcg

SEQ ID NO: 2033 - DNA, 23 bp, Homo sapiens
tacagcaccatgagcccacagga

SEQ ID NO: 2034 - DNA, 25 bp, Homo sapiens
tgatgaggacttagacctggatacc

SEQ ID NO: 2035 - DNA, 24 bp, Homo sapiens
cgctattgtgaatcctggtagaga

SEQ ID NO: 2036 - DNA, 24 bp, Homo sapiens
ctaccacaacacactacaatcgca

SEQ ID NO: 2037 - DNA, 24 bp, Homo sapiens
acaatgaagccaagactaaccgat

SEQ ID NO: 2038 - DNA, 24 bp, Homo sapiens
atgagtctcgtattggtctagctg

SEQ ID NO: 2039 - DNA, 24 bp, Homo sapiens
tggaatccgagaagaaggcagtta

SEQ ID NO: 2040 - DNA, 24 bp, Homo sapiens
atctgtctagtggttcttgtgggt

SEQ ID NO: 2041 - DNA, 24 bp, Homo sapiens
aaacaattccagctcctgagccag

SEQ ID NO: 2042 - DNA, 24 bp, Homo sapiens
gaaacaattccagctcctgagcca

SEQ ID NO: 2043 - DNA, 24 bp, Homo sapiens
aacaattccagctcctgagccagt

SEQ ID NO: 2044 - DNA, 25 bp, Homo sapiens
cccaccacggacaccataaaccatt

SEQ ID NO: 2045 - DNA, 25 bp, Homo sapiens
acacatatactcaaagctcatgctg

SEQ ID NO: 2046 - DNA, 23 bp, Homo sapiens
tttggatcgccatatgcaaaccc

SEQ ID NO: 2047 - DNA, 23 bp, Homo sapiens
gacaccataaaccattccgatgc

SEQ ID NO: 2048 - DNA, 25 bp, Homo sapiens
ccttcaagtcctcctataacagccg

SEQ ID NO: 2049 - DNA, 24 bp, Homo sapiens
aaatgcatccgggtcagtgtgcag

SEQ ID NO: 2050 - DNA, 24 bp, Homo sapiens
caaatgcatccgggtcagtgtgca

SEQ ID NO: 2051 - DNA, 24 bp, Homo sapiens
aatgcatccgggtcagtgtgcagc

SEQ ID NO: 2052 - DNA, 24 bp, Homo sapiens
ttctgcctgtctgaagatgctgga

SEQ ID NO: 2053 - DNA, 24 bp, Homo sapiens
cgagccttccagcccttctttgtg

SEQ ID NO: 2054 - DNA, 24 bp, Homo sapiens
tggagaggtcttcacactcaaggc

SEQ ID NO: 2055 - DNA, 24 bp, Homo sapiens
aactaccttcccaaatgcatccgg

SEQ ID NO: 2056 - DNA, 24 bp, Homo sapiens
aggtgtggctgaggtaggagtaac

SEQ ID NO: 2057 - DNA, 24 bp, Homo sapiens
tgacaccatcaccgagtggaaggc

SEQ ID NO: 2058 - DNA, 24 bp, Homo sapiens
aaagacagctacgtgggtgacgaa

SEQ ID NO: 2059 - DNA, 24 bp, Homo sapiens
agcaaaagaggaatcctgaccctg

SEQ ID NO: 2060 - DNA, 24 bp, Homo sapiens
agaagaggacagcactgccttggt

SEQ ID NO: 2061 - DNA, 24 bp, Homo sapiens
atgaagatcctgactgagcgtggc

SEQ ID NO: 2062 - DNA, 24 bp, Homo sapiens
tactgctgagcgtgagattgtccg

SEQ ID NO: 2063 - DNA, 24 bp, Homo sapiens
catcatgcgtctggatctggctgg

SEQ ID NO: 2064 - DNA, 24 bp, Homo sapiens
gctatccaggcggtgctgtctctc

SEQ ID NO: 2065 - DNA, 24 bp, Homo sapiens
ggctatccaggcggtgctgtctct

SEQ ID NO: 2066 - DNA, 24 bp, Homo sapiens
ctatccaggcggtgctgtctctct

SEQ ID NO: 2067 - DNA, 24 bp, Homo sapiens
tgagactttcaatgtcccagccat

SEQ ID NO: 2068 - DNA, 24 bp, Homo sapiens
tcgtgctggactctggagatggtg

SEQ ID NO: 2069 - DNA, 24 bp, Homo sapiens
tcgttactactgctgagcgtgaga

SEQ ID NO: 2070 - DNA, 24 bp, Homo sapiens
ttcgttactactgctgagcgtgag

SEQ ID NO: 2071 - DNA, 24 bp, Homo sapiens
cgttactactgctgagcgtgagat

SEQ ID NO: 2072 - DNA, 24 bp, Homo sapiens
caatggctctgggctctgtaaggc

SEQ ID NO: 2073 - DNA, 24 bp, Homo sapiens
atactctgtctggatcggtggctc

SEQ ID NO: 2074 - DNA, 24 bp, Homo sapiens
gcctctctgtccaccttccagcag

SEQ ID NO: 2075 - DNA, 24 bp, Homo sapiens
tccatgaaaccacctacaacagca

SEQ ID NO: 2076 - DNA, 24 bp, Homo sapiens
tgacatcaggaaggacctctatgc

SEQ ID NO: 2077 - DNA, 24 bp, Homo sapiens
gtgggtgacgaagcacagagcaaa

SEQ ID NO: 2078 - DNA, 24 bp, Homo sapiens
cccacaatgtccccatctatgagg

SEQ ID NO: 2079 - DNA, 24 bp, Homo sapiens
atgccatcatgcgtctggatctgg

SEQ ID NO: 2080 - DNA, 24 bp, Homo sapiens
gtctggatctggctggccgagatc

SEQ ID NO: 2081 - DNA, 24 bp, Homo sapiens
cgtctggatctggctggccgagat

SEQ ID NO: 2082 - DNA, 24 bp, Homo sapiens
tctggatctggctggccgagatct

SEQ ID NO: 2083 - DNA, 24 bp, Homo sapiens
gggacatcaaggagaaactgtgtt

SEQ ID NO: 2084 - DNA, 24 bp, Homo sapiens
ctctggactttgaaaatgagatgg

SEQ ID NO: 2085 - DNA, 24 bp, Homo sapiens
ccgcatcctcatcctcccttgaga

SEQ ID NO: 2086 - DNA, 24 bp, Homo sapiens
aagacagctacgtgggtgacgaag

SEQ ID NO: 2087 - DNA, 24 bp, Homo sapiens
gcaaaagaggaatcctgaccctga

SEQ ID NO: 2088 - DNA, 24 bp, Homo sapiens
cgatagaacatggcatcatcacca

SEQ ID NO: 2089 - DNA, 24 bp, Homo sapiens
ccgatagaacatggcatcatcacc

SEQ ID NO: 2090 - DNA, 24 bp, Homo sapiens
gatagaacatggcatcatcaccaa

SEQ ID NO: 2091 - DNA, 24 bp, Homo sapiens
catcccaccctgctcacggaggca

SEQ ID NO: 2092 - DNA, 24 bp, Homo sapiens
gggtgatggtgggaatgggacaaa

SEQ ID NO: 2093 - DNA, 24 bp, Homo sapiens
agatggtgtcacccacaatgtccc

SEQ ID NO: 2094 - DNA, 24 bp, Homo sapiens
tcatgcgtctggatctggctggcc

SEQ ID NO: 2095 - DNA, 24 bp, Homo sapiens
atcatgcgtctggatctggctggc

SEQ ID NO: 2096 - DNA, 24 bp, Homo sapiens
catgcgtctggatctggctggccg

SEQ ID NO: 2097 - DNA, 24 bp, Homo sapiens
gacgatgctcccagggctgttttc

SEQ ID NO: 2098 - DNA, 24 bp, Homo sapiens
ggcatcatcaccaactgggacgac

SEQ ID NO: 2099 - DNA, 24 bp, Homo sapiens
aaaagacagctacgtgggtgacga

SEQ ID NO: 2100 - DNA, 24 bp, Homo sapiens
gagcaaaagaggaatcctgaccct

SEQ ID NO: 2101 - DNA, 24 bp, Homo sapiens
agagcaaaagaggaatcctgaccc

SEQ ID NO: 2102 - DNA, 24 bp, Homo sapiens
ccagccaagcactgtcaggaatcc

SEQ ID NO: 2103 - DNA, 24 bp, Homo sapiens
tgagaagagttacgagttgcctga

SEQ ID NO: 2104 - DNA, 24 bp, Homo sapiens
tttccgctgcccagagaccctgtt

SEQ ID NO: 2105 - DNA, 24 bp, Homo sapiens
cagagcaaaagaggaatcctgacc

SEQ ID NO: 2106 - DNA, 24 bp, Homo sapiens
tctggagatggtgtcacccacaat

SEQ ID NO: 2107 - DNA, 24 bp, Homo sapiens
ctggctggccgagatctcactgac

SEQ ID NO: 2108 - DNA, 24 bp, Homo sapiens
cctgttccagccatccttcatcgg

SEQ ID NO: 2109 - DNA, 24 bp, Homo sapiens
gccgaccgaatgcagaaggagatc

SEQ ID NO: 2110 - DNA, 24 bp, Homo sapiens
gcaaacaggaatacgatgaagccg

SEQ ID NO: 2111 - DNA, 25 bp, Homo sapiens
tttgtggataatcccgtgggcactg

SEQ ID NO: 2112 - DNA, 25 bp, Homo sapiens
tgtgaatggtagtggtgcctatgcc

SEQ ID NO: 2113 - DNA, 25 bp, Homo sapiens
tggtggcttcagacatgatggttct

SEQ ID NO: 2114 - DNA, 25 bp, Homo sapiens
agcactggatttggaaactttgagg

SEQ ID NO: 2115 - DNA, 23 bp, Homo sapiens
ggccccttgacagtgatctcaaa

SEQ ID NO: 2116 - DNA, 25 bp, Homo sapiens
ggatacaaggctggcatgactcaca

SEQ ID NO: 2117 - DNA, 25 bp, Homo sapiens
aggtgaacaagaaggaggtggtgga

SEQ ID NO: 2118 - DNA, 23 bp, Homo sapiens
gtggttgtgggcattgtgggcta

SEQ ID NO: 2119 - DNA, 24 bp, Homo sapiens
ggaggctgtgaccattgtagagac

SEQ ID NO: 2120 - DNA, 25 bp, Homo sapiens
tgagcacatcagtgatgaatgcaag

SEQ ID NO: 2121 - DNA, 24 bp, Homo sapiens
gtccgcattggggtgctggatgag

SEQ ID NO: 2122 - DNA, 24 bp, Homo sapiens
atgaagctggattacatcctgggc

SEQ ID NO: 2123 - DNA, 24 bp, Homo sapiens
gccaagtccatccaccacgctcgc

SEQ ID NO: 2124 - DNA, 24 bp, Homo sapiens
gctacctcacaaccagtcctgtct

SEQ ID NO: 2125 - DNA, 24 bp, Homo sapiens
agcagtgacaatggcagtcttggc

SEQ ID NO: 2126 - DNA, 24 bp, Homo sapiens
acagtcctttaaccagcacagcca

SEQ ID NO: 2127 - DNA, 24 bp, Homo sapiens
gagtaggcgagtatcagaggatgg

SEQ ID NO: 2128 - DNA, 24 bp, Homo sapiens
aactgaagatgtgcccttacttgg

SEQ ID NO: 2129 - DNA, 24 bp, Homo sapiens
ctgaagtgttaccaactagccaca

SEQ ID NO: 2130 - DNA, 24 bp, Homo sapiens
cactggacaatgatggagacggcg

SEQ ID NO: 2131 - DNA, 24 bp, Homo sapiens
ggttactactgcctgccacgagtt

SEQ ID NO: 2132 - DNA, 24 bp, Homo sapiens
tcaggtctcagtgataaagcgtgc

SEQ ID NO: 2133 - DNA, 24 bp, Homo sapiens
ggcacccttaaaacttccactacc

SEQ ID NO: 2134 - DNA, 24 bp, Homo sapiens
ttcctgtaacagagacggtcatgc

SEQ ID NO: 2135 - DNA, 24 bp, Homo sapiens
aaggacctggacgccaatggagat

SEQ ID NO: 2136 - DNA, 24 bp, Homo sapiens
tgagttcatcgtgttcgtggctgc

SEQ ID NO: 2137 - DNA, 24 bp, Homo sapiens
gatgtcacagattcctggcagagc

SEQ ID NO: 2138 - DNA, 24 bp, Homo sapiens
agcacagatcagcaccatgaagct

SEQ ID NO: 2139 - DNA, 24 bp, Homo sapiens
cagcacagatcagcaccatgaagc

SEQ ID NO: 2140 - DNA, 24 bp, Homo sapiens
gcacagatcagcaccatgaagctt

SEQ ID NO: 2141 - DNA, 23 bp, Homo sapiens
tctgctccttggtcctgggtgtc

SEQ ID NO: 2142 - DNA, 25 bp, Homo sapiens
tcagcgatgccagagagaatatcca

SEQ ID NO: 2143 - DNA, 23 bp, Homo sapiens
ccaatcacttccgacctgctggc

SEQ ID NO: 2144 - DNA, 23 bp, Homo sapiens
agggacccgcagctcagctacag

SEQ ID NO: 2145 - DNA, 24 bp, Homo sapiens
cccaatcacttccgacctgctggc

SEQ ID NO: 2146 - DNA, 24 bp, Homo sapiens
gcttcctcttcactctgctctcag

SEQ ID NO: 2147 - DNA, 24 bp, Homo sapiens
agtgaggtctatgtccagagaagc

SEQ ID NO: 2148 - DNA, 24 bp, Homo sapiens
tgtggagagcctactctgacatga

SEQ ID NO: 2149 - DNA, 24 bp, Homo sapiens
ctatgatgctgccaaaaggggacc

SEQ ID NO: 2150 - DNA, 24 bp, Homo sapiens
catcggctcagacaaatacttcca

SEQ ID NO: 2151 - DNA, 24 bp, Homo sapiens
tctgctccttggtcctgagtgtca

SEQ ID NO: 2152 - DNA, 24 bp, Homo sapiens
gagaatatccagagactcacaggc

SEQ ID NO: 2153 - DNA, 24 bp, Homo sapiens
tcatttgaacgaggcaactcaggg

SEQ ID NO: 2154 - DNA, 24 bp, Homo sapiens
cgaagggtccaccagccaagattg

SEQ ID NO: 2155 - DNA, 24 bp, Homo sapiens
taggaagaggaaggcttgggagta

SEQ ID NO: 2156 - DNA, 24 bp, Homo sapiens
cgctaggaagaggaaggcttggga

SEQ ID NO: 2157 - DNA, 24 bp, Homo sapiens
cttggttaggcattgtgggaaggg

SEQ ID NO: 2158 - DNA, 24 bp, Homo sapiens
cactgtgctgagtctgaaggctgg

SEQ ID NO: 2159 - DNA, 24 bp, Homo sapiens
tccaccatcaagccaccaacatac

SEQ ID NO: 2160 - DNA, 24 bp, Homo sapiens
gtccttaccagcagagcaccttag

SEQ ID NO: 2161 - DNA, 24 bp, Homo sapiens
agtccttaccagcagagcacctta

SEQ ID NO: 2162 - DNA, 24 bp, Homo sapiens
tccttaccagcagagcaccttaga

SEQ ID NO: 2163 - DNA, 24 bp, Homo sapiens
agttccaccatcaagccaccaaca

SEQ ID NO: 2164 - DNA, 24 bp, Homo sapiens
ccctgacaacactcattgacctga

SEQ ID NO: 2165 - DNA, 24 bp, Homo sapiens
acgaacaggaggtgtcagactgct

SEQ ID NO: 2166 - DNA, 25 bp, Homo sapiens
gtgatcatgaagttccagaaccaga

SEQ ID NO: 2167 - DNA, 25 bp, Homo sapiens
accttgcccaatttctcaatgaaga

SEQ ID NO: 2168 - DNA, 25 bp, Homo sapiens
acccaagcatcaaagtctactcagc

SEQ ID NO: 2169 - DNA, 25 bp, Homo sapiens
aagatgagactaccaagacgagcca

SEQ ID NO: 2170 - DNA, 25 bp, Homo sapiens
acagtcttcccacttcactaaccaa

SEQ ID NO: 2171 - DNA, 25 bp, Homo sapiens
agagaagtcaaatagccaaccatca

SEQ ID NO: 2172 - DNA, 25 bp, Homo sapiens
ttgttgctagatccacctcatttgc

SEQ ID NO: 2173 - DNA, 24 bp, Homo sapiens
ccaagccccaaggcacaacggtgt

SEQ ID NO: 2174 - DNA, 24 bp, Homo sapiens
tccaagccccaaggcacaacggtg

SEQ ID NO: 2175 - DNA, 24 bp, Homo sapiens
caagccccaaggcacaacggtgtg

SEQ ID NO: 2176 - DNA, 24 bp, Homo sapiens
ttgaacatctctgtgccagcgagt

SEQ ID NO: 2177 - DNA, 24 bp, Homo sapiens
tgtccccaagaagaagaagcccct

SEQ ID NO: 2178 - DNA, 24 bp, Homo sapiens
gcttgtgctgtacctgaagaatgg

SEQ ID NO: 2179 - DNA, 24 bp, Homo sapiens
ccagcgagtttgcactgaggatga

SEQ ID NO: 2180 - DNA, 24 bp, Homo sapiens
gccagcgagtttgcactgaggatg

SEQ ID NO: 2181 - DNA, 24 bp, Homo sapiens
cagcgagtttgcactgaggatgaa

SEQ ID NO: 2182 - DNA, 24 bp, Homo sapiens
cctgctcaacaagaactgccacgc

SEQ ID NO: 2183 - DNA, 24 bp, Homo sapiens
ggtcttcctctgctcgctcttcgc

SEQ ID NO: 2184 - DNA, 24 bp, Homo sapiens
ccaatgccaccgaagcctccaagc

SEQ ID NO: 2185 - DNA, 24 bp, Homo sapiens
caaaggtaggtgcagggtctgctg

SEQ ID NO: 2186 - DNA, 24 bp, Homo sapiens
ccaaaggtaggtgcagggtctgct

SEQ ID NO: 2187 - DNA, 24 bp, Homo sapiens
aaaggtaggtgcagggtctgctgg

SEQ ID NO: 2188 - DNA, 25 bp, Homo sapiens
ggagccgtctgtatgttgaattagg

SEQ ID NO: 2189 - DNA, 23 bp, Homo sapiens
cgcaacacgtcaccagtcggaaa

SEQ ID NO: 2190 - DNA, 24 bp, Homo sapiens
gctcgctgctttgctggcttgtta

SEQ ID NO: 2191 - DNA, 23 bp, Homo sapiens
gtggtaagtgctgctggctctgg

SEQ ID NO: 2192 - DNA, 23 bp, Homo sapiens
caggtcgccaacagcccaatccc

SEQ ID NO: 2193 - DNA, 25 bp, Homo sapiens
tcttcatcttccagccagtacaagg

SEQ ID NO: 2194 - DNA, 23 bp, Homo sapiens
gcggactccccagaccagaagaa

SEQ ID NO: 2195 - DNA, 23 bp, Homo sapiens
gcctatggtcaaaatccagtttt

SEQ ID NO: 2196 - DNA, 25 bp, Homo sapiens
ttagcaagtgataagaacgactgta

SEQ ID NO: 2197 - DNA, 24 bp, Homo sapiens
aaagcaaaaatgaccctaagactg

SEQ ID NO: 2198 - DNA, 25 bp, Homo sapiens
tgtggaggagaaaaagaaagcctgc

SEQ ID NO: 2199 - DNA, 23 bp, Homo sapiens
acagcccaatcccctaccccatc

SEQ ID NO: 2200 - DNA, 24 bp, Homo sapiens
ccaacggaggaaccactgaagcaa

SEQ ID NO: 2201 - DNA, 24 bp, Homo sapiens
aaatgaccctaagactgaaagaaa

SEQ ID NO: 2202 - DNA, 24 bp, Homo sapiens
tcttccagccagtacaaggccaat

SEQ ID NO: 2203 - DNA, 24 bp, Homo sapiens
atcttccagccagtacaaggccaa

SEQ ID NO: 2204 - DNA, 24 bp, Homo sapiens
cttccagccagtacaaggccaata

SEQ ID NO: 2205 - DNA, 25 bp, Homo sapiens
atcatagcaacagtcacagacaggt

SEQ ID NO: 2206 - DNA, 25 bp, Homo sapiens
agtcccaatccatcttctgctgaaa

SEQ ID NO: 2207 - DNA, 23 bp, Homo sapiens
cgcccttcatctctgcctctgga

SEQ ID NO: 2208 - DNA, 25 bp, Homo sapiens
tggagtggttcaacgaagaaggcaa

SEQ ID NO: 2209 - DNA, 25 bp, Homo sapiens
gcaagcagatgagaatccagacatt

SEQ ID NO: 2210 - DNA, 23 bp, Homo sapiens
ccctcctgcctctcccttacacc

SEQ ID NO: 2211 - DNA, 25 bp, Homo sapiens
atggctctaagtggacaggtttgct

SEQ ID NO: 2212 - DNA, 23 bp, Homo sapiens
gcttgagaatggtgactgatcga

SEQ ID NO: 2213 - DNA, 23 bp, Homo sapiens
tgcttgggccatcggaatacctc

SEQ ID NO: 2214 - DNA, 25 bp, Homo sapiens
gttgaaatcacctgtgtgtcttaat

SEQ ID NO: 2215 - DNA, 25 bp, Homo sapiens
tcctttttggcaagaatatcaagca

SEQ ID NO: 2216 - DNA, 24 bp, Homo sapiens
ttctcctgttatgttctggttgaa

SEQ ID NO: 2217 - DNA, 25 bp, Homo sapiens
tgtgtgtcttaatttctcaattcct

SEQ ID NO: 2218 - DNA, 23 bp, Homo sapiens
cagggtatggctgctttccgacc

SEQ ID NO: 2219 - DNA, 23 bp, Homo sapiens
ccatcatcacgaggcgcttcacc

SEQ ID NO: 2220 - DNA, 23 bp, Homo sapiens
cttctgtgtccagtcaggctgcg

SEQ ID NO: 2221 - DNA, 25 bp, Homo sapiens
gggagtaaaatgttacgttcggaat

SEQ ID NO: 2222 - DNA, 24 bp, Homo sapiens
atccttgcagggccaaaggaagga

SEQ ID NO: 2223 - DNA, 24 bp, Homo sapiens
gatccttgcagggccaaaggaagg

SEQ ID NO: 2224 - DNA, 24 bp, Homo sapiens
tccttgcagggccaaaggaaggac

SEQ ID NO: 2225 - DNA, 24 bp, Homo sapiens
cttggagcatgacctggatgatgt

SEQ ID NO: 2226 - DNA, 25 bp, Homo sapiens
tctcaataagaaggtggctcagcga

SEQ ID NO: 2227 - DNA, 23 bp, Homo sapiens
gctggatggtggacactgaggag

SEQ ID NO: 2228 - DNA, 25 bp, Homo sapiens
agatgtaaactggttaggtcaaggc

SEQ ID NO: 2229 - DNA, 25 bp, Homo sapiens
gtgctgaagaatggatgcttgaagg

SEQ ID NO: 2230 - DNA, 25 bp, Homo sapiens
agcatctggtggactcaagaaaggg

SEQ ID NO: 2231 - DNA, 25 bp, Homo sapiens
ggcttagaaccagagaccttccaga

SEQ ID NO: 2232 - DNA, 25 bp, Homo sapiens
ccgggccatggtagattcacaacaa

SEQ ID NO: 2233 - DNA, 24 bp, Homo sapiens
acgccgaagaatgcagagttcagc

SEQ ID NO: 2234 - DNA, 25 bp, Homo sapiens
ggacctaaggactcgatatactgcc

SEQ ID NO: 2235 - DNA, 23 bp, Homo sapiens
ttcagcgtcagaaggcaacagtg

SEQ ID NO: 2236 - DNA, 24 bp, Homo sapiens
aagtgaagccaagcagtaccgcag

SEQ ID NO: 2237 - DNA, 24 bp, Homo sapiens
tgccgtggaagagaacctcctgaa

SEQ ID NO: 2238 - DNA, 25 bp, Homo sapiens
tcaacagaagatgctggtgtccgaa

SEQ ID NO: 2239 - DNA, 25 bp, Homo sapiens
gcctgattgggtttctagtcctcct

SEQ ID NO: 2240 - DNA, 25 bp, Homo sapiens
cttatctcccatatgagagtgtgaa

SEQ ID NO: 2241 - DNA, 25 bp, Homo sapiens
acctccatttagggatttgcttggg

SEQ ID NO: 2242 - DNA, 25 bp, Homo sapiens
tcggcagatcatcagttagagcgga

SEQ ID NO: 2243 - DNA, 25 bp, Homo sapiens
cccatcacctctactgtctcctccc

SEQ ID NO: 2244 - DNA, 25 bp, Homo sapiens
cattgaagaagaaccagcccagcct

SEQ ID NO: 2245 - DNA, 24 bp, Homo sapiens
ctggtttatgaagaaagcgcagga

SEQ ID NO: 2246 - DNA, 24 bp, Homo sapiens
actggtttatgaagaaagcgcagg

SEQ ID NO: 2247 - DNA, 24 bp, Homo sapiens
tggtttatgaagaaagcgcaggag

SEQ ID NO: 2248 - DNA, 25 bp, Homo sapiens
ctctgtcactgagcaatggtaactg

SEQ ID NO: 2249 - DNA, 24 bp, Homo sapiens
tggtaccttcagccctggccaagc

SEQ ID NO: 2250 - DNA, 24 bp, Homo sapiens
gtggtaccttcagccctggccaag

SEQ ID NO: 2251 - DNA, 24 bp, Homo sapiens
ggtaccttcagccctggccaagct

SEQ ID NO: 2252 - DNA, 24 bp, Homo sapiens
cttcagatgggcagcaacagaggg

SEQ ID NO: 2253 - DNA, 23 bp, Homo sapiens
ccatcccgcttagcctgcctcac

SEQ ID NO: 2254 - DNA, 24 bp, Homo sapiens
aagaatggcgtgattctgagcaag

SEQ ID NO: 2255 - DNA, 24 bp, Homo sapiens
gaagaatggcgtgattctgagcaa

SEQ ID NO: 2256 - DNA, 24 bp, Homo sapiens
agaatggcgtgattctgagcaagc

SEQ ID NO: 2257 - DNA, 23 bp, Homo sapiens
gcaaagacatggcagcagtgcag

SEQ ID NO: 2258 - DNA, 23 bp, Homo sapiens
ctgatggctttgggcagcttggc

SEQ ID NO: 2259 - DNA, 23 bp, Homo sapiens
gcctcagcccaacttcttacccg

SEQ ID NO: 2260 - DNA, 23 bp, Homo sapiens
cgagaagaagtatgacgaggagc

SEQ ID NO: 2261 - DNA, 23 bp, Homo sapiens
agcggctggtggagtggatcata

SEQ ID NO: 2262 - DNA, 25 bp, Homo sapiens
ggtctggctgaagaatggcgtgatt

SEQ ID NO: 2263 - DNA, 23 bp, Homo sapiens
agctttgaggctctgtcactgag

SEQ ID NO: 2264 - DNA, 24 bp, Homo sapiens
ctgggcagctcctccctgtgcccc

SEQ ID NO: 2265 - DNA, 24 bp, Homo sapiens
cctgggcagctcctccctgtgccc

SEQ ID NO: 2266 - DNA, 24 bp, Homo sapiens
tgggcagctcctccctgtgccccc

SEQ ID NO: 2267 - DNA, 23 bp, Homo sapiens
ctgaaggcggctgaggactatgg

SEQ ID NO: 2268 - DNA, 25 bp, Homo sapiens
cagcccaacttcttacccgaaagca

SEQ ID NO: 2269 - DNA, 23 bp, Homo sapiens
ccttggcccctccctcccggctg

SEQ ID NO: 2270 - DNA, 24 bp, Homo sapiens
tcacctctactgtctcctccctgg

SEQ ID NO: 2271 - DNA, 25 bp, Homo sapiens
agaatgatgggcactaccgtggaga

SEQ ID NO: 2272 - DNA, 23 bp, Homo sapiens
cccgaaagcatcactgccttggc

SEQ ID NO: 2273 - DNA, 23 bp, Homo sapiens
aagtccactgtcctccttggcgg

SEQ ID NO: 2274 - DNA, 24 bp, Homo sapiens
tcctttgaagaattgagagcccag

SEQ ID NO: 2275 - DNA, 24 bp, Homo sapiens
acggagaaagcatgagcaatgggt

SEQ ID NO: 2276 - DNA, 24 bp, Homo sapiens
aagttgcatcaggtggtggagaca

SEQ ID NO: 2277 - DNA, 24 bp, Homo sapiens
gcttctgacctcacctgggacaat

SEQ ID NO: 2278 - DNA, 24 bp, Homo sapiens
cagttggcagaaccgctggctgga

SEQ ID NO: 2279 - DNA, 24 bp, Homo sapiens
ccatgggcctgctctacaataaga

SEQ ID NO: 2280 - DNA, 24 bp, Homo sapiens
agggatactacggctacacaggcg

SEQ ID NO: 2281 - DNA, 24 bp, Homo sapiens
tctggttgagaagggagatgtggc

SEQ ID NO: 2282 - DNA, 24 bp, Homo sapiens
tatgagttgctgtgccttgatggt

SEQ ID NO: 2283 - DNA, 24 bp, Homo sapiens
agagatgacacagtatgtttggcc

SEQ ID NO: 2284 - DNA, 24 bp, Homo sapiens
cagagatgacacagtatgtttggc

SEQ ID NO: 2285 - DNA, 24 bp, Homo sapiens
gagatgacacagtatgtttggcca

SEQ ID NO: 2286 - DNA, 24 bp, Homo sapiens
gctccacctcatcactcctggaag

SEQ ID NO: 2287 - DNA, 24 bp, Homo sapiens
tgctccacctcatcactcctggaa

SEQ ID NO: 2288 - DNA, 24 bp, Homo sapiens
ctccacctcatcactcctggaagc

SEQ ID NO: 2289 - DNA, 24 bp, Homo sapiens
ctgtggaggagtatgcgaactgcc

SEQ ID NO: 2290 - DNA, 24 bp, Homo sapiens
ccttaaaatctcagaggtagggct

SEQ ID NO: 2291 - DNA, 24 bp, Homo sapiens
ctggcccaagtggtttgtgctaac

SEQ ID NO: 2292 - DNA, 24 bp, Homo sapiens
caccacgagaggctcaagtgtgat

SEQ ID NO: 2293 - DNA, 24 bp, Homo sapiens
tgtatcagcagagaccaccgaaga

SEQ ID NO: 2294 - DNA, 24 bp, Homo sapiens
catagcgggcaagtgtggtctggt

SEQ ID NO: 2295 - DNA, 24 bp, Homo sapiens
tgtggcctttgtgaaacaccagac

SEQ ID NO: 2296 - DNA, 24 bp, Homo sapiens
aggcgctttcaggtgtctggttga

SEQ ID NO: 2297 - DNA, 24 bp, Homo sapiens
caggcgctttcaggtgtctggttg

SEQ ID NO: 2298 - DNA, 24 bp, Homo sapiens
ggcgctttcaggtgtctggttgag

SEQ ID NO: 2299 - DNA, 24 bp, Homo sapiens
cctgatccatgggctaagaatctg

SEQ ID NO: 2300 - DNA, 24 bp, Homo sapiens
accaaggtgaagatgggaacgcag

SEQ ID NO: 2301 - DNA, 24 bp, Homo sapiens
atgagtttgccctggtttcactgg

SEQ ID NO: 2302 - DNA, 24 bp, Homo sapiens
gctctgtgttgccatgtgtgctga

SEQ ID NO: 2303 - DNA, 24 bp, Homo sapiens
atgagttgctgtgccttgatggta

SEQ ID NO: 2304 - DNA, 24 bp, Homo sapiens
gaatcacgctgtggtcacacggaa

SEQ ID NO: 2305 - DNA, 24 bp, Homo sapiens
aacagcagcacctatttggaagca

SEQ ID NO: 2306 - DNA, 24 bp, Homo sapiens
tccgtagaccttaaaatctcagag

SEQ ID NO: 2307 - DNA, 24 bp, Homo sapiens
atgtcaaggctgttggtaacctga

SEQ ID NO: 2308 - DNA, 24 bp, Homo sapiens
aaccaaggaccttctgttcagaga

SEQ ID NO: 2309 - DNA, 24 bp, Homo sapiens
ttaaaatctcagaggtagggctgc

SEQ ID NO: 2310 - DNA, 24 bp, Homo sapiens
aggtgaagatgggaacgcagatga

SEQ ID NO: 2311 - DNA, 24 bp, Homo sapiens
atttccattcaggatgccggcttt

SEQ ID NO: 2312 - DNA, 24 bp, Homo sapiens
catttccattcaggatgccggctt

SEQ ID NO: 2313 - DNA, 24 bp, Homo sapiens
tttccattcaggatgccggcttta

SEQ ID NO: 2314 - DNA, 24 bp, Homo sapiens
gcagctcgttatgacagcgatggt

SEQ ID NO: 2315 - DNA, 24 bp, Homo sapiens
tgcagctcgttatgacagcgatgg

SEQ ID NO: 2316 - DNA, 24 bp, Homo sapiens
cagctcgttatgacagcgatggtg

SEQ ID NO: 2317 - DNA, 24 bp, Homo sapiens
cccatcagccagtttccgaggtgc

SEQ ID NO: 2318 - DNA, 24 bp, Homo sapiens
actccgcagactactcctcagaga

SEQ ID NO: 2319 - DNA, 24 bp, Homo sapiens
agacaagacacgcctgctcaagaa

SEQ ID NO: 2320 - DNA, 24 bp, Homo sapiens
cccgattagtccagcctctattgc

SEQ ID NO: 2321 - DNA, 24 bp, Homo sapiens
cctagacaagacacgcctgctcaa

SEQ ID NO: 2322 - DNA, 24 bp, Homo sapiens
tgccccgattagtccagcctctat

SEQ ID NO: 2323 - DNA, 24 bp, Homo sapiens
ttccagcagtactccctcctccaa

SEQ ID NO: 2324 - DNA, 24 bp, Homo sapiens
cgttatgacagcgatggtgagaaa

SEQ ID NO: 2325 - DNA, 24 bp, Homo sapiens
gctttgaactcagggtcaccacca

SEQ ID NO: 2326 - DNA, 24 bp, Homo sapiens
ggctttgaactcagggtcaccacc

SEQ ID NO: 2327 - DNA, 24 bp, Homo sapiens
ctttgaactcagggtcaccaccag

SEQ ID NO: 2328 - DNA, 24 bp, Homo sapiens
gcggcaggtcatattgaacattcc

SEQ ID NO: 2329 - DNA, 24 bp, Homo sapiens
gcaagatggctttgaactcagggt

SEQ ID NO: 2330 - DNA, 24 bp, Homo sapiens
gcacctcaaagactaagaaagcac

SEQ ID NO: 2331 - DNA, 24 bp, Homo sapiens
ggagcgcggcaggtcatattgaac

SEQ ID NO: 2332 - DNA, 24 bp, Homo sapiens
tggagcgcggcaggtcatattgaa

SEQ ID NO: 2333 - DNA, 24 bp, Homo sapiens
gagcgcggcaggtcatattgaaca

SEQ ID NO: 2334 - DNA, 24 bp, Homo sapiens
gaaaacccctatcccgcacagccc

SEQ ID NO: 2335 - DNA, 24 bp, Homo sapiens
acctatcattactcgatgctgttg

SEQ ID NO: 2336 - DNA, 24 bp, Homo sapiens
cagctattggaccttactatgaaa

SEQ ID NO: 2337 - DNA, 24 bp, Homo sapiens
atctgaggacatctctgtgccagg

SEQ ID NO: 2338 - DNA, 24 bp, Homo sapiens
tcaccattgcagcctgtaaatgaa

SEQ ID NO: 2339 - DNA, 24 bp, Homo sapiens
gtcaccattgcagcctgtaaatga

SEQ ID NO: 2340 - DNA, 24 bp, Homo sapiens
caccattgcagcctgtaaatgaaa

SEQ ID NO: 2341 - DNA, 24 bp, Homo sapiens
tcccagctctcatatttggacagc

SEQ ID NO: 2342 - DNA, 24 bp, Homo sapiens
acaggtggtcgaaatggctatgga

SEQ ID NO: 2343 - DNA, 24 bp, Homo sapiens
tgtggaaacagccagtagagaata

SEQ ID NO: 2344 - DNA, 24 bp, Homo sapiens
atgttcaaacagacatggatggat

SEQ ID NO: 2345 - DNA, 24 bp, Homo sapiens
aatgttcaaacagacatggatgga

SEQ ID NO: 2346 - DNA, 24 bp, Homo sapiens
tgttcaaacagacatggatggata

SEQ ID NO: 2347 - DNA, 24 bp, Homo sapiens
cctgtaaatgaaaatatgcaagtc

SEQ ID NO: 2348 - DNA, 24 bp, Homo sapiens
tgctaagaaaagactgtctgttga

SEQ ID NO: 2349 - DNA, 24 bp, Homo sapiens
tttgctccgcccagacacctacat

SEQ ID NO: 2350 - DNA, 24 bp, Homo sapiens
atggaactcaagcccttcaatgga

SEQ ID NO: 2351 - DNA, 24 bp, Homo sapiens
gcactaatggtcagaagagcatat

SEQ ID NO: 2352 - DNA, 24 bp, Homo sapiens
acaggtgggaagtgtgtttaacta

SEQ ID NO: 2353 - DNA, 24 bp, Homo sapiens
tcccaaactcgatgatgccaatga

SEQ ID NO: 2354 - DNA, 24 bp, Homo sapiens
tgagtgtacgcttatcctgactga

SEQ ID NO: 2355 - DNA, 24 bp, Homo sapiens
ccttggtgtggttgggagagacaa

SEQ ID NO: 2356 - DNA, 24 bp, Homo sapiens
gctacatccaagggtggcagacat

SEQ ID NO: 2357 - DNA, 24 bp, Homo sapiens
tgaagaagaagaacaagggtggtg

SEQ ID NO: 2358 - DNA, 24 bp, Homo sapiens
aacccaacctttgactctcagaca

SEQ ID NO: 2359 - DNA, 24 bp, Homo sapiens
ggttcccacatcaaaggcttgctg

SEQ ID NO: 2360 - DNA, 24 bp, Homo sapiens
gccctctcttctgcgacatcgttt

SEQ ID NO: 2361 - DNA, 24 bp, Homo sapiens
cctgaatttgaagagtggaagagt

SEQ ID NO: 2362 - DNA, 24 bp, Homo sapiens
ttgtggaaagaagacttggctaca

SEQ ID NO: 2363 - DNA, 24 bp, Homo sapiens
agaaatgaaaaagaacaagagctg

SEQ ID NO: 2364 - DNA, 24 bp, Homo sapiens
aagaaatgaaaaagaacaagagct

SEQ ID NO: 2365 - DNA, 24 bp, Homo sapiens
gaaatgaaaaagaacaagagctgg

SEQ ID NO: 2366 - DNA, 24 bp, Homo sapiens
gaagaattggaggctgttgaagcc

SEQ ID NO: 2367 - DNA, 24 bp, Homo sapiens
tgaagaattggaggctgttgaagc

SEQ ID NO: 2368 - DNA, 24 bp, Homo sapiens
aagaattggaggctgttgaagcca

SEQ ID NO: 2369 - DNA, 24 bp, Homo sapiens
aggaatgcttggtgctgaatctgc

SEQ ID NO: 2370 - DNA, 24 bp, Homo sapiens
agcccagcaaaaggttccagatga

SEQ ID NO: 2371 - DNA, 24 bp, Homo sapiens
ccgtaacagattctggaccaacct

SEQ ID NO: 2372 - DNA, 24 bp, Homo sapiens
accatagaaatgaaagcagaggca

SEQ ID NO: 2373 - DNA, 24 bp, Homo sapiens
cctcaagaagatggtgtggaacta

SEQ ID NO: 2374 - DNA, 24 bp, Homo sapiens
aggaaagaagagaaatccctggtc

SEQ ID NO: 2375 - DNA, 24 bp, Homo sapiens
tggattcagatgaagatttctcag

SEQ ID NO: 2376 - DNA, 24 bp, Homo sapiens
cagatgctagtccacctaagacca

SEQ ID NO: 2377 - DNA, 24 bp, Homo sapiens
ttagtaacaaagaactgaaaccac

SEQ ID NO: 2378 - DNA, 24 bp, Homo sapiens
ggagagcagcaacaaaaacaaaat

SEQ ID NO: 2379 - DNA, 24 bp, Homo sapiens
cggagagcagcaacaaaaacaaaa

SEQ ID NO: 2380 - DNA, 24 bp, Homo sapiens
gagagcagcaacaaaaacaaaatt

SEQ ID NO: 2381 - DNA, 24 bp, Homo sapiens
aagccctcaagaagatggtgtgga

SEQ ID NO: 2382 - DNA, 24 bp, Homo sapiens
agaatcagataggagcagtgacga

SEQ ID NO: 2383 - DNA, 24 bp, Homo sapiens
ttgatgtccctccacgagaaacag

SEQ ID NO: 2384 - DNA, 23 bp, Homo sapiens
aaggagaagttgctgcgggtgtc

SEQ ID NO: 2385 - DNA, 23 bp, Homo sapiens
gaggagctgcacaaggcggagga

SEQ ID NO: 2386 - DNA, 23 bp, Homo sapiens
ccgccgaagaggccgccgccaag

SEQ ID NO: 2387 - DNA, 23 bp, Homo sapiens
gacaagaaggcggcggaagacag

SEQ ID NO: 2388 - DNA, 24 bp, Homo sapiens
gctctcagaaggcaaatgtgccga

SEQ ID NO: 2389 - DNA, 24 bp, Homo sapiens
agctctcagaaggcaaatgtgccg

SEQ ID NO: 2390 - DNA, 24 bp, Homo sapiens
ctctcagaaggcaaatgtgccgag

SEQ ID NO: 2391 - DNA, 24 bp, Homo sapiens
caggctgagaagtactcgcagaag

SEQ ID NO: 2392 - DNA, 24 bp, Homo sapiens
tcaggctgagaagtactcgcagaa

SEQ ID NO: 2393 - DNA, 24 bp, Homo sapiens
aggctgagaagtactcgcagaagg

SEQ ID NO: 2394 - DNA, 24 bp, Homo sapiens
aactgtgacgaacaacttgaagtc

SEQ ID NO: 2395 - DNA, 23 bp, Homo sapiens
gacgaacaacttgaagtcactgg

SEQ ID NO: 2396 - DNA, 25 bp, Homo sapiens
gacgaacaacttgaagtcactggag

SEQ ID NO: 2397 - DNA, 24 bp, Homo sapiens
ggtggccgagagccgagccagaca

SEQ ID NO: 2398 - DNA, 24 bp, Homo sapiens
aggtggccgagagccgagccagac

SEQ ID NO: 2399 - DNA, 24 bp, Homo sapiens
gtggccgagagccgagccagacag

SEQ ID NO: 2400 - DNA, 24 bp, Homo sapiens
tcagaggaggagtattccaccaaa

SEQ ID NO: 2401 - DNA, 24 bp, Homo sapiens
ctcagaggaggagtattccaccaa

SEQ ID NO: 2402 - DNA, 24 bp, Homo sapiens
cagaggaggagtattccaccaaag

SEQ ID NO: 2403 - DNA, 24 bp, Homo sapiens
tgatcctggaaggagagctggagc

SEQ ID NO: 2404 - DNA, 24 bp, Homo sapiens
gttggaggagaagctgaaggaggc

SEQ ID NO: 2405 - DNA, 25 bp, Homo sapiens
cgagaggtctgtggcaaagttggag

SEQ ID NO: 2406 - DNA, 24 bp, Homo sapiens
cgatgacctagaagagaccttggc

SEQ ID NO: 2407 - DNA, 25 bp, Homo sapiens
ccaccaaagaagataaatatgaaga

SEQ ID NO: 2408 - DNA, 24 bp, Homo sapiens
aagctgaaggaggctgagacccga

SEQ ID NO: 2409 - DNA, 24 bp, Homo sapiens
gaagctgaaggaggctgagacccg

SEQ ID NO: 2410 - DNA, 24 bp, Homo sapiens
agctgaaggaggctgagacccgag

SEQ ID NO: 2411 - DNA, 23 bp, Homo sapiens
ctgaaggaggccaagcacatcgc

SEQ ID NO: 2412 - DNA, 25 bp, Homo sapiens
cagaccgcaaatatgaagaggtggc

SEQ ID NO: 2413 - DNA, 23 bp, Homo sapiens
gctggtgatcctggaaggagagc

SEQ ID NO: 2414 - DNA, 24 bp, Homo sapiens
cgcattcagctggttgaggaggag

SEQ ID NO: 2415 - DNA, 23 bp, Homo sapiens
ggcccaggagcgcctggctacag

SEQ ID NO: 2416 - DNA, 23 bp, Homo sapiens
agaagctggaggaggccgagaag

SEQ ID NO: 2417 - DNA, 24 bp, Homo sapiens
aaggccactgatgctgaggcagat

SEQ ID NO: 2418 - DNA, 24 bp, Homo sapiens
gaaggccactgatgctgaggcaga

SEQ ID NO: 2419 - DNA, 24 bp, Homo sapiens
aggccactgatgctgaggcagatg

SEQ ID NO: 2420 - DNA, 24 bp, Homo sapiens
tgagagcgagagaggaatgaaggt

SEQ ID NO: 2421 - DNA, 24 bp, Homo sapiens
atgagagcgagagaggaatgaagg

SEQ ID NO: 2422 - DNA, 24 bp, Homo sapiens
gagagcgagagaggaatgaaggtc

SEQ ID NO: 2423 - DNA, 23 bp, Homo sapiens
gccgaagccgacaagaagcaagc

SEQ ID NO: 2424 - DNA, 23 bp, Homo sapiens
agcagcaggccctccagaagaag

SEQ ID NO: 2425 - DNA, 25 bp, Homo sapiens
agtattctgaatccgtgaaggaggc

SEQ ID NO: 2426 - DNA, 25 bp, Homo sapiens
aaggatgaggagaagatggaactgc

SEQ ID NO: 2427 - DNA, 23 bp, Homo sapiens
ggagaaactggagcaggccgaga

SEQ ID NO: 2428 - DNA, 24 bp, Homo sapiens
tattctgaatccgtgaaggaggcc

SEQ ID NO: 2429 - DNA, 24 bp, Homo sapiens
gtattctgaatccgtgaaggaggc

SEQ ID NO: 2430 - DNA, 24 bp, Homo sapiens
attctgaatccgtgaaggaggccc

SEQ ID NO: 2431 - DNA, 23 bp, Homo sapiens
gaaccgccgcattcagctggttg

SEQ ID NO: 2432 - DNA, 23 bp, Homo sapiens
agctggaccgggcccaggagcgc

SEQ ID NO: 2433 - DNA, 24 bp, Homo sapiens
gctggcagagtcccgttgccgaga

SEQ ID NO: 2434 - DNA, 24 bp, Homo sapiens
agctggcagagtcccgttgccgag

SEQ ID NO: 2435 - DNA, 24 bp, Homo sapiens
ctggcagagtcccgttgccgagag

SEQ ID NO: 2436 - DNA, 23 bp, Homo sapiens
tggctgggatcaccaccatcgag

SEQ ID NO: 2437 - DNA, 23 bp, Homo sapiens
tccagcgagaagttgagggagaa

SEQ ID NO: 2438 - DNA, 24 bp, Homo sapiens
gcccgggaacaggctgaggctgag

SEQ ID NO: 2439 - DNA, 24 bp, Homo sapiens
ggcccgggaacaggctgaggctga

SEQ ID NO: 2440 - DNA, 24 bp, Homo sapiens
cccgggaacaggctgaggctgagg

SEQ ID NO: 2441 - DNA, 23 bp, Homo sapiens
ccttgaaccgtaggatccagctg

SEQ ID NO: 2442 - DNA, 23 bp, Homo sapiens
gaagagctggaccgtgctcagga

SEQ ID NO: 2443 - DNA, 23 bp, Homo sapiens
gccctgcaaaagctggaagaagc

SEQ ID NO: 2444 - DNA, 25 bp, Homo sapiens
cagcgagaagttgagggagaaaggc

SEQ ID NO: 2445 - DNA, 23 bp, Homo sapiens
ggaacaggctgaggctgaggtgg

SEQ ID NO: 2446 - DNA, 23 bp, Homo sapiens
gttgaagaagagctggaccgtgc

SEQ ID NO: 2447 - DNA, 23 bp, Homo sapiens
gcgcctggccactgccctgcaaa

SEQ ID NO: 2448 - DNA, 25 bp, Homo sapiens
attgaaaaccgggccttaaaagatg

SEQ ID NO: 2449 - DNA, 25 bp, Homo sapiens
agatggaactccaggaaatccaact

SEQ ID NO: 2450 - DNA, 25 bp, Homo sapiens
agctaagcacattgcagaagaggca

SEQ ID NO: 2451 - DNA, 24 bp, Homo sapiens
tgagagtgagagaggtatgaaggt

SEQ ID NO: 2452 - DNA, 24 bp, Homo sapiens
atgagagtgagagaggtatgaagg

SEQ ID NO: 2453 - DNA, 24 bp, Homo sapiens
gagagtgagagaggtatgaaggtt

SEQ ID NO: 2454 - DNA, 24 bp, Homo sapiens
agatgaagaaaagatggaactcca

SEQ ID NO: 2455 - DNA, 24 bp, Homo sapiens
aagatgaagaaaagatggaactcc

SEQ ID NO: 2456 - DNA, 24 bp, Homo sapiens
gatgaagaaaagatggaactccag

SEQ ID NO: 2457 - DNA, 24 bp, Homo sapiens
gctgctgatgagagtgagagaggt

SEQ ID NO: 2458 - DNA, 25 bp, Homo sapiens
tgaagaggtggctcgtaagttggtg

SEQ ID NO: 2459 - DNA, 23 bp, Homo sapiens
cggtgaagcgcaagatccaggtt

SEQ ID NO: 2460 - DNA, 23 bp, Homo sapiens
cagatgatgcagaggagcgagct

SEQ ID NO: 2461 - DNA, 23 bp, Homo sapiens
ttggaacgcacagaggaacgagc

SEQ ID NO: 2462 - DNA, 23 bp, Homo sapiens
ccgttgccgagagatggatgagc

SEQ ID NO: 2463 - DNA, 24 bp, Homo sapiens
gctgaagaaaagtactctcaaaaa

SEQ ID NO: 2464 - DNA, 24 bp, Homo sapiens
tgctgaagaaaagtactctcaaaa

SEQ ID NO: 2465 - DNA, 24 bp, Homo sapiens
ctgaagaaaagtactctcaaaaag

SEQ ID NO: 2466 - DNA, 23 bp, Homo sapiens
ggctgaggtggcctccttgaacc

SEQ ID NO: 2467 - DNA, 25 bp, Homo sapiens
aacctgaagtgtctgagtgctgctg

SEQ ID NO: 2468 - DNA, 23 bp, Homo sapiens
cagagacccgtgctgagtttgct

SEQ ID NO: 2469 - DNA, 23 bp, Homo sapiens
tcggtagccaagctggaaaagac

SEQ ID NO: 2470 - DNA, 25 bp, Homo sapiens
tgacctggaagataaactgaaatgc

SEQ ID NO: 2471 - DNA, 24 bp, Homo sapiens
ggccagaaagacagctatgtgggg

SEQ ID NO: 2472 - DNA, 24 bp, Homo sapiens
cagagcaagcgagggatcctaact

SEQ ID NO: 2473 - DNA, 24 bp, Homo sapiens
ccattgaacacggcatcatcacca

SEQ ID NO: 2474 - DNA, 24 bp, Homo sapiens
gaccctcttccagccttcctttat

SEQ ID NO: 2475 - DNA, 24 bp, Homo sapiens
agtgtgacattgacatccgtaagg

SEQ ID NO: 2476 - DNA, 24 bp, Homo sapiens
atgccaacaatgtcctctctgggg

SEQ ID NO: 2477 - DNA, 24 bp, Homo sapiens
ctgcgtgtagcacctgaagagcac

SEQ ID NO: 2478 - DNA, 24 bp, Homo sapiens
ccttcaatgtccctgccatgtacg

SEQ ID NO: 2479 - DNA, 24 bp, Homo sapiens
gctgtgctctccctctatgcctct

SEQ ID NO: 2480 - DNA, 24 bp, Homo sapiens
ctggagacaagatgattcacgaga

SEQ ID NO: 2481 - DNA, 24 bp, Homo sapiens
agagtgaggtccagtacatccagg

SEQ ID NO: 2482 - DNA, 24 bp, Homo sapiens
cgacaggagatacaggtggtgcta

SEQ ID NO: 2483 - DNA, 24 bp, Homo sapiens
aaaagcggaaaataaaatgaagat

SEQ ID NO: 2484 - DNA, 24 bp, Homo sapiens
caagatgcggtactggttgcttcc

SEQ ID NO: 2485 - DNA, 24 bp, Homo sapiens
accattgtccaaggtcaagtggct

SEQ ID NO: 2486 - DNA, 24 bp, Homo sapiens
agcggcagaaggagagggagagag

SEQ ID NO: 2487 - DNA, 24 bp, Homo sapiens
tactccgagggaagagagcaaggg

SEQ ID NO: 2488 - DNA, 24 bp, Homo sapiens
ccaaggaccaactagcggcggagc

SEQ ID NO: 2489 - DNA, 24 bp, Homo sapiens
tgcccagcacaggtggctgctaca

SEQ ID NO: 2490 - DNA, 24 bp, Homo sapiens
ttgcccagcacaggtggctgctac

SEQ ID NO: 2491 - DNA, 24 bp, Homo sapiens
gcccagcacaggtggctgctacac

SEQ ID NO: 2492 - DNA, 24 bp, Homo sapiens
accgatggcttctgaccttctact

SEQ ID NO: 2493 - DNA, 24 bp, Homo sapiens
cgagtcaaatgggatgcagtgcct

SEQ ID NO: 2494 - DNA, 24 bp, Homo sapiens
tgcccaatacagaatacacagtca

SEQ ID NO: 2495 - DNA, 24 bp, Homo sapiens
gcaactaaagcaattattcaaggc

SEQ ID NO: 2496 - DNA, 24 bp, Homo sapiens
ccagaccagaattacacagttcaa

SEQ ID NO: 2497 - DNA, 24 bp, Homo sapiens
ataaagataaagaaagcaagccag

SEQ ID NO: 2498 - DNA, 24 bp, Homo sapiens
ttgctgacattgtaatcctggtcg

SEQ ID NO: 2499 - DNA, 24 bp, Homo sapiens
attcaacttcagactggttcggca

SEQ ID NO: 2500 - DNA, 24 bp, Homo sapiens
acctggttacagcattcgatgtgg

SEQ ID NO: 2501 - DNA, 24 bp, Homo sapiens
gctgtccgaaacctcccatataaa

SEQ ID NO: 2502 - DNA, 24 bp, Homo sapiens
acactaacaggtcttgctttgaac

SEQ ID NO: 2503 - DNA, 24 bp, Homo sapiens
agaagcaggatcaaggactggagt

SEQ ID NO: 2504 - DNA, 24 bp, Homo sapiens
cgcctacggagttgattacttctg

SEQ ID NO: 2505 - DNA, 24 bp, Homo sapiens
acgaggtggtggtagatggaactg

SEQ ID NO: 2506 - DNA, 24 bp, Homo sapiens
gcaatctatgcccacactgctagt

SEQ ID NO: 2507 - DNA, 24 bp, Homo sapiens
gagaaattaaagcctcagcccatg

SEQ ID NO: 2508 - DNA, 24 bp, Homo sapiens
agagaaattaaagcctcagcccat

SEQ ID NO: 2509 - DNA, 24 bp, Homo sapiens
agaaattaaagcctcagcccatgc

SEQ ID NO: 2510 - DNA, 24 bp, Homo sapiens
ttcgtgagtctggtgtagaactgt

SEQ ID NO: 2511 - DNA, 24 bp, Homo sapiens
ctgaaccagacagcactcatgtgt

SEQ ID NO: 2512 - DNA, 24 bp, Homo sapiens
acagttgtggagagtctgaccagg

SEQ ID NO: 2513 - DNA, 24 bp, Homo sapiens
gaaccagctacaaccatagtgcct

SEQ ID NO: 2514 - DNA, 24 bp, Homo sapiens
tcgggaccacacttgacagttttt

SEQ ID NO: 2515 - DNA, 24 bp, Homo sapiens
gtcgggaccacacttgacagtttt

SEQ ID NO: 2516 - DNA, 24 bp, Homo sapiens
cgggaccacacttgacagtttttg

SEQ ID NO: 2517 - DNA, 24 bp, Homo sapiens
ctgtgacttcagttttccagacgg

SEQ ID NO: 2518 - DNA, 24 bp, Homo sapiens
tctgtgacttcagttttccagacg

SEQ ID NO: 2519 - DNA, 24 bp, Homo sapiens
tgtgacttcagttttccagacggg

SEQ ID NO: 2520 - DNA, 24 bp, Homo sapiens
ggaacggttatggtgcctggaagc

SEQ ID NO: 2521 - DNA, 24 bp, Homo sapiens
gcctctgcttcctgatactgaata

SEQ ID NO: 2522 - DNA, 24 bp, Homo sapiens
ggatggcgaaggcgtcagcgtctc

SEQ ID NO: 2523 - DNA, 24 bp, Homo sapiens
accaccaacttttcctccaaccat

SEQ ID NO: 2524 - DNA, 24 bp, Homo sapiens
tggaaaaaacacaatcacttccta

SEQ ID NO: 2525 - DNA, 24 bp, Homo sapiens
atggaaaaaacacaatcacttcct

SEQ ID NO: 2526 - DNA, 24 bp, Homo sapiens
ggaaaaaacacaatcacttcctac

SEQ ID NO: 2527 - DNA, 24 bp, Homo sapiens
cctcagcggaatggactacaatgt

SEQ ID NO: 2528 - DNA, 24 bp, Homo sapiens
gtacatcgccatgccacagcctat

SEQ ID NO: 2529 - DNA, 24 bp, Homo sapiens
ggacaaccaggcattgcttctatg

SEQ ID NO: 2530 - DNA, 24 bp, Homo sapiens
aacaagattggcacagatggaacc

SEQ ID NO: 2531 - DNA, 24 bp, Homo sapiens
tgttcgagataccttgttcactgc

SEQ ID NO: 2532 - DNA, 24 bp, Homo sapiens
ggcatcccaaaggttatcgtggtt

SEQ ID NO: 2533 - DNA, 24 bp, Homo sapiens
ttgccctccgactacacaatcagt

SEQ ID NO: 2534 - DNA, 24 bp, Homo sapiens
cggattcttcctgacactccacag

SEQ ID NO: 2535 - DNA, 24 bp, Homo sapiens
ggggttattttagacaatggtggg

SEQ ID NO: 2536 - DNA, 24 bp, Homo sapiens
ccagccaaccaggtacttgcaccc

SEQ ID NO: 2537 - DNA, 24 bp, Homo sapiens
cccagccaaccaggtacttgcacc

SEQ ID NO: 2538 - DNA, 24 bp, Homo sapiens
cagccaaccaggtacttgcaccca

SEQ ID NO: 2539 - DNA, 24 bp, Homo sapiens
tcggagttggttagcattggcagt

SEQ ID NO: 2540 - DNA, 24 bp, Homo sapiens
tctttgtggatgactttgacgcct

SEQ ID NO: 2541 - DNA, 24 bp, Homo sapiens
cagcatcagcaacctgtccagtgg

SEQ ID NO: 2542 - DNA, 24 bp, Homo sapiens
gatgaagtgattgaagctgtccga

SEQ ID NO: 2543 - DNA, 24 bp, Homo sapiens
agagtggaagaacaggacagagaa

SEQ ID NO: 2544 - DNA, 24 bp, Homo sapiens
atggtgtgagagatctgatcccct

SEQ ID NO: 2545 - DNA, 24 bp, Homo sapiens
tatggtgtgagagatctgatcccc

SEQ ID NO: 2546 - DNA, 24 bp, Homo sapiens
tggtgtgagagatctgatccccta

SEQ ID NO: 2547 - DNA, 24 bp, Homo sapiens
gtgagatcagtggcgcgtcaagta

SEQ ID NO: 2548 - DNA, 24 bp, Homo sapiens
gcaggtcattagtgaggtgagcag

SEQ ID NO: 2549 - DNA, 24 bp, Homo sapiens
attccttgcgaactccgaagtcca

SEQ ID NO: 2550 - DNA, 24 bp, Homo sapiens
aggcttcaagggctactggacaat

SEQ ID NO: 2551 - DNA, 24 bp, Homo sapiens
caaggtgcgcttcctggagcagca

SEQ ID NO: 2552 - DNA, 24 bp, Homo sapiens
acaaggtgcgcttcctggagcagc

SEQ ID NO: 2553 - DNA, 24 bp, Homo sapiens
aaggtgcgcttcctggagcagcag

SEQ ID NO: 2554 - DNA, 24 bp, Homo sapiens
agtgtaaaactgcttccatgtcta

SEQ ID NO: 2555 - DNA, 24 bp, Homo sapiens
cagtgtaaaactgcttccatgtct

SEQ ID NO: 2556 - DNA, 24 bp, Homo sapiens
gtgtaaaactgcttccatgtctaa

SEQ ID NO: 2557 - DNA, 25 bp, Homo sapiens
tgatgctgaaaggaataacaaggct

SEQ ID NO: 2558 - DNA, 24 bp, Homo sapiens
agccatttggacagaagccctaaa

SEQ ID NO: 2559 - DNA, 24 bp, Homo sapiens
gagtcctgtgtctacatgcagcgt

SEQ ID NO: 2560 - DNA, 24 bp, Homo sapiens
acccaagactcatctgtcaagccc

SEQ ID NO: 2561 - DNA, 24 bp, Homo sapiens
actgcttttaaggtgccagtcacg

SEQ ID NO: 2562 - DNA, 24 bp, Homo sapiens
gactgcttttaaggtgccagtcac

SEQ ID NO: 2563 - DNA, 24 bp, Homo sapiens
ctgcttttaaggtgccagtcacga

SEQ ID NO: 2564 - DNA, 24 bp, Homo sapiens
acctgctgatcagaagccagaatg

SEQ ID NO: 2565 - DNA, 24 bp, Homo sapiens
tactgggaaaaggatgatgcttcg

SEQ ID NO: 2566 - DNA, 24 bp, Homo sapiens
gccgtttgacctcacagacatcgt

SEQ ID NO: 2567 - DNA, 24 bp, Homo sapiens
gaaggagcacaagtctcaggcgga

SEQ ID NO: 2568 - DNA, 24 bp, Homo sapiens
taagcaagagcagtggagacttct

SEQ ID NO: 2569 - DNA, 24 bp, Homo sapiens
ccagcgtgtgacaaagcctaacct

SEQ ID NO: 2570 - DNA, 24 bp, Homo sapiens
cagaactcagaggtcagcttctgg

SEQ ID NO: 2571 - DNA, 24 bp, Homo sapiens
tcagaactcagaggtcagcttctg

SEQ ID NO: 2572 - DNA, 24 bp, Homo sapiens
agaactcagaggtcagcttctgga

SEQ ID NO: 2573 - DNA, 24 bp, Homo sapiens
caaatatttcagactggtgtaaag

SEQ ID NO: 2574 - DNA, 24 bp, Homo sapiens
acaaatatttcagactggtgtaaa

SEQ ID NO: 2575 - DNA, 24 bp, Homo sapiens
aaatatttcagactggtgtaaagg

SEQ ID NO: 2576 - DNA, 23 bp, Homo sapiens
tcaaggactcgcatccgtcgctt

SEQ ID NO: 2577 - DNA, 23 bp, Homo sapiens
gaaaggggcttcttcggtcccga

SEQ ID NO: 2578 - DNA, 23 bp, Homo sapiens
gtccaggtggccaggcctctgcc

SEQ ID NO: 2579 - DNA, 25 bp, Homo sapiens
ttattcaacagagtgggacctaatg

SEQ ID NO: 2580 - DNA, 25 bp, Homo sapiens
gggaaatgctatactgccatgcctg

SEQ ID NO: 2581 - DNA, 25 bp, Homo sapiens
cccacaggaaaattaccagttttga

SEQ ID NO: 2582 - DNA, 25 bp, Homo sapiens
aactgaaggagacagaagcagccat

SEQ ID NO: 2583 - DNA, 23 bp, Homo sapiens
actgcagaggatgggaaatgcta

SEQ ID NO: 2584 - DNA, 25 bp, Homo sapiens
acagagtgggacctaatggtgagag

SEQ ID NO: 2585 - DNA, 24 bp, Homo sapiens
acaaggcttgaacttctatgccaa

SEQ ID NO: 2586 - DNA, 25 bp, Homo sapiens
aagcaattagaagattcctcctggc

SEQ ID NO: 2587 - DNA, 24 bp, Homo sapiens
actggaaatgttgctcgggctgtt

SEQ ID NO: 2588 - DNA, 23 bp, Homo sapiens
gagacagtgggttcctcaggtcc

SEQ ID NO: 2589 - DNA, 24 bp, Homo sapiens
gctcatggtattggtgatgtggaa

SEQ ID NO: 2590 - DNA, 25 bp, Homo sapiens
tgacctgggagcagacattagtttg

SEQ ID NO: 2591 - DNA, 24 bp, Homo sapiens
ctcatggtattggtgatgtggaaa

SEQ ID NO: 2592 - DNA, 24 bp, Homo sapiens
tcatggtattggtgatgtggaaac

SEQ ID NO: 2593 - DNA, 25 bp, Homo sapiens
gtgtctcattaactctggcaacggt

SEQ ID NO: 2594 - DNA, 25 bp, Homo sapiens
agaagaagaagacatcaagcgagga

SEQ ID NO: 2595 - DNA, 25 bp, Homo sapiens
aggctatcctctgtgatgtgtgaca

SEQ ID NO: 2596 - DNA, 24 bp, Homo sapiens
ctggggctgcaggtaggccacctg

SEQ ID NO: 2597 - DNA, 24 bp, Homo sapiens
actggggctgcaggtaggccacct

SEQ ID NO: 2598 - DNA, 24 bp, Homo sapiens
tggggctgcaggtaggccacctgt

SEQ ID NO: 2599 - DNA, 25 bp, Homo sapiens
atgcggatcgaagtgtacggatgtg

SEQ ID NO: 2600 - DNA, 24 bp, Homo sapiens
gctgccttccactattgctcctgt

SEQ ID NO: 2601 - DNA, 25 bp, Homo sapiens
gcagattaggtacaagctagataga

SEQ ID NO: 2602 - DNA, 25 bp, Homo sapiens
aatcctgatgcatttacctttgatt

SEQ ID NO: 2603 - DNA, 24 bp, Homo sapiens
acatggctgatgggcaacttcacc

SEQ ID NO: 2604 - DNA, 25 bp, Homo sapiens
gggaaattgaagccaatgacatcgt

SEQ ID NO: 2605 - DNA, 24 bp, Homo sapiens
tgtcggtgaaatgtgtggatgccc

SEQ ID NO: 2606 - DNA, 25 bp, Homo sapiens
agtccttggttccaattcatgctgt

SEQ ID NO: 2607 - DNA, 25 bp, Homo sapiens
cgtttccctggcttaccgtgatgac

SEQ ID NO: 2608 - DNA, 25 bp, Homo sapiens
gccgttactatgaatgtgatgtcct

SEQ ID NO: 2609 - DNA, 25 bp, Homo sapiens
cggctgcctgtgaatgagaagaaga

SEQ ID NO: 2610 - DNA, 25 bp, Homo sapiens
caagatccgagacattgaagaggca

SEQ ID NO: 2611 - DNA, 24 bp, Homo sapiens
ccttggttccaattcatgctgttt

SEQ ID NO: 2612 - DNA, 24 bp, Homo sapiens
tccttggttccaattcatgctgtt

SEQ ID NO: 2613 - DNA, 24 bp, Homo sapiens
cttggttccaattcatgctgttta

SEQ ID NO: 2614 - DNA, 24 bp, Homo sapiens
ggagaaaatcaggtagaggtgatg

SEQ ID NO: 2615 - DNA, 24 bp, Homo sapiens
tggagaaaatcaggtagaggtgat

SEQ ID NO: 2616 - DNA, 24 bp, Homo sapiens
gagaaaatcaggtagaggtgatgg

SEQ ID NO: 2617 - DNA, 25 bp, Homo sapiens
ttgaagaagttgacggctcctcacc

SEQ ID NO: 2618 - DNA, 25 bp, Homo sapiens
cagatgatgaagtttccagcagtga

SEQ ID NO: 2619 - DNA, 25 bp, Homo sapiens
agggagaaacgactgaggacaaaga

SEQ ID NO: 2620 - DNA, 23 bp, Homo sapiens
tcaccaggaggcaaggcttcaca

SEQ ID NO: 2621 - DNA, 23 bp, Homo sapiens
ggatgtccagccgccataacagc

SEQ ID NO: 2622 - DNA, 25 bp, Homo sapiens
aggaggaagaagaagaggaagagga

SEQ ID NO: 2623 - DNA, 25 bp, Homo sapiens
tgacgatgatgacaaaggagatggc

SEQ ID NO: 2624 - DNA, 23 bp, Homo sapiens
aaggtttgggcacccatgccgaa

SEQ ID NO: 2625 - DNA, 23 bp, Homo sapiens
caccgccgttcacgaaagccatg

SEQ ID NO: 2626 - DNA, 25 bp, Homo sapiens
agatagccacattccaggaactcca

SEQ ID NO: 2627 - DNA, 23 bp, Homo sapiens
accctttcgctggtgccttacac

SEQ ID NO: 2628 - DNA, 24 bp, Homo sapiens
accctggaaaaggtgggtgcagga

SEQ ID NO: 2629 - DNA, 24 bp, Homo sapiens
caccctggaaaaggtgggtgcagg

SEQ ID NO: 2630 - DNA, 24 bp, Homo sapiens
ccctggaaaaggtgggtgcaggat

SEQ ID NO: 2631 - DNA, 23 bp, Homo sapiens
cctccactctgagcgttagcagc

SEQ ID NO: 2632 - DNA, 25 bp, Homo sapiens
agacgagtcaagtcaattccaggct

SEQ ID NO: 2633 - DNA, 24 bp, Homo sapiens
tgaaatgctgcccgtgaaaccctt

SEQ ID NO: 2634 - DNA, 24 bp, Homo sapiens
actctgtggttgggagaagctcag

SEQ ID NO: 2635 - DNA, 24 bp, Homo sapiens
gactctgtggttgggagaagctca

SEQ ID NO: 2636 - DNA, 24 bp, Homo sapiens
ctctgtggttgggagaagctcagt

SEQ ID NO: 2637 - DNA, 24 bp, Homo sapiens
agtcaattccaggcttgctaagac

SEQ ID NO: 2638 - DNA, 24 bp, Homo sapiens
aagtcaattccaggcttgctaaga

SEQ ID NO: 2639 - DNA, 24 bp, Homo sapiens
gtcaattccaggcttgctaagact

SEQ ID NO: 2640 - DNA, 25 bp, Homo sapiens
atcagcgtcatccagaaggaggagt

SEQ ID NO: 2641 - DNA, 25 bp, Homo sapiens
tgacaccgattgaagttgccattga

SEQ ID NO: 2642 - DNA, 23 bp, Homo sapiens
agttgccattaaccaggagccgc

SEQ ID NO: 2643 - DNA, 24 bp, Homo sapiens
aacagctacgagatgcgaaatgca

SEQ ID NO: 2644 - DNA, 24 bp, Homo sapiens
caacagctacgagatgcgaaatgc

SEQ ID NO: 2645 - DNA, 24 bp, Homo sapiens
acagctacgagatgcgaaatgcag

SEQ ID NO: 2646 - DNA, 24 bp, Homo sapiens
actcccttctcccaccttagttgg

SEQ ID NO: 2647 - DNA, 24 bp, Homo sapiens
cactcccttctcccaccttagttg

SEQ ID NO: 2648 - DNA, 24 bp, Homo sapiens
ctcccttctcccaccttagttggt

SEQ ID NO: 2649 - DNA, 24 bp, Homo sapiens
ggtgagtgagataaccaatgccaa

SEQ ID NO: 2650 - DNA, 24 bp, Homo sapiens
gctcatttcattctctagtgtcta

SEQ ID NO: 2651 - DNA, 24 bp, Homo sapiens
gtatgggtttggccagcgtcatgg

SEQ ID NO: 2652 - DNA, 24 bp, Homo sapiens
atcaccaaccagaaccccaagttt

SEQ ID NO: 2653 - DNA, 24 bp, Homo sapiens
tatcaccaaccagaaccccaagtt

SEQ ID NO: 2654 - DNA, 24 bp, Homo sapiens
tcaccaaccagaaccccaagtttc

SEQ ID NO: 2655 - DNA, 23 bp, Homo sapiens
agagtggaagatgacggagatgc

SEQ ID NO: 2656 - DNA, 25 bp, Homo sapiens
aagccacacgcattatcagtaactt

SEQ ID NO: 2657 - DNA, 23 bp, Homo sapiens
gcagttgcctcactcacctggaa

SEQ ID NO: 2658 - DNA, 24 bp, Homo sapiens
ggctctgctcatggaacctactga

SEQ ID NO: 2659 - DNA, 24 bp, Homo sapiens
aacagcagtatccacagaagacga

SEQ ID NO: 2660 - DNA, 24 bp, Homo sapiens
gccatgaacagtcagcagaacagg

SEQ ID NO: 2661 - DNA, 24 bp, Homo sapiens
agcagagaactcatcaaatgagga

SEQ ID NO: 2662 - DNA, 24 bp, Homo sapiens
tcccaccataaggctgaaaaatca

SEQ ID NO: 2663 - DNA, 24 bp, Homo sapiens
ttcccaccataaggctgaaaaatc

SEQ ID NO: 2664 - DNA, 24 bp, Homo sapiens
cccaccataaggctgaaaaatcat

SEQ ID NO: 2665 - DNA, 24 bp, Homo sapiens
tcaatccattgcctatcacctcaa

SEQ ID NO: 2666 - DNA, 24 bp, Homo sapiens
ggagcaaagagaaaaagtacatga

SEQ ID NO: 2667 - DNA, 24 bp, Homo sapiens
cactgagcctggagagcaccaaga

SEQ ID NO: 2668 - DNA, 24 bp, Homo sapiens
agtttatgggctgaagctgaagaa

SEQ ID NO: 2669 - DNA, 24 bp, Homo sapiens
aaagaaacagcagtatccacagaa

SEQ ID NO: 2670 - DNA, 24 bp, Homo sapiens
aacagcaagcaggaggaagacaat

SEQ ID NO: 2671 - DNA, 24 bp, Homo sapiens
acagtcagcagaacagggcaagag

SEQ ID NO: 2672 - DNA, 24 bp, Homo sapiens
tggctcctggtgttagttccttca

SEQ ID NO: 2673 - DNA, 24 bp, Homo sapiens
caagaaagaaagacagaattgccc

SEQ ID NO: 2674 - DNA, 24 bp, Homo sapiens
ccaagaaagaaagacagaattgcc

SEQ ID NO: 2675 - DNA, 24 bp, Homo sapiens
aagaaagaaagacagaattgccca

SEQ ID NO: 2676 - DNA, 24 bp, Homo sapiens
tcagcaaccacaaagagacagaag

SEQ ID NO: 2677 - DNA, 24 bp, Homo sapiens
aagagcaggatccaaatatttcca

SEQ ID NO: 2678 - DNA, 24 bp, Homo sapiens
gaggaagaagaaaaagagccaggt

SEQ ID NO: 2679 - DNA, 24 bp, Homo sapiens
ggtacccacaatgataaccaagaa

SEQ ID NO: 2680 - DNA, 24 bp, Homo sapiens
tggtacccacaatgataaccaaga

SEQ ID NO: 2681 - DNA, 24 bp, Homo sapiens
gtacccacaatgataaccaagaaa

SEQ ID NO: 2682 - DNA, 24 bp, Homo sapiens
agatatgattgagcctcaggagaa

SEQ ID NO: 2683 - DNA, 24 bp, Homo sapiens
gctgggattgaaggatcaagagga

SEQ ID NO: 2684 - DNA, 24 bp, Homo sapiens
agctgggattgaaggatcaagagg

SEQ ID NO: 2685 - DNA, 24 bp, Homo sapiens
ctgggattgaaggatcaagaggac

SEQ ID NO: 2686 - DNA, 24 bp, Homo sapiens
ccaaggcctaagggatcaaggaaa

SEQ ID NO: 2687 - DNA, 24 bp, Homo sapiens
gccaaggcctaagggatcaaggaa

SEQ ID NO: 2688 - DNA, 24 bp, Homo sapiens
caaggcctaagggatcaaggaaac

SEQ ID NO: 2689 - DNA, 24 bp, Homo sapiens
gctgggattgaaggatcaaggaaa

SEQ ID NO: 2690 - DNA, 24 bp, Homo sapiens
agctgggattgaaggatcaaggaa

SEQ ID NO: 2691 - DNA, 24 bp, Homo sapiens
ctgggattgaaggatcaaggaaac

SEQ ID NO: 2692 - DNA, 24 bp, Homo sapiens
gcaggatccaaatatttccaatgg

SEQ ID NO: 2693 - DNA, 24 bp, Homo sapiens
aaaagagccaggtgaagttggtac

SEQ ID NO: 2694 - DNA, 24 bp, Homo sapiens
agccatgaacagtcagcagaacag

SEQ ID NO: 2695 - DNA, 24 bp, Homo sapiens
aagccatgaacagtcagcagaaca

SEQ ID NO: 2696 - DNA, 24 bp, Homo sapiens
tcagttgaacaggagcagtaaaca

SEQ ID NO: 2697 - DNA, 24 bp, Homo sapiens
atcagttgaacaggagcagtaaac

SEQ ID NO: 2698 - DNA, 24 bp, Homo sapiens
cagttgaacaggagcagtaaacat

SEQ ID NO: 2699 - DNA, 24 bp, Homo sapiens
gggatcaaggaaaccaagagcagg

SEQ ID NO: 2700 - DNA, 24 bp, Homo sapiens
agcagaacagggcaagagttctag

SEQ ID NO: 2701 - DNA, 24 bp, Homo sapiens
cagcagaacagggcaagagttcta

SEQ ID NO: 2702 - DNA, 24 bp, Homo sapiens
gcagaacagggcaagagttctagc

SEQ ID NO: 2703 - DNA, 24 bp, Homo sapiens
atctggaaagcatgaagactgggc

SEQ ID NO: 2704 - DNA, 24 bp, Homo sapiens
gctgcaatcccgacaaatgcaaga

SEQ ID NO: 2705 - DNA, 24 bp, Homo sapiens
agctgcaatcccgacaaatgcaag

SEQ ID NO: 2706 - DNA, 24 bp, Homo sapiens
ctgcaatcccgacaaatgcaagat

SEQ ID NO: 2707 - DNA, 24 bp, Homo sapiens
tttcctatgtctcttgggaactgc

SEQ ID NO: 2708 - DNA, 24 bp, Homo sapiens
cacatcatcagttgaacaggagca

SEQ ID NO: 2709 - DNA, 24 bp, Homo sapiens
attccaaaccaactgctgaaacgg

SEQ ID NO: 2710 - DNA, 24 bp, Homo sapiens
atcattccaaaccaactgctgaaa

SEQ ID NO: 2711 - DNA, 24 bp, Homo sapiens
gatcattccaaaccaactgctgaa

SEQ ID NO: 2712 - DNA, 24 bp, Homo sapiens
tcattccaaaccaactgctgaaac

SEQ ID NO: 2713 - DNA, 24 bp, Homo sapiens
aaaaagaaacagcagtatccacag

SEQ ID NO: 2714 - DNA, 24 bp, Homo sapiens
gaaaaagaaacagcagtatccaca

SEQ ID NO: 2715 - DNA, 24 bp, Homo sapiens
aaaagaaacagcagtatccacaga

SEQ ID NO: 2716 - DNA, 24 bp, Homo sapiens
aggaggaaacgtcaagtgaaggca

SEQ ID NO: 2717 - DNA, 24 bp, Homo sapiens
gagcaccaagaggccaagaaagca

SEQ ID NO: 2718 - DNA, 24 bp, Homo sapiens
agagcaccaagaggccaagaaagc

SEQ ID NO: 2719 - DNA, 24 bp, Homo sapiens
agcaccaagaggccaagaaagcag

SEQ ID NO: 2720 - DNA, 24 bp, Homo sapiens
tgcatgctgtggattcttgcatga

SEQ ID NO: 2721 - DNA, 24 bp, Homo sapiens
gtgcatgctgtggattcttgcatg

SEQ ID NO: 2722 - DNA, 24 bp, Homo sapiens
gcatgctgtggattcttgcatgag

SEQ ID NO: 2723 - DNA, 24 bp, Homo sapiens
aaagactgtttctgaggctctgct

SEQ ID NO: 2724 - DNA, 24 bp, Homo sapiens
gccacatctgtaaggcagaccaac

SEQ ID NO: 2725 - DNA, 24 bp, Homo sapiens
tgtcctccaacaaaaccccttgat

SEQ ID NO: 2726 - DNA, 24 bp, Homo sapiens
tgctagttcctgtcatctattcgc

SEQ ID NO: 2727 - DNA, 24 bp, Homo sapiens
agactggctcaagaatatcctcat

SEQ ID NO: 2728 - DNA, 24 bp, Homo sapiens
ttatgaagccaactctgaacatgc

SEQ ID NO: 2729 - DNA, 24 bp, Homo sapiens
ccccttgatcaagtttgtggcact

SEQ ID NO: 2730 - DNA, 24 bp, Homo sapiens
accccttgatcaagtttgtggcac

SEQ ID NO: 2731 - DNA, 24 bp, Homo sapiens
cccttgatcaagtttgtggcactg

SEQ ID NO: 2732 - DNA, 24 bp, Homo sapiens
attcttgcatgagcttccagtgta

SEQ ID NO: 2733 - DNA, 24 bp, Homo sapiens
aacctcactgtgtctgccaggatc

SEQ ID NO: 2734 - DNA, 24 bp, Homo sapiens
gagcctgcaaatctattcctactt

SEQ ID NO: 2735 - DNA, 24 bp, Homo sapiens
ggagcctgcaaatctattcctact

SEQ ID NO: 2736 - DNA, 24 bp, Homo sapiens
agcctgcaaatctattcctacttg

SEQ ID NO: 2737 - DNA, 24 bp, Homo sapiens
gaagtgattcagtttcctctacgg

SEQ ID NO: 2738 - DNA, 24 bp, Homo sapiens
actggctcaagaatatcctcatgc

SEQ ID NO: 2739 - DNA, 24 bp, Homo sapiens
gaagccaactctgaacatgctggt

SEQ ID NO: 2740 - DNA, 24 bp, Homo sapiens
gaggaaagccatgaacagtcagca

SEQ ID NO: 2741 - DNA, 24 bp, Homo sapiens
agaggaaagccatgaacagtcagc

SEQ ID NO: 2742 - DNA, 24 bp, Homo sapiens
aggaaagccatgaacagtcagcag

SEQ ID NO: 2743 - DNA, 24 bp, Homo sapiens
gaacctactgatgatggtaatacc

SEQ ID NO: 2744 - DNA, 24 bp, Homo sapiens
ggaacctactgatgatggtaatac

SEQ ID NO: 2745 - DNA, 24 bp, Homo sapiens
aacctactgatgatggtaatacca

SEQ ID NO: 2746 - DNA, 24 bp, Homo sapiens
ccataaggctgaaaaatcatcagt

SEQ ID NO: 2747 - DNA, 24 bp, Homo sapiens
tggcgatgatgatggcgatgatgg

SEQ ID NO: 2748 - DNA, 24 bp, Homo sapiens
actgagcctggagagcaccaagag

SEQ ID NO: 2749 - DNA, 24 bp, Homo sapiens
acaaagagagaggaaaaccaagaa

SEQ ID NO: 2750 - DNA, 24 bp, Homo sapiens
cacaaagagagaggaaaaccaaga

SEQ ID NO: 2751 - DNA, 24 bp, Homo sapiens
caaagagagaggaaaaccaagaac

SEQ ID NO: 2752 - DNA, 24 bp, Homo sapiens
gcaagagttctagccaagagctgg

SEQ ID NO: 2753 - DNA, 24 bp, Homo sapiens
gctcaatccattgcctatcacctc

SEQ ID NO: 2754 - DNA, 24 bp, Homo sapiens
caaccaactcaagtaagcaagatg

SEQ ID NO: 2755 - DNA, 24 bp, Homo sapiens
cagggtaaccaagaacaagaagat

SEQ ID NO: 2756 - DNA, 24 bp, Homo sapiens
tcagggtaaccaagaacaagaaga

SEQ ID NO: 2757 - DNA, 24 bp, Homo sapiens
agggtaaccaagaacaagaagata

SEQ ID NO: 2758 - DNA, 24 bp, Homo sapiens
ggatcaagaggacagtgatggtca

SEQ ID NO: 2759 - DNA, 24 bp, Homo sapiens
actgaatggcagagtcaagagggt

SEQ ID NO: 2760 - DNA, 24 bp, Homo sapiens
ctggaaagcatgaagactgggcct

SEQ ID NO: 2761 - DNA, 24 bp, Homo sapiens
tctgatcattccaaaccaactgct

SEQ ID NO: 2762 - DNA, 25 bp, Homo sapiens
acgagaagcacctgttccaactaag

SEQ ID NO: 2763 - DNA, 25 bp, Homo sapiens
tgacatcacctattggcttaacaga

SEQ ID NO: 2764 - DNA, 23 bp, Homo sapiens
gcatggagccagcgtcaactacg

SEQ ID NO: 2765 - DNA, 24 bp, Homo sapiens
ctcagtattctggtggctcatcca

SEQ ID NO: 2766 - DNA, 24 bp, Homo sapiens
gctcagtattctggtggctcatcc

SEQ ID NO: 2767 - DNA, 24 bp, Homo sapiens
tcagtattctggtggctcatccac

SEQ ID NO: 2768 - DNA, 23 bp, Homo sapiens
agcctcctgtctacttctcacgg

SEQ ID NO: 2769 - DNA, 25 bp, Homo sapiens
gccatcattatctacagcagttcag

SEQ ID NO: 2770 - DNA, 25 bp, Homo sapiens
tgacccaacagagaaacccaaagca

SEQ ID NO: 2771 - DNA, 24 bp, Homo sapiens
gatatgaacgaggtagggccgaga

SEQ ID NO: 2772 - DNA, 24 bp, Homo sapiens
cgatatgaacgaggtagggccgag

SEQ ID NO: 2773 - DNA, 24 bp, Homo sapiens
atatgaacgaggtagggccgagag

SEQ ID NO: 2774 - DNA, 24 bp, Homo sapiens
gcagccgccctggttgaaggttta

SEQ ID NO: 2775 - DNA, 24 bp, Homo sapiens
ggcagccgccctggttgaaggttt

SEQ ID NO: 2776 - DNA, 24 bp, Homo sapiens
cagccgccctggttgaaggtttag

SEQ ID NO: 2777 - DNA, 24 bp, Homo sapiens
ggacccgttctgctaggaagaagg

SEQ ID NO: 2778 - DNA, 23 bp, Homo sapiens
tggtgctgctactcgggaggaag

SEQ ID NO: 2779 - DNA, 23 bp, Homo sapiens
gcctccgtcgctgtcgctgagag

SEQ ID NO: 2780 - DNA, 23 bp, Homo sapiens
tgcgtctagtaccagccagtcgg

SEQ ID NO: 2781 - DNA, 23 bp, Homo sapiens
ccacagacggtcaggaggaagca

SEQ ID NO: 2782 - DNA, 25 bp, Homo sapiens
aaccagccaatccctacctaagcct

SEQ ID NO: 2783 - DNA, 24 bp, Homo sapiens
gccgccctggttgaaggtttagaa

SEQ ID NO: 2784 - DNA, 25 bp, Homo sapiens
tatgccacaaatttgaaagacaaga

SEQ ID NO: 2785 - DNA, 24 bp, Homo sapiens
ggaacagcagtggtcgcgcctgca

SEQ ID NO: 2786 - DNA, 24 bp, Homo sapiens
tggaacagcagtggtcgcgcctgc

SEQ ID NO: 2787 - DNA, 24 bp, Homo sapiens
gaacagcagtggtcgcgcctgcag

SEQ ID NO: 2788 - DNA, 24 bp, Homo sapiens
ggtggtggcttgattgtatcccaa

SEQ ID NO: 2789 - DNA, 24 bp, Homo sapiens
tggtggtggcttgattgtatccca

SEQ ID NO: 2790 - DNA, 24 bp, Homo sapiens
gtggtggcttgattgtatcccaag

SEQ ID NO: 2791 - DNA, 24 bp, Homo sapiens
acttcagaaacagacctcaataca

SEQ ID NO: 2792 - DNA, 24 bp, Homo sapiens
tacttcagaaacagacctcaatac

SEQ ID NO: 2793 - DNA, 24 bp, Homo sapiens
cttcagaaacagacctcaatacag

SEQ ID NO: 2794 - DNA, 24 bp, Homo sapiens
tgttgtacctggaaaacaatgccc

SEQ ID NO: 2795 - DNA, 24 bp, Homo sapiens
atatggtaacagctccccacctct

SEQ ID NO: 2796 - DNA, 24 bp, Homo sapiens
ccagcttatcaaccctcagcagcg

SEQ ID NO: 2797 - DNA, 24 bp, Homo sapiens
cgccctcactcctacaaccattcc

SEQ ID NO: 2798 - DNA, 24 bp, Homo sapiens
cccagtttcccgtccatctccctt

SEQ ID NO: 2799 - DNA, 24 bp, Homo sapiens
ggctgctgttgcttaaaccactta

SEQ ID NO: 2800 - DNA, 24 bp, Homo sapiens
gcattctggtcaagggctgtcatt

SEQ ID NO: 2801 - DNA, 24 bp, Homo sapiens
tccagaaccacacttgaaaccttt

SEQ ID NO: 2802 - DNA, 24 bp, Homo sapiens
atgtgtggcctgtgtgggaactac

SEQ ID NO: 2803 - DNA, 24 bp, Homo sapiens
cccaaggatgacttccagaagccc

SEQ ID NO: 2804 - DNA, 24 bp, Homo sapiens
caggcaggcaacgccaatgagttc

SEQ ID NO: 2805 - DNA, 24 bp, Homo sapiens
gccacatcgaagcatgctaagatc

SEQ ID NO: 2806 - DNA, 24 bp, Homo sapiens
accacagctgaattctgcactagt

SEQ ID NO: 2807 - DNA, 24 bp, Homo sapiens
tttagccaaggctgtggcaaaggt

SEQ ID NO: 2808 - DNA, 24 bp, Homo sapiens
gggctggtgaaggtgggtgcccca

SEQ ID NO: 2809 - DNA, 24 bp, Homo sapiens
ggggctggtgaaggtgggtgcccc

SEQ ID NO: 2810 - DNA, 24 bp, Homo sapiens
ggctggtgaaggtgggtgccccag

SEQ ID NO: 2811 - DNA, 25 bp, Homo sapiens
tgccaacacctacaatctaaccgaa

SEQ ID NO: 2812 - DNA, 23 bp, Homo sapiens
cctggaagagcctcggatggact

SEQ ID NO: 2813 - DNA, 24 bp, Homo sapiens
ttccactgatgacaccacaggagc

SEQ ID NO: 2814 - DNA, 23 bp, Homo sapiens
ccaaggcaggacctacacgcatc

SEQ ID NO: 2815 - DNA, 25 bp, Homo sapiens
tgatgccaggtgacacagatgatgc

SEQ ID NO: 2816 - DNA, 25 bp, Homo sapiens
acttcaaggctatgttcacaggtgg

SEQ ID NO: 2817 - DNA, 24 bp, Homo sapiens
gatgaagctaccaaaaaggcctgt

SEQ ID NO: 2818 - DNA, 24 bp, Homo sapiens
aggcaaatcaaaggaggaatgtca

SEQ ID NO: 2819 - DNA, 24 bp, Homo sapiens
cgggtgcttctggtgggtggcgac

SEQ ID NO: 2820 - DNA, 25 bp, Homo sapiens
gaagtggatcggttggaagaactga

SEQ ID NO: 2821 - DNA, 24 bp, Homo sapiens
ggcaattcgagtggagctggttca

SEQ ID NO: 2822 - DNA, 24 bp, Homo sapiens
ttatagccaggagcagagacaagc

SEQ ID NO: 2823 - DNA, 24 bp, Homo sapiens
gagccatttcaggaagaaggagag

SEQ ID NO: 2824 - DNA, 24 bp, Homo sapiens
tgagccatttcaggaagaaggaga

SEQ ID NO: 2825 - DNA, 24 bp, Homo sapiens
agccatttcaggaagaaggagaga

SEQ ID NO: 2826 - DNA, 24 bp, Homo sapiens
aagcatatcaaggaactcctggat

SEQ ID NO: 2827 - DNA, 24 bp, Homo sapiens
gaagcatatcaaggaactcctgga

SEQ ID NO: 2828 - DNA, 24 bp, Homo sapiens
agcatatcaaggaactcctggata

SEQ ID NO: 2829 - DNA, 25 bp, Homo sapiens
tcaggaagaaggagagacgaccatc

SEQ ID NO: 2830 - DNA, 25 bp, Homo sapiens
atgatattgacagtgcctcagtgcc

SEQ ID NO: 2831 - DNA, 25 bp, Homo sapiens
tgtggtgtgtgaagacgaagatgcc

SEQ ID NO: 2832 - DNA, 25 bp, Homo sapiens
tgtctttggagaatattgcaacact

SEQ ID NO: 2833 - DNA, 24 bp, Homo sapiens
ttgctacggcagctggaaatgcag

SEQ ID NO: 2834 - DNA, 24 bp, Homo sapiens
gttgctacggcagctggaaatgca

SEQ ID NO: 2835 - DNA, 24 bp, Homo sapiens
tgctacggcagctggaaatgcaga

SEQ ID NO: 2836 - DNA, 24 bp, Homo sapiens
cacccaagtggaattgatgcgaaa

SEQ ID NO: 2837 - DNA, 25 bp, Homo sapiens
aagagcaagatcaagaactgtgcga

SEQ ID NO: 2838 - DNA, 24 bp, Homo sapiens
gggctgcgtactcaaatccgagag

SEQ ID NO: 2839 - DNA, 23 bp, Homo sapiens
tgaggagaagtgaggtgctggcg

SEQ ID NO: 2840 - DNA, 25 bp, Homo sapiens
ggattccagaggaccagcggttaca

SEQ ID NO: 2841 - DNA, 24 bp, Homo sapiens
catgaggagaagtgaggtgctggc

SEQ ID NO: 2842 - DNA, 24 bp, Homo sapiens
ccatgaggagaagtgaggtgctgg

SEQ ID NO: 2843 - DNA, 24 bp, Homo sapiens
atgaggagaagtgaggtgctggcg

SEQ ID NO: 2844 - DNA, 24 bp, Homo sapiens
agggaaacaaaggcttctaggcgt

SEQ ID NO: 2845 - DNA, 24 bp, Homo sapiens
gagggaaacaaaggcttctaggcg

SEQ ID NO: 2846 - DNA, 24 bp, Homo sapiens
gggaaacaaaggcttctaggcgtg

SEQ ID NO: 2847 - DNA, 25 bp, Homo sapiens
gtcagtataaagagacagatcatac

SEQ ID NO: 2848 - DNA, 25 bp, Homo sapiens
attagaccacaccccagacacaagc

SEQ ID NO: 2849 - DNA, 25 bp, Homo sapiens
gcagaaagccctaaatcaccttcgg

SEQ ID NO: 2850 - DNA, 24 bp, Homo sapiens
gcggttacaaagaactgaggtggt

SEQ ID NO: 2851 - DNA, 25 bp, Homo sapiens
ggaactcctggatatgatgattgct

SEQ ID NO: 2852 - DNA, 24 bp, Homo sapiens
ctataaagccatgcaaatgacaaa

SEQ ID NO: 2853 - DNA, 24 bp, Homo sapiens
actataaagccatgcaaatgacaa

SEQ ID NO: 2854 - DNA, 24 bp, Homo sapiens
tataaagccatgcaaatgacaaaa

SEQ ID NO: 2855 - DNA, 24 bp, Homo sapiens
ggttgccaatgccatcatcagaga

SEQ ID NO: 2856 - DNA, 24 bp, Homo sapiens
agaagtcaccgagcgtctactcca

SEQ ID NO: 2857 - DNA, 24 bp, Homo sapiens
gcacgggggacaatgagaaggtga

SEQ ID NO: 2858 - DNA, 24 bp, Homo sapiens
ctcacattctgctgacggctggaa

SEQ ID NO: 2859 - DNA, 24 bp, Homo sapiens
cactggtgctgattgttggaggag

SEQ ID NO: 2860 - DNA, 25 bp, Homo sapiens
gcaaggcattcttacacgaggaagt

SEQ ID NO: 2861 - DNA, 25 bp, Homo sapiens
accagagcctagatgagacaccgaa

SEQ ID NO: 2862 - DNA, 23 bp, Homo sapiens
catcccttctgaccctggcttcc

SEQ ID NO: 2863 - DNA, 25 bp, Homo sapiens
gaggaggtcaccaagaaacatcagt

SEQ ID NO: 2864 - DNA, 25 bp, Homo sapiens
gcattatcattgaaacacctcacaa

SEQ ID NO: 2865 - DNA, 25 bp, Homo sapiens
aacaagtgatttctccagatttaca

SEQ ID NO: 2866 - DNA, 23 bp, Homo sapiens
gctgccacctaacaggagtcacc

SEQ ID NO: 2867 - DNA, 23 bp, Homo sapiens
gcgggacagactcctaacctggg

SEQ ID NO: 2868 - DNA, 24 bp, Homo sapiens
ccacagataagctggcaagaggaa

SEQ ID NO: 2869 - DNA, 24 bp, Homo sapiens
atctctttgcaggtagcagcaaca

SEQ ID NO: 2870 - DNA, 24 bp, Homo sapiens
catctctttgcaggtagcagcaac

SEQ ID NO: 2871 - DNA, 24 bp, Homo sapiens
tctctttgcaggtagcagcaacag

SEQ ID NO: 2872 - DNA, 24 bp, Homo sapiens
ggtctggaccttcaatcaaagcct

SEQ ID NO: 2873 - DNA, 24 bp, Homo sapiens
gggtctggaccttcaatcaaagcc

SEQ ID NO: 2874 - DNA, 24 bp, Homo sapiens
gagatctcaagtttcaacaccacg

SEQ ID NO: 2875 - DNA, 24 bp, Homo sapiens
cgtgtggttgctaaggatgggctg

SEQ ID NO: 2876 - DNA, 24 bp, Homo sapiens
gaaaggctttgggaactgtcaaca

SEQ ID NO: 2877 - DNA, 24 bp, Homo sapiens
tgcctcagatgatgcctatccaga

SEQ ID NO: 2878 - DNA, 24 bp, Homo sapiens
gtctggaccttcaatcaaagcctt

SEQ ID NO: 2879 - DNA, 24 bp, Homo sapiens
tgctgctctctgtggtttgtgtcc

SEQ ID NO: 2880 - DNA, 24 bp, Homo sapiens
tctggtggacttaggtgaaggcaa

SEQ ID NO: 2881 - DNA, 24 bp, Homo sapiens
cctctttgccctgtgtgccttgaa

SEQ ID NO: 2882 - DNA, 24 bp, Homo sapiens
ccagtttgtgtccagcgtgcccag

SEQ ID NO: 2883 - DNA, 24 bp, Homo sapiens
gaagaatttcaaccagccaagtgc

SEQ ID NO: 2884 - DNA, 24 bp, Homo sapiens
agaaaatgccttgaaactctttcc

SEQ ID NO: 2885 - DNA, 24 bp, Homo sapiens
gccctgtagtgctgttcaccttct

SEQ ID NO: 2886 - DNA, 24 bp, Homo sapiens
gtgagccagatggaccaggagcag

SEQ ID NO: 2887 - DNA, 24 bp, Homo sapiens
gacattcctaacatacctgccgaa

SEQ ID NO: 2888 - DNA, 24 bp, Homo sapiens
cctggtgcgtcctatcagaagccg

SEQ ID NO: 2889 - DNA, 24 bp, Homo sapiens
cggaaaatccagggactcctgaag

SEQ ID NO: 2890 - DNA, 24 bp, Homo sapiens
ccggaaaatccagggactcctgaa

SEQ ID NO: 2891 - DNA, 24 bp, Homo sapiens
ggaaaatccagggactcctgaagt

SEQ ID NO: 2892 - DNA, 24 bp, Homo sapiens
aaacctgtcgaggacttcatccag

SEQ ID NO: 2893 - DNA, 24 bp, Homo sapiens
gaaacctgtcgaggacttcatcca

SEQ ID NO: 2894 - DNA, 24 bp, Homo sapiens
aacctgtcgaggacttcatccagg

SEQ ID NO: 2895 - DNA, 25 bp, Homo sapiens
tgttggagttagagagtgaagagga

SEQ ID NO: 2896 - DNA, 24 bp, Homo sapiens
cgaggacttcatccaggagctgct

SEQ ID NO: 2897 - DNA, 23 bp, Homo sapiens
cctgaccctcttgcactctccct

SEQ ID NO: 2898 - DNA, 23 bp, Homo sapiens
gccgcccagcttgcttgtgtata

SEQ ID NO: 2899 - DNA, 24 bp, Homo sapiens
ccttcgtggaggagagcctaactt

SEQ ID NO: 2900 - DNA, 24 bp, Homo sapiens
tgaggaggctgacattcgtgagga

SEQ ID NO: 2901 - DNA, 24 bp, Homo sapiens
ctgcttacctggacttgttgctgg

SEQ ID NO: 2902 - DNA, 24 bp, Homo sapiens
ttcctggtgaaggtgggcacggtc

SEQ ID NO: 2903 - DNA, 24 bp, Homo sapiens
cttcctggtgaaggtgggcacggt

SEQ ID NO: 2904 - DNA, 24 bp, Homo sapiens
tcctggtgaaggtgggcacggtca

SEQ ID NO: 2905 - DNA, 24 bp, Homo sapiens
agccaatccaactgacctagtgaa

SEQ ID NO: 2906 - DNA, 24 bp, Homo sapiens
gaggaatacgagggctttgggcag

SEQ ID NO: 2907 - DNA, 24 bp, Homo sapiens
agagcagcactggtgaatatggga

SEQ ID NO: 2908 - DNA, 25 bp, Homo sapiens
atggtgacagaaacgacaatgaagt

SEQ ID NO: 2909 - DNA, 25 bp, Homo sapiens
aactgaaggctattgttactgaacc

SEQ ID NO: 2910 - DNA, 23 bp, Homo sapiens
aacgcagattagaagccaggttg

SEQ ID NO: 2911 - DNA, 25 bp, Homo sapiens
aacgatgagcagacacttccaaggc

SEQ ID NO: 2912 - DNA, 25 bp, Homo sapiens
agagaaacgacataacttacgacaa

SEQ ID NO: 2913 - DNA, 25 bp, Homo sapiens
aaggagaagatgatctcaggacaga

SEQ ID NO: 2914 - DNA, 23 bp, Homo sapiens
ctccgacacagacgatcacgctc

SEQ ID NO: 2915 - DNA, 25 bp, Homo sapiens
gatcataagcccgcctctaacatgc

SEQ ID NO: 2916 - DNA, 25 bp, Homo sapiens
tgtccctcatgccatcacagtatct

SEQ ID NO: 2917 - DNA, 25 bp, Homo sapiens
aagaatgtgagcgtagagtggcagc

SEQ ID NO: 2918 - DNA, 25 bp, Homo sapiens
tggagatgcagaataaactctgggt

SEQ ID NO: 2919 - DNA, 24 bp, Homo sapiens
ggaaggatcaggcactctggcaga

SEQ ID NO: 2920 - DNA, 24 bp, Homo sapiens
agatgactcttccattccagcagt

SEQ ID NO: 2921 - DNA, 24 bp, Homo sapiens
tgcccttactcccagtgtgccttc

SEQ ID NO: 2922 - DNA, 24 bp, Homo sapiens
actttgaagaccagtcctgtttgc

SEQ ID NO: 2923 - DNA, 25 bp, Homo sapiens
gtaggtgtgacttgaactagattgc

SEQ ID NO: 2924 - DNA, 24 bp, Homo sapiens
gcagtgacagcttgagtgggttct

SEQ ID NO: 2925 - DNA, 24 bp, Homo sapiens
tggtgccatattgtcactccttct

SEQ ID NO: 2926 - DNA, 25 bp, Homo sapiens
tggcaaggaggacaaatacgcaatg

SEQ ID NO: 2927 - DNA, 25 bp, Homo sapiens
tgcttagattgttgtactgctgcca

SEQ ID NO: 2928 - DNA, 24 bp, Homo sapiens
tgattattggaatggtgccatatt

SEQ ID NO: 2929 - DNA, 24 bp, Homo sapiens
ttgattattggaatggtgccatat

SEQ ID NO: 2930 - DNA, 24 bp, Homo sapiens
gattattggaatggtgccatattg

SEQ ID NO: 2931 - DNA, 25 bp, Homo sapiens
ggtgtttgattattggaatggtgcc

SEQ ID NO: 2932 - DNA, 25 bp, Homo sapiens
agagttagatttttgcacattaaaa

SEQ ID NO: 2933 - DNA, 25 bp, Homo sapiens
cgttggaagtagcaagaagtggaga

SEQ ID NO: 2934 - DNA, 25 bp, Homo sapiens
agtgaaggaagagtgaggtgtggct

SEQ ID NO: 2935 - DNA, 25 bp, Homo sapiens
ggtctgtgtaagtggatgtgagtga

SEQ ID NO: 2936 - DNA, 25 bp, Homo sapiens
tcgccctttaagaactcctgacctt

SEQ ID NO: 2937 - DNA, 25 bp, Homo sapiens
gggagagggatagaggagattgggt

SEQ ID NO: 2938 - DNA, 25 bp, Homo sapiens
tggcagaactaaatcttggagtggg

SEQ ID NO: 2939 - DNA, 36 bp, Homo sapiens
agatgggaatgcctcagggtagctagcatggaaaaa

SEQ ID NO: 2940 - DNA, 36 bp, Homo sapiens
ataatcctccactggcaggtcaaaaatgtaatgaaa

SEQ ID NO: 2941 - DNA, 36 bp, Homo sapiens; identical to SEQ ID NO: 2940

SEQ ID NO: 2942 - DNA, 500 bp, Homo sapiens
acaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgac

SEQ ID NO: 2943 - DNA, 500 bp, Homo sapiens
caggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatc

SEQ ID NO: 2944 - DNA, 36 bp, Homo sapiens
ttcaaaacctcaaaccaggtggctatggtatggatg

SEQ ID NO: 2945 - DNA, 204 bp, Homo sapiens
gtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaa

SEQ ID NO: 2946 - DNA, 36 bp, Homo sapiens
tgacaatgcccgtctggccgcggatgacttccgcac

SEQ ID NO: 2947 - DNA, 500 bp, Homo sapiens
aacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaactt

SEQ ID NO: 2948 - DNA, 500 bp, Homo sapiens
cctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaag

SEQ ID NO: 2949 - DNA, 411 bp, Homo sapiens
catgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaa

SEQ ID NO: 2950 - DNA, 372 bp, Homo sapiens
gagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccaga

SEQ ID NO: 2951 - DNA, 463 bp, Homo sapiens
tggtggctttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttccgcaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggag

SEQ ID NO: 2952 - DNA, 111 bp, Homo sapiens
gcaaacatctgtagatggacagaagaccgctgggttcttttacaagacatccttctcaaatggcaacgtcttactgaagaacagtgcctttttagtgcatggctttcagaa

SEQ ID NO: 2953 - DNA, 115 bp, Homo sapiens
ggatctccagaatcagaaactgaaagagttgaatgactggctaacaaaaacagaagaaagaacaaggaaaatggaggaagagcctcttggacctgatcttgaagacctaaaacgc

SEQ ID NO: 2954 - DNA, 64 bp, Homo sapiens
atccgcaccaaggtcatggatgtgcacgatggcaaggtggtgtccacccacgagcaggtccttc

SEQ ID NO: 2955 - DNA, 26 bp, Homo sapiens
ccacaagacttacatccttaccacca

SEQ ID NO: 2956 - DNA, 36 bp, Homo sapiens
accggagcatgcttcaagatcgggaggaccagtcca

SEQ ID NO: 2957 - DNA, 130 bp, Homo sapiens
gcaaacatctgtagatggacagaagaccgctgggttcttttacaagacatccttctcaaatggcaacgtcttactgaagaacagtgcctttttagtgcatggctttcagaaaaagaagatgcagtgaaca

SEQ ID NO: 2958 - DNA, 501 bp, Homo sapiens
ttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttccgcaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtgg

SEQ ID NO: 2959 - DNA, 500 bp, Homo sapiens
ggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcct

SEQ ID NO: 2960 - DNA, 25 bp, Homo sapiens
cccagttctcctctggatcgcagtc

SEQ ID NO: 2961 - DNA, 500 bp, Homo sapiens
agtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatggg

SEQ ID NO: 2962 - DNA, 228 bp, Homo sapiens
gagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaat

SEQ ID NO: 2963 - DNA, 204 bp, Homo sapiens
gaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacag

SEQ ID NO: 2964 - DNA, 500 bp, Homo sapiens
aagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattca

SEQ ID NO: 2965 - DNA, 26 bp, Homo sapiens
cacagccacagtggacaatgccaatg

SEQ ID NO: 2966 - DNA, 36 bp, Homo sapiens
gcctcctacctggacaaggtgcgtgctctggaggag

SEQ ID NO: 2967 - DNA, 36 bp, Homo sapiens
tgatttcagaactggaagtgcggctaaagaaggaag

SEQ ID NO: 2968 - DNA, 36 bp, Homo sapiens
tctgtgccagcgagtttgcactgaggatgaaaataa

SEQ ID NO: 2969 - DNA, 36 bp, Homo sapiens
cgcagtcatccagagatgtgacctcctccagccgcc

SEQ ID NO: 2970 - DNA, 500 bp, Homo sapiens; identical to SEQ ID NO: 2964

SEQ ID NO: 2971 - DNA, 288 bp, Homo sapiens
ggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaa

SEQ ID NO: 2972 - DNA, 122 bp, Homo sapiens
tggtgatgggcttctggtgggcagtgagaaggtgaccatgcagaacctcaatgaccgcctggcctcctacctggacaaggtgcgtgctctggaggaggccaacgccgacctggaagtgaaga

SEQ ID NO: 2973 - DNA, 309 bp, Homo sapiens
ttgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaagggagctccagtggcaactcttctccggagt

SEQ ID NO: 2974 - DNA, 482 bp, Homo sapiens
aacatttttgaaagatcactcagctttaacacaccttggctgggtctggataaaaaaaaagtgagcactgcaaatttctagaagaaaacatcaggagaagaaagagagagggggatttattcaaagttgtttccaattccttcaaaacctcaaaccaggtggctatggtatggatgtaaccaagaaaaacaaacgagatggaactgaagtcactgagagaattgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgtta

SEQ ID NO: 2975 - DNA, 36 bp, Homo sapiens
gaatggttcttcaccaagacagaggagctgaaccgc

SEQ ID NO: 2976 - DNA, 36 bp, Homo sapiens
cttgagcagttcaagagggccaaggcgaacctagac

SEQ ID NO: 2977 - DNA, 333 bp, Homo sapiens
ccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaag

SEQ ID NO: 2978 - DNA, 144 bp, Homo sapiens
gagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgag

SEQ ID NO: 2979 - DNA, 36 bp, Homo sapiens
ctatcttttgaggaccaaatctgtacccccgatttg

SEQ ID NO: 2980 - DNA, 445 bp, Homo sapiens
acaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaag

SEQ ID NO: 2981 - DNA, 36 bp, Homo sapiens; identical to SEQ ID NO: 2956

SEQ ID NO: 2982 - DNA, 36 bp, Homo sapiens
ccagtccattctatgcacaggcgagtctggagccgg

SEQ ID NO: 2983 - DNA, 433 bp, Homo sapiens
atgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactga

SEQ ID NO: 2984 - DNA, 147 bp, Homo sapiens
actaaactacaggagaaatataatagctggcatcacggtgacttcaattatgaacgtcaggcaacgttgactatcagttcagcgagagttaatgattctggagtgttcatgtgttatgccaataatacttttggatcagcaaatgtc

SEQ ID NO: 2985 - DNA, 480 bp, Homo sapiens
tgcgggtgcttgtggagtgggtggctatggcagccggagcctctacaacctggggggctccaagaggatatccatcagcactagaggaggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgt

SEQ ID NO: 2986 - DNA, 36 bp, Homo sapiens
aaagacacaagtatcacgggagagctggaaaagcag

SEQ ID NO: 2987 - DNA, 345 bp, Homo sapiens
ctgatctgggcccacaagagcgtatgcaaatctctaagtttacgggactctcaatgaccactatcagtcactggctggccaacgtcaagtaccagcttaggaaaacgggcgggacaaaatttccgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggaca

SEQ ID NO: 2988 - DNA, 362 bp, Homo sapiens
aaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaaagaagatccacagtaccagcagcaataggaaatggagtcttattgccaagataattacaactggagaattggccccacaggaaacaacaattacagagataaaacaaaaattgatgcaaatacctgatgaagagggcattgttattgatggatttccaagagatgttgcccaggct

SEQ ID NO: 2989 - DNA, 319 bp, Homo sapiens
atgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattcca

SEQ ID NO: 2990 - DNA, 57 bp, Homo sapiens
ggaagtactgacatcgtagatggaaatcataaactgactcttggtttgatttggaat

SEQ ID NO: 2991 - DNA, 36 bp, Homo sapiens
actcaagagcaagctcaggcgaggaaacgagacctc

SEQ ID NO: 2992 - DNA, 66 bp, Homo sapiens
ggaggacgagctgcaagccacggaggacgccaaactgcggctggaagtcaacatgcaggcgctcaa

SEQ ID NO: 2993 - DNA, 500 bp, Homo sapiens
cctgtgacaacgagttgaaatctgaggccatcattgaacatctctgtgccagcgagtttgcactgaggatgaaaataaaagaagtgaaaaaagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaaggtgaagagccagtacttgctgacggccatccacaagtgggacaagaaaaacaaggagttcaaaaacttcatgaagaaaatgaaaaaccatgagtgccccacctttcagtccgtgtttaagtgattctcccgggggcagggtggggagggagcctcgggtggggtgggagcgggggggacagtgccccgggaacccggtgggtcacacacacgcactgcgcctgtcagtagtggacattgt

SEQ ID NO: 2994 - DNA, 36 bp, Homo sapiens
ccaagcccaaacctcaagcagaatctaagaagaaga

SEQ ID NO: 2995 - DNA, 270 bp, Homo sapiens
gagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctg

SEQ ID NO: 2996 - DNA, 75 bp, Homo sapiens
gagaacctcttcagtgacctacaggatgggaggcgcctcctagacctcctcgaaggcctgacagggcaaaaactg

SEQ ID NO: 2997 - DNA, 32 bp, Homo sapiens
tggagcaagatgtactgagaatgtgcccatga

SEQ ID NO: 2998 - DNA, 66 bp, Homo sapiens
ctgagactgcagagttgattgaggagtatgaggtttttgatcctaccagacctcgaccaaaaatca

SEQ ID NO: 2999 - DNA, 117 bp, Homo sapiens
agaaaaaaggctctagaaatttctcatcagtggtatcagtacaagaggcaggctgatgatctcctgaaatgcttggatgacattgaaaaaaaattagccagcctacctgagcccaga

SEQ ID NO: 3000 - DNA, 36 bp, Homo sapiens; identical to SEQ ID NO: 2986

SEQ ID NO: 3001 - DNA, 36 bp, Homo sapiens
ttgaaaacatgccgtcagaattcagaaacaaatcct

SEQ ID NO: 3002 - DNA, 36 bp, Homo sapiens
agctatgattgtccgtaggcccatactagagttcat

SEQ ID NO: 3003 - DNA, 500 bp, Homo sapiens
gaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaact

SEQ ID NO: 3004 - DNA, 77 bp, Homo sapiens
gtatgagacagagttgaacctgcgcatgagtgtggaagccgacatcaatggcctgcgcagggtgctggacgaactga

SEQ ID NO: 3005 - DNA, 36 bp, Homo sapiens
gaggacctgaggaacaagattctcacagccacagtg

SEQ ID NO: 3006 - DNA, 141 bp, Homo sapiens
ggtttggtgctggtgctggaggcggctatggctttggaggtggtgccggtagtggatttggtttcggcggtggagctggtggtggctttgggctcggtggcggagctggctttggaggtggcttcggtggccctggctttc

SEQ ID NO: 3007 - DNA, 36 bp, Homo sapiens
aaaacacagctacacaagataaatgcagagggaaca

SEQ ID NO: 3008 - DNA, 499 bp, Homo sapiens
ctgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcaaggcgctgcggcgcgaggcgctcgggttggagcagctgcgcgcgcggctggaggacgcgctgctgcggatgcgcgaggagtacgggatacaggccgaggagcggcagagagtgattgactgcctggaggatgagaaggcaaccctcaccttggccatggctgactggctgcgggactatcaggacctcctgcaggtgaagaccggcctcagtttggaggtggcgacctaccgggccttattggaaggagaaagtaatccagagatagtgatctgggctgagcacgttgaaaacatgccgtcagaattcagaaacaaatcctatcactataccgactcactactacagagggaaaatgaaag

SEQ ID NO: 3009 - DNA, 245 bp, Homo sapiens
aaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaaggg

SEQ ID NO: 3010 - DNA, 500 bp, Homo sapiens
aactcaagctgatgcttcaaaaacgagaagcacctgttccaactaagactaaagtggccgttgatgagaataaagccaaagaattccttggcagcctgaagcgccagaagcggcagctgtgggaccggactcggcccgaggtgcagcagtggtaccagcagtttctctacatgggctttgacgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatctttctacctactttggtgatcaaaaaagaagagttaaaacaacac

SEQ ID NO: 3011 - DNA, 36 bp, Homo sapiens
ggatgacttccgcaccaagtatgagacagagttgaa

SEQ ID NO: 3012 - DNA, 143 bp, Homo sapiens
actccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccacc

SEQ ID NO: 3013 - DNA, 500 bp, Homo sapiens
aataaatccagtatttgtaaagtgaataacttcatttctaattgtttaatttttaaaattctgatttttatatattgagtttaagcaaggcattcttacacgaggaagtgaagtaaattttagttcagacataaaatttcacttattaggaatatgtaacatgctaaaacttttttttttttaaagagtactgagtcacaacatgttttagagcatccaagtaccatataatccaactatcatggtaaggccagaaatcttctaacctaccagagcctagatgagacaccgaattaacattaaaatttcagtaactgactgtccctcatgtccatggcctaccatcccttctgaccctggcttccagggacctatgtcttttaatactcactgtcacattgggcaaagttgcttctaatccttatttcccatgtgcacaagtctttttgtattccagcttcctgataacactgcttactgtggaatattcatttgacatc

SEQ ID NO: 3014 - DNA, 139 bp, Homo sapiens
acgtactctggcctcttctgcgtggtggtcaacccctataaacacctgcccatctactcggagaagatcgtcgacatgtacaagggcaagaagaggcacgagatgccgcctcacatctacgccatcgcagacacggcct

SEQ ID NO: 3015 - DNA, 72 bp, Homo sapiens
gcgcatgagtgtggaagccgacatcaatggcctgcgcagggtgctggacgaactgaccctggccagagctga

SEQ ID NO: 3016 - DNA, 204 bp, Homo sapiens; identical to SEQ ID NO: 2963

SEQ ID NO: 3017 - DNA, 25 bp, Homo sapiens
caataagctgcagccaggctccgtg

SEQ ID NO: 3018 - DNA, 36 bp, Homo sapiens; identical to SEQ ID NO: 3007

SEQ ID NO: 3019 - DNA, 500 bp, Homo sapiens
aaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcct

SEQ ID NO: 3020 - DNA, 500 bp, Homo sapiens
caaagcaagcaggctttagacctccaccatccaaagctcatgcccggcagtggactcgccctcgctccatctacctgcccccgctgcctctttcaggaaggagccccttaggaggacaggcctgcagcatcctggtctcgggaggcttctgtcattgctcacacacagttcagatttccacctctttatagacaagaagtgaatttgcctggggcagaacacccacccaaagagtccccacttaacaataccccccccccacggcaagaatgcccaaatccgaatgaccccagttttcctaatgagtaaaatgatcccagatgtgccccagagcatgacgcctgcagctccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaa

SEQ ID NO: 3021 - DNA, 36 bp, Homo sapiens; identical to SEQ ID NO: 2986

SEQ ID NO: 3022 - DNA, 500 bp, Homo sapiens
cagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatggga

SEQ ID NO: 3023 - DNA, 198 bp, Homo sapiens
ccctgttcactcctttgctgattggtttcgtaatcgtagctggcatgatgtgcattattgtgatgattctgacctacaaatatttacagaaacccatgtatgaagtacagtggaaggttgttgaggagataaatggaaacaattatgtttacatagacccaacacaacttccttatgatcacaaatgggagtttccca

SEQ ID NO: 3024 - DNA, 26 bp, Homo sapiens
gtagctagcatggaaaaacaaagcaa

SEQ ID NO: 3025 - DNA, 500 bp, Homo sapiens
cactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcat

SEQ ID NO: 3026 - DNA, 319 bp, Homo sapiens
atgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatcacagagatga

SEQ ID NO: 3027 - DNA, 36 bp, Homo sapiens
aagcctccaagccccaaggcacaacggtgtgtcctc

SEQ ID NO: 3028 - DNA, 497 bp, Homo sapiens
gcagccgccagttcacctcctccagctccatgaagggctcctgcggcatcgggggcggcatcgggggcggctccagccgcatctcctccgtcctggccggagggtcctgccgcgcccccagcacctacgggggcggcctgtctgtctcatcctcccgcttctcctctgggggagcctacgggctggggggcggctatggcggtggcttcagcagcagcagcagcagctttggtagtggctttgggggaggatatggtggtggccttggtgctggcttgggtggtggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctgctgagatcaaagactacagtccctacttcaagaccatt

SEQ ID NO: 3029 - DNA, 36 bp, Homo sapiens
ccttgacttgtctgaactgatcctggtgggcaatcc

SEQ ID NO: 3030 - DNA, 500 bp, Homo sapiens
gatcagtggcaaaattccacactacgagagtgaaattgatgaaaacaccttttttgtgcccactgcaccaaaatgggactcaacagggcattcattaaatgaagcacaccaaatatccttgaatgaattcacttctaaaagccgtgaactctcctggcatcaagttagcaaagcaccagcaattggttttagtccttctgtgttaccaaaacctcaaaatacgaataaagaatgctcctggggaagccccataggaaaacatcatggtgctgatgattccagattcagtattttagctccatcattcacaagtttggataaaattaatctagagaaagaattagaaaatgaaaatcataactaccatataggatttgaaagtagcattcctccaacaaattcatccttctcaagtgacttcatgccgaaagaagagaataaaaggagtggacatgtgaacattgtggaaccatctttgatgcttttgaaaggctctcttc

SEQ ID NO: 3031 - DNA, 501 bp, Homo sapiens
gaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctagg

SEQ ID NO: 3032 - DNA, 36 bp, Homo sapiens
ggagggcgaggaatgcagactcagtggagaaggagt

SEQ ID NO: 3033 - DNA, 111 bp, Homo sapiens
aagatttgcttctgttgtgaagaatttcaaccagccaagtgcacagacaaagaaaatgccttgaaactctttccggttcagccctgtagtgctgttcaccttctacttaag

SEQ ID NO: 3034 - DNA, 36 bp, Homo sapiens; identical to SEQ ID NO: 3005

SEQ ID NO: 3035 - DNA, 36 bp, Homo sapiens
ctgaagtcactgagagaattgtcactgaaacagtaa

SEQ ID NO: 3036 - DNA, 500 bp, Homo sapiens
gaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttat

SEQ ID NO: 3037 - DNA, 500 bp, Homo sapiens
gtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcat

SEQ ID NO: 3038 - DNA, 500 bp, Homo sapiens
acatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagaca

SEQ ID NO: 3039 - DNA, 500 bp, Homo sapiens
aacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagtta

SEQ ID NO: 3040 - DNA, 36 bp, Homo sapiens
tgagaacatcaccgaaattttcatcgcaaaccagaa

SEQ ID NO: 3041 - DNA, 25 bp, Homo sapiens
atgcccgtctggccgcggatgactt

SEQ ID NO: 3042 - DNA, 500 bp, Homo sapiens
atgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgtaatgcctgaaaactcaaactttccatatcggcggtatgaccggctccctccaatccatcaattctccatagaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaaagaagatccacagtaccagcagcaataggaaatggagtcttattgccaagataattacaactggagaattggc

SEQ ID NO: 3043 - DNA, 270 bp, Homo sapiens
tcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcat

SEQ ID NO: 3044 - DNA, 189 bp, Homo sapiens
gattttaggtgatgggcaagtcagaaagtcagatggatataactgatatcaacactccaaagccaaagaagaaacagcgatggactcgactggagatcagcctctcggtccttgtcctgctcctcaccatcatagctgtgagaatgatcgcactctatgcaacctacgatgatggtatttgcaagtcat

SEQ ID NO: 3045 - DNA, 500 bp, Homo sapiens
gaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgtaaaattattttcataattggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaagg

SEQ ID NO: 3046 - DNA, 500 bp, Homo sapiens
acatgtttcatattgactttggaaaattcttaggtcatgcacaaacatttggagggataaaaagggaccgagctcctttcatttttacttcagagatggaatactttattacagagggtgggaaaaacccacagcattttcaagattttgtggaactttgctgtcgtgcttataatattatcagaaagcacagccaactgctcttgaacctgctggaaatgatgctgtatgcaggactgcctgagctaagtggaattcaagacctgaaatatgtgtataataatcttcgtccacaagacacagacctggaagcaacaagtcattttaccaagaaaataaaggaaagtctggagtgtttccctgttaaattgaataacttgatccacacacttgcacaaatgtcagccataagccctgccaaatctacttcacagacttttcctcaggaatcctgtttgctgagtacaactaggtcgattgaaagagcaattttagggttc

SEQ ID NO: 3047 - DNA, 26 bp, Homo sapiens
tcgggaggaccagtccattctatgca

SEQ ID NO: 3048 - DNA, 36 bp, Homo sapiens
gaagagttcggacgcaggattggagacccacagttg

SEQ ID NO: 3049 - DNA, 101 bp, Homo sapiens
ttgtgtctgtgtccaaagcaagctatcttcttagggaaggggaagaattcacagtgacgtgcacaataaaagatgtgtctagttctgtgtactcaacgtgg

SEQ ID NO: 3050 - DNA, 500 bp, Homo sapiens
gtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgtaatgcctgaaaactcaaactttccatatcggcggtatgaccggctccctccaatccatcaattctccatagaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaaagaagatccacagtaccagcagcaataggaaatggagtcttattgccaagataattacaactggagaattggccc

SEQ ID NO: 3051 - DNA, 126 bp, Homo sapiens
tatgacaacgacgtcaaggactcgcatccgtcgctttctgcagaaaggggcttcttcggtcccgagctcgcgtccaggtggccaggcctctgccggcggctccagtggctgcgattatcgggttcg

SEQ ID NO: 3052 - DNA, 36 bp, Homo sapiens
ttgactgcaagattgaaggatacccagaccccgagg

SEQ ID NO: 3053 - DNA, 282 bp, Homo sapiens
ccttgcctccccaattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatca

SEQ ID NO: 3054 - DNA, 345 bp, Homo sapiens
gtcagaaagtcagatggatataactgatatcaacactccaaagccaaagaagaaacagcgatggactcgactggagatcagcctctcggtccttgtcctgctcctcaccatcatagctgtgagaatgatcgcactctatgcaacctacgatgatggtatttgcaagtcatcagactgcataaaatcagctgctcgactgatccaaaacatggatgccaccactgagccttgtagagactttttcaaatatgcttgcggaggctggttgaaacgtaatgtcattcccgagaccagctcccgttacggcaactttgacattttaagagatgaactagaagtcgtttt

SEQ ID NO: 3055 - DNA, 36 bp, Homo sapiens
aaaagagaaaacagtcagactaaactacaggagaaa

SEQ ID NO: 3056 - DNA, 85 bp, Homo sapiens
gaaaaccgaaaacaccaagaaggtcattcagtacctggccgtggtggcctcctcccacaagggcaagaaagacacaagtatcacg

SEQ ID NO: 3057 - DNA, 500 bp, Homo sapiens
agcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacagg

SEQ ID NO: 3058 - DNA, 442 bp, Homo sapiens
tggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctg

SEQ ID NO: 3059 - DNA, 36 bp, Homo sapiens
agctggagggtgatgccagcgacttccacgagcaga

SEQ ID NO: 3060 - DNA, 36 bp, Homo sapiens
aaattattttcataattggtggtcctggctctggca

SEQ ID NO: 3061 - DNA, 36 bp, Homo sapiens
gaaacgaagcaagacaaacagcaaacaggcattttg

SEQ ID NO: 3062 - DNA, 254 bp, Homo sapiens
atcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcg

SEQ ID NO: 3063 - DNA, 212 bp, Homo sapiens
gtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttca

SEQ ID NO: 3064 - DNA, 76 bp, Homo sapiens
tggtgcctctttagcaagtgataagaacgactgtaaaacagaaagcaaaaatgaccctaagactgaaagaaaaaag

SEQ ID NO: 3065 - DNA, 499 bp, Homo sapiens
catgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcaaggcgctgcggcgcgaggcgctcgggttggagcagctgcgcgcgcggctggaggacgcgctgctgcggatgcgcgaggagtacgggatacaggccgaggagcggcagagagtgattgactgcctggaggatgagaaggcaaccctcaccttggccatggctgactggctgcgggactatcaggacctcctgcaggtgaagaccggcctcagtttggaggtggcgacctaccgggccttattggaaggagaaagtaatccagagatagtgatctgggctgagcacg

SEQ ID NO: 3066 - DNA, 162 bp, Homo sapiens
ttcttagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaa

SEQ ID NO: 3067 - DNA, 60 bp, Homo sapiens
ccaaaagaaaaaggatccacaagagttcatgccctgaacaatgtcaacaaggcactgcgg

SEQ ID NO: 3068 - DNA, 36 bp, Homo sapiens
ggtttcccagccaaccaggtacttgcacccagaagg

SEQ ID NO: 3069 - DNA, 36 bp, Homo sapiens
ttgtaacctggagaagagacctgtcatttactccat

SEQ ID NO: 3070 - DNA, 160 bp, Homo sapiens
tacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatg

SEQ ID NO: 3071 - DNA, 308 bp, Homo sapiens
atggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaa

SEQ ID NO: 3072 - DNA, 36 bp, Homo sapiens
cagtcccagctcagcatgaaagcatccctggagggc

SEQ ID NO: 3073 - DNA, 36 bp, Homo sapiens
tccatcaattctccatagaaagtgacacggatctct

SEQ ID NO: 3074 - DNA, 36 bp, Homo sapiens
gctccggcagccgccctggttgaaggtttagaacag

SEQ ID NO: 3075 - DNA, 500 bp, Homo sapiens
ttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcag

SEQ ID NO: 3076 - DNA, 36 bp, Homo sapiens
cctcatgaagatgcagtggtggaatgtaactcaaaa

SEQ ID NO: 3077 - DNA, 36 bp, Homo sapiens; identical to SEQ ID NO: 3048

SEQ ID NO: 3078 - DNA, 486 bp, Homo sapiens
gccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctg

SEQ ID NO: 3079 - DNA, 36 bp, Homo sapiens
gacaatgccaatgtccttctgcagattgacaatgcc

SEQ ID NO: 3080 - DNA, 26 bp, Homo sapiens
gacaatgccaatgtccttctgcagat

SEQ ID NO: 3081 - DNA, 201 bp, Homo sapiens
tatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattc

SEQ ID NO: 3082 - DNA, 30 bp, Homo sapiens
gtggaatgtaactcaaaactggaccccacc

SEQ ID NO: 3083 - DNA, 36 bp, Homo sapiens
ttcgagacattctttcaggtcctgcatactgatgaa

SEQ ID NO: 3084 - DNA, 420 bp, Homo sapiens
cagagacattatggaacgtggagacctggtgccctcaggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattttctgaaggca

SEQ ID NO: 3085 - DNA, 36 bp, Homo sapiens
agtacccgatagaacatggcatcatcaccaactggg

SEQ ID NO: 3086 - DNA, 135 bp, Homo sapiens
tttcgttccttctagaaggtctggaggacgtagagttattgaaaatgcagatggttctgaggaggaaacggacactcgagacgcagacttcaatggaaccaaggccagtgaataagcaactttctacagttttgc

SEQ ID NO: 3087 - DNA, 151 bp, Homo sapiens
tataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtag

SEQ ID NO: 3088 - DNA, 500 bp, Homo sapiens
agaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaagtcatcgggcagctggaggaaacccttcccgagcgcatgagggaggagctgtccgccctcaccagagaggggcagggtgggccggggagcgttt

SEQ ID NO: 3089 - DNA, 500 bp, Homo sapiens
ttgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaaccc

SEQ ID NO: 3090 - DNA, 500 bp, Homo sapiens
gctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccc

SEQ ID NO: 3091 - DNA, 36 bp, Homo sapiens
aaaatgcatgtttgttagaatggaaacagaaaaaca

SEQ ID NO: 3092 - DNA, 500 bp, Homo sapiens
agtggcggctatggcagcagagccagaggcagctatggctttggtggcgccgggagtggatttggtttcggtggtggagccggcattggctttgatctgggtggtggagccggccttgctggtggctttgggggccctggcttccctgtgtgcccccctggaggcatccaagaggtcactgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctagagcagcagaacaaggttctggacaccaagtggaccctgctgcaggagcagggcaccaagactgtgaggcagaacctggagccgttgttcgagcagtacatcaacaacctcaggaggcagctggacaacatcgtgggggaacggggccgcctggactcggagctgagaaacatgcaggacctggt

SEQ ID NO: 3093 - DNA, 264 bp, Homo sapiens
agagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgc

SEQ ID NO: 3094 - DNA, 500 bp, Homo sapiens
ggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactca

SEQ ID NO: 3095 - DNA, 28 bp, Homo sapiens
cccgatagaacatggcatcatcaccaac

SEQ ID NO: 3096 - DNA, 25 bp, Homo sapiens
cggagttgcaagcaaacgggtttca

SEQ ID NO: 3097 - DNA, 198 bp, Homo sapiens
gttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgag

SEQ ID NO: 3098 - DNA, 216 bp, Homo sapiens
ttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccag

SEQ ID NO: 3099 - DNA, 97 bp, Homo sapiens
cttacgacaggctcgtgaatggcatgctccaatgtgtggcagcaggattcccagagcccacaatagattggtatttttgtccaggaactgagcagag

SEQ ID NO: 3100 - DNA, 36 bp, Homo sapiens
gcctccttcatcgacaaggtgcggttcctggagcag

SEQ ID NO: 3101 - DNA, 112 bp, Homo sapiens
ccagaggacgtttttcttcaactctgcacagctattgactctattttctgaaggcaaaaatgcatgtttgttagaatggaaacagaaaaacattaaaaagttcattccttaa

SEQ ID NO: 3102 - DNA, 238 bp, Homo sapiens
tttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgta

SEQ ID NO: 3103 - DNA, 400 bp, Homo sapiens
gagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcct

SEQ ID NO: 3104 - DNA, 25 bp, Homo sapiens
atgttgtacctggaaaacaatgccc

SEQ ID NO: 3105 - DNA, 349 bp, Homo sapiens
gagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctg

SEQ ID NO: 3106 - DNA, 266 bp, Homo sapiens
gagaggctggcggcagtggtggctctcccggctgggttgtcagtcagtgagaggagggggaagatggctcaccgggacccgttctgctaggaagaaggggagcaggtggtgctgctactcgggaggaagcagagcagcctccgtcgctgtcgctgagagcctcacgagtcgaggtcctgcaggtggagctccggcagccgccctggttgaaggtttagaacagatgtggaaaaatgtttacttcagagaaaggggttgtggaggaa

SEQ ID NO: 3107 - DNA, 500 bp, Homo sapiens
cgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagag

SEQ ID NO: 3108 - DNA, 36 bp, Homo sapiens; identical to SEQ ID NO: 3076

SEQ ID NO: 3109 - DNA, 500 bp, Homo sapiens
agaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcagg

SEQ ID NO: 3110 - DNA, 193 bp, Homo sapiens
atttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttccc

SEQ ID NO: 3111 - DNA, 500 bp, Homo sapiens; identical to SEQ ID NO: 3010

SEQ ID NO: 3112 - DNA, 500 bp, Homo sapiens
ctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccaaccagcccagaatgcgact

SEQ ID NO: 3113 - DNA, 36 bp, Homo sapiens
ctcagcttcttctgctaggtttgtctcttcagggtc

SEQ ID NO: 3114 - DNA, 151 bp, Homo sapiens
ccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggt

SEQ ID NO: 3115 - DNA, 160 bp, Homo sapiens; identical to SEQ ID NO: 3070

SEQ ID NO: 3116 - DNA, 116 bp, Homo sapiens
gaagtttgcagattaggtacaagctagatagacatcaaaatcctgatgcatttacctttgattttaaaaacatggctgatgggcaacttcaccaagtgaagattaacagagaagaa

SEQ ID NO: 3117 - DNA, 409 bp, Homo sapiens
gctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacag

SEQ ID NO: 3118 - DNA, 72 bp, Homo sapiens
gaagccaaattgacagaggagtgtgatcttctcattgagatcattcagcaaagacgacagattattggaacc

SEQ ID NO: 3119 - DNA, 322 bp, Homo sapiens
tacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggct

SEQ ID NO: 3120 - DNA, 157 bp, Homo sapiens
gggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctga

SEQ ID NO: 3121 - DNA, 501 bp, Homo sapiens
gccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcacgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctgg

SEQ ID NO: 3122 - DNA, 282 bp, Homo sapiens; identical to SEQ ID NO: 3053

SEQ ID NO: 3123 - DNA, 423 bp, Homo sapiens
acaattagagagaggggaagcttcagtggtagatcttaagaagaatttggaatatgcagccacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagccccggttcaagagcatcgttcacgcagtgcaggctgggatatttgtggagagaatgtatagacggacatcaaacatggttggactgagctatccaccagctgttattgaggcattaaaggatgtggacaagtggtcctttgacgtcttttccctcaatgaggccagtggggatcatgcactgaaatttattttcta

SEQ ID NO: 3124 - DNA, 344 bp, Homo sapiens
tggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatat

SEQ ID NO: 3125 - DNA, 500 bp, Homo sapiens
atttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttc

SEQ ID NO: 3126 - DNA, 36 bp, Homo sapiens; identical to SEQ ID NO: 3032

SEQ ID NO: 3127 - DNA, 500 bp, Homo sapiens
aggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcacc

SEQ ID NO: 3128 - DNA, 287 bp, Homo sapiens
gcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaac

SEQ ID NO: 3129 - DNA, 400 bp, Homo sapiens; identical to SEQ ID NO: 3103

SEQ ID NO: 3130 - DNA, 500 bp, Homo sapiens
ctgcagacaatttcatgctgaaaaggagattatttttcagggccccatttctgctgcagggaaggttggtgattattttgcaacagaagagtcagtgggtacccagacttctgtcaggcaactccagttaggccctaaagaagggttcagtgggcaaatccagttcacagctccactttcagacaaggtggagttgggtgtcacaggagattctgtacacatggaagggttgccagggagcagcacatccatcaggcacatcagcattgggcctcagaggcatcagaccacccagcagatagtttaccatgggctggttccccaactgggggaatctggtgactcagagagcactgtgcacggagagggctcagcagatgtgcaccaggccactcacagtcatacctcgggtagacaaaccgttatgactgaaaagagcaccttccaaagtgtcgtttctgaatctccccaggaggatagtgcagaggacacatcagggg

SEQ ID NO: 3131 - DNA, 36 bp, Homo sapiens
tggcttgggtgctggctttggtggtggttttgctgg

SEQ ID NO: 3132 - DNA, 36 bp, Homo sapiens
gcctcctacctggacaaggtacgtgccctggaggag

SEQ ID NO: 3133 - DNA, 226 bp, Homo sapiens
actactgatgtcagctggtctgaaggaccctaccagaagctaaatcatcaaagaatgcaatttccatatcctaatgattcaatctcccttaccctgaccaatcagtggcccaaattttccagccccttgcctcccagaaccccagcccagaactcttcagagatttaagaatctcctcctacctcctgactcagcaccatgtaatcattaaactctctgctgcaaa

SEQ ID NO: 3134 - DNA, 240 bp, Homo sapiens
cttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatg

SEQ ID NO: 3135 - DNA, 345 bp, Homo sapiens; identical to SEQ ID NO: 3054

SEQ ID NO: 3136 - DNA, 36 bp, Homo sapiens
ccaggctccgtgaagaagatcaatgagtcaacccaa

SEQ ID NO: 3137 - DNA, 500 bp, Homo sapiens
gccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctg

SEQ ID NO: 3138 - DNA, 25 bp, Homo sapiens
aatgtaactcaaaactggaccccac

SEQ ID NO: 3139 - DNA, 155 bp, Homo sapiens
ctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaa

SEQ ID NO: 3140 - DNA, 36 bp, Homo sapiens; identical to SEQ ID NO: 3132

SEQ ID NO: 3141 - DNA, 236 bp, Homo sapiens
tcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccag

SEQ ID NO: 3142 - DNA, 201 bp, Homo sapiens
cttggccagagccgacctggagatgcagattgagaacctcaaggaggagctggcctacctgaagaagaaccacgaggaggagataaacgccctgcgaggccaggtgggcggtgagatcaatgtggagatggacgctgccccaggcatggacctgagccgcatcctgaacgagatgcatgagtagtacgagaagatggcaga

SEQ ID NO: 3143 - DNA, 36 bp, Homo sapiens
atgcctcaggaagcccagaaaatccaatctgatttg

SEQ ID NO: 3144 - DNA, 36 bp, Homo sapiens
tcttcatcttccagccagtacaaggccaatatgcac

SEQ ID NO: 3145 - DNA, 352 bp, Homo sapiens
cgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggag

SEQ ID NO: 3146 - DNA, 36 bp, Homo sapiens
gcctcctacctggacaaggtgcgtgccctggaggag

SEQ ID NO: 3147 - DNA, 365 bp, Homo sapiens
tttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggt

SEQ ID NO: 3148 - DNA, 500 bp, Homo sapiens
ctacctgcagccgccagttcacctcctccagctccatgaagggctcctgcggcatcgggggcggcatcgggggcggctccagccgcatctcctccgtcctggccggagggtcctgccgcgcccccagcacctacgggggcggcctgtctgtctcatcctcccgcttctcctctgggggagcctacgggctggggggcggctatggcggtggcttcagcagcagcagcagcagctttggtagtggctttgggggaggatatggtggtggccttggtgctggcttgggtggtggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctgctgagatcaaagactacagtccctacttcaagacc

SEQ ID NO: 3149 - DNA, 264 bp, Homo sapiens
ttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccag

SEQ ID NO: 3150 - DNA, 36 bp, Homo sapiens; identical to SEQ ID NO: 3132

SEQ ID NO: 3151 - DNA, 36 bp, Homo sapiens; identical to SEQ ID NO: 3076

SEQ ID NO: 3152 - DNA, 427 bp, Homo sapiens
gccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatg

SEQ ID NO: 3153 - DNA, 500 bp, Homo sapiens
gtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgca

SEQ ID NO: 3154 - DNA, 205 bp, Homo sapiens
cagctagtggaagtacctcaaagcagcaatacgagtctggcctctttttgcaacaaagtaaaaaaaatcagagaaagatatcatgcagctgatgttaatttcaattctgggaagatctggagcactactacagcatttccgtatcagctcttttctaagaccaagtttaatatacatatttttattgataactcaacacaacctc

SEQ ID NO: 3155 - DNA, 93 bp, Homo sapiens
ggccagaaagacagctatgtgggggatgaggctcagagcaagcgagggatcctaactctcaaataccccattgaacacggcatcatcaccaac

SEQ ID NO: 3156 - DNA, 36 bp, Homo sapiens; identical to SEQ ID NO: 3132

SEQ ID NO: 3157 - DNA, 32 bp, Homo sapiens
cctgctgcaagtcactgccttccaagtgcagc

SEQ ID NO: 3158 - DNA, 367 bp, Homo sapiens
tgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagc

SEQ ID NO: 3159 - DNA, 500 bp, Homo sapiens
cttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacct

SEQ ID NO: 3160 - DNA, 265 bp, Homo sapiens
tggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaag

SEQ ID NO: 3161 - DNA, 52 bp, Homo sapiens
gcttgagaatggtgactgatcgaccagattgcttgggccatcggaatacctc

SEQ ID NO: 3162 - DNA, 500 bp, Homo sapiens; identical to SEQ ID NO: 3089

SEQ ID NO: 3163 - DNA, 359 bp, Homo sapiens
gcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtg

SEQ ID NO: 3164 - DNA, 36 bp, Homo sapiens; identical to SEQ ID NO: 3132

SEQ ID NO: 3165 - DNA, 171 bp, Homo sapiens
gtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacac

SEQ ID NO: 3166 - DNA, 245 bp, Homo sapiens
cagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaac

SEQ ID NO: 3167 - DNA, 36 bp, Homo sapiens
gggccagttcgaaagggatctccaagcccgggacga

SEQ ID NO: 3168 - DNA, 116 bp, Homo sapiens
cagctatgtgtgaagaagaggacagcactgccttggtgtgtgacaatggctctgggctctgtaaggccggctttgctggggacgatgctcccagggctgttttcccatccattgtg

SEQ ID NO: 3169 - DNA, 486 bp, Homo sapiens
cagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaaggcacgcgcggcacagccatgaacaccaacgatgccaaggagtatctggcccggagggaaatccctcagctttttgagagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacgga

SEQ ID NO: 3170 - DNA, 500 bp, Homo sapiens; identical to SEQ ID NO: 3020

SEQ ID NO: 3171 - DNA, 500 bp, Homo sapiens
atctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacact

SEQ ID NO: 3172 - DNA, 500 bp, Homo sapiens; identical to SEQ ID NO: 3036

SEQ ID NO: 3173 - DNA, 36 bp, Homo sapiens
cagtcccagctcagcatgaaagcatccctggagaac

SEQ ID NO: 3174 - DNA, 36 bp, Homo sapiens
aaaggtcgctactgcatgcagctggcccagatccag

SEQ ID NO: 3175 - DNA, 36 bp, Homo sapiens; identical to SEQ ID NO: 3076

SEQ ID NO: 3176 - DNA, 36 bp, Homo sapiens; identical to SEQ ID NO: 3005

SEQ ID NO: 3177 - DNA, 500 bp, Homo sapiens
gtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatatgagcccagaaaacggaggatgggggtggggcgccttcctggaggtgacacttgatgggggtgtgttctggttactgttctaaggctgtgccatcagctccttcctcccctgttcattctgcattctctagtcagttggctaagaagtgactcttgcaactaaaaaaattaagaaattcacttcccctctaggaggtgatgatagggtttctaatggttatatg

SEQ ID NO: 3178 - DNA, 500 bp, Homo sapiens
acttctgaacatggggcatattcagatctgcttcagcgtcagaaggcaacagtgcttgagaatagcaaacttacaggaaagataagtgagttggaaagaatggtagctgaactaaagaaacaaaagtcccgagtagaggaagaacttccgaaggtcagggaggctgcagaaaatgaattgagaaagcagcagagaaatgtagaagatatctctctgcagaagataagggctgaaagtgaagccaagcagtaccgcagggaacttgaaaccattgtgagagagaaggaagccgctgaaagagaactggagcgggtgaggcagctcaccatagaggccgaggctaaaagagctgccgtggaagagaacctcctgaattttcgcaatcagttggaggaaaacacctttaccagacgaacactggaagatcatcttaaaagaaaagatttaagtctcaatgatttggagcaacaaaaaaataaattaatggaagaattaagaag

SEQ ID NO: 3179 - DNA, 338 bp, Homo sapiens
gccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaa

SEQ ID NO: 3180 - DNA, 250 bp, Homo sapiens
gttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacagg

SEQ ID NO: 3181 - DNA, 409 bp, Homo sapiens
ggtacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctg

SEQ ID NO: 3182 - DNA, 117 bp, Homo sapiens
ccagaggacgtttttcttcaactctgcacagctattgactctattttctgaaggcaaaaatgcatgtttgttagaatggaaacagaaaaacattaaaaagttcattccttaacacaa

SEQ ID NO: 3183 - DNA, 36 bp, Homo sapiens
aatcaagctgtgccaaccgtatggaaaaattgtatc

SEQ ID NO: 3184 - DNA, 93 bp, Homo sapiens
ggacaaaaagacagctacgtgggtgacgaagcacagagcaaaagaggaatcctgaccctgaagtacccgatagaacatggcatcatcaccaac

SEQ ID NO: 3185 - DNA, 36 bp, Homo sapiens
cagactgcataaaatcagctgctcgactgatccaaa

SEQ ID NO: 3186 - DNA, 217 bp, Homo sapiens
attgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttt

SEQ ID NO: 3187 - DNA, 260 bp, Homo sapiens
tgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaa

SEQ ID NO: 3188 - DNA, 36 bp, Homo sapiens
tagaccctgatcatctggttctcctctcattaagca

SEQ ID NO: 3189 - DNA, 65 bp, Homo sapiens
atcatggccaccaccatcgacaactcccgggtcatcctggagatcgacaatgccaggctggctgc

SEQ ID NO: 3190 - DNA, 479 bp, Homo sapiens
cctgatcgaacagcctcacttgtgttgctgtcagtgccagtagggcaggcaggaatgcagcagagaggactcgccatcgtggccttggctgtctgtgcggccctacatgcctcagaagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtaaaggaaatgtttgccacaggaagaaacaccatggcaagaggaacagtaacagggcacatcaggggaaacacgaaacatacggccataaaactccttattagagagtctacagataaatctacagagacaattcctcaagtgg

SEQ ID NO: 3191 - DNA, 395 bp, Homo sapiens
gccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttg

SEQ ID NO: 3192 - DNA, 150 bp, Homo sapiens
gggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagaga

SEQ ID NO: 3193 - DNA, 208 bp, Homo sapiens
ggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccc

SEQ ID NO: 3194 - DNA, 34 bp, Homo sapiens
cctgggcctttgaatgaccaggacgatgaagact

SEQ ID NO: 3195 - DNA, 36 bp, Homo sapiens; identical to SEQ ID NO: 3100

SEQ ID NO: 3196 - DNA, 500 bp, Homo sapiens
tttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacgaagaaggcaagacatggaaggatatagtagttctggttctcaaactcctgaatc

SEQ ID NO: 3197 - DNA, 156 bp, Homo sapiens
ctgggttgtcagtcagtgagaggagggggaagatggctcaccgggacccgttctgctaggaagaaggggagcaggtggtgctgctactcgggaggaagcagagcagcctccgtcgctgtcgctgagagcctcacgagtcgaggtcctgcaggtgga

SEQ ID NO: 3198 - DNA, 36 bp, Homo sapiens
tggcaagagtgagatctcggagctccggcgcaccat

SEQ ID NO: 3199 - DNA, 500 bp, Homo sapiens
cctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgcc

SEQ ID NO: 3200 - DNA, 260 bp, Homo sapiens; identical to SEQ ID NO: 3187

SEQ ID NO: 3201 - DNA, 36 bp, Homo sapiens; identical to SEQ ID NO: 3076

SEQ ID NO: 3202 - DNA, 396 bp, Homo sapiens
atgcagaacctcaatgaccgcctggcctcctacctggacaaggtacgtgccctggaggaggccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctg

SEQ ID NO: 3203 - DNA, 500 bp, Homo sapiens
gccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggc

SEQ ID NO: 3204 - DNA, 36 bp, Homo sapiens
gcttttctgacactccaggtagcgagggagttgggt

SEQ ID NO: 3205 - DNA, 179 bp, Homo sapiens
ccccgatagcatcttctgggaagaatccaaccaagatacaaagcagatgatggtggatcggcaaactcttttctatgaaaagaaaaaccagatataccagggactggaaagcacctgcttgaaaattgatatgagcatgtctgaatttttcccttataagagcctgagtattgtaacag

SEQ ID NO: 3206 - DNA, 500 bp, Homo sapiens
aacgcagacagtgtggtgcactacagactccagcctccctttgaagccaggttcctgcgctttctccctttagcctggaaccccaggggcaggattgggatgcggatcgaagtgtacggatgtgcatataaatctgaggtggtttattttgatggacaaagtgctctgctgtatacacttgataaaaaacctttaaaaccaataagagatgttatttctttgaaatttaaagccatgcagagcaatggaattctacttcacagagaaggacaacatggaaatcacattactctggaattaattaaaggaaagcttgtcttttttcttaattcaggcaatgctaagctgccttctactattgctcctgtgaccctcaccctgggcagcctgctggatgaccagcactggcattccgtcctcatcgagctcctcgacacgcaggtcaacttcaccgtggacaaacacactcatcatttccaagcaaagggagattccagtaa

SEQ ID NO: 3207 - DNA, 36 bp, Homo sapiens
gcctccttcatcgacaaggtgcggtttctggagcag

SEQ ID NO: 3208 - DNA, 500 bp, Homo sapiens; identical to SEQ ID NO: 3112

SEQ ID NO: 3209 - DNA, 500 bp, Homo sapiens
aaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacg

SEQ ID NO: 3210 - DNA, 500 bp, Homo sapiens
agatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtgt

SEQ ID NO: 3211 - DNA, 434 bp, Homo sapiens
cctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcag

SEQ ID NO: 3212 - DNA, 119 bp, Homo sapiens
gcctatggtcaaaatccagttttgatggtgcctctttagcaagtgataagaacgactgtaaaacagaaagcaaaaatgaccctaagactgaaagaaaaaagtcttcatcttccagccag

SEQ ID NO: 3213 - DNA, 34 bp, Homo sapiens
ttaccaaattatgccacaaatttgaaagacaaga

SEQ ID NO: 3214 - DNA, 427 bp, Homo sapiens; identical to SEQ ID NO: 3152

SEQ ID NO: 3215 - DNA, 76 bp, Homo sapiens
ctcaagagttcatgatcccttttcaattccaatttgttgccatcctttatagtcctgggtctctgtcatcatttag

SEQ ID NO: 3216 - DNA, 112 bp, Homo sapiens
aaaacgggcaatgctgtgagagccattggaagactgtcctctatggcaatgatctcagggctcagtggcaggaaatcctcaacagggtcaccaaccagcccgctcaatgcag

SEQ ID NO: 3217 - DNA, 36 bp, Homo sapiens
gagaaaattaccatgcagaacctcaatgaccgcctg

SEQ ID NO: 3218 - DNA, 500 bp, Homo sapiens
acgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaa

SEQ ID NO: 3219 - DNA, 396 bp, Homo sapiens; identical to SEQ ID NO: 3202

SEQ ID NO: 3220 - DNA, 27 bp, Homo sapiens
taaccaagaaaaacaaacgagatggaa

SEQ ID NO: 3221 - DNA, 287 bp, Homo sapiens; identical to SEQ ID NO: 3128

SEQ ID NO: 3222 - DNA, 219 bp, Homo sapiens
gacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaa

SEQ ID NO: 3223 - DNA, 412 bp, Homo sapiens
gaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgcagatgggcaccaacaagtttgccagccagcagggcatgacggcctatggcacccggcgccacctctacgaccccaagctgggcacagaccagcctctggaccaggcgaccatcagcctgcagatgggcacc

SEQ ID NO: 3224 - DNA, 500 bp, Homo sapiens
gcctcctacctggacaaggtacgtgccctggaggaggccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacga

SEQ ID NO: 3225 - DNA, 500 bp, Homo sapiens
gagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttc

SEQ ID NO: 3226 - DNA, 498 bp, Homo sapiens
gagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagct

SEQ ID NO: 3227 - DNA, 501 bp, Homo sapiens
gccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcc

SEQ ID NO: 3228 - DNA, 114 bp, Homo sapiens
gccaatgctgacctggaggtgaagatccatgactggtaccagaagcagaccccaaccagcccagaatgcgactacagccaatacttcaagaccattgaagagctccgggacaag

SEQ ID NO: 3229 - DNA, 36 bp, Homo sapiens
aggactggcagcagtaagatcttccctggcaactgg

SEQ ID NO: 3230 - DNA, 36 bp, Homo sapiens
gaagagctccgggacaagatcatggccaccaccatc

SEQ ID NO: 3231 - DNA, 409 bp, Homo sapiens; identical to SEQ ID NO: 3181

SEQ ID NO: 3232 - DNA, 114 bp, Homo sapiens; identical to SEQ ID NO: 3228

SEQ ID NO: 3233 - DNA, 365 bp, Homo sapiens; identical to SEQ ID NO: 3147

SEQ ID NO: 3234 - DNA, 26 bp, Homo sapiens
atatgtcaaggctgttggtaacctga

SEQ ID NO: 3235 - DNA, 155 bp, Homo sapiens; identical to SEQ ID NO: 3139

SEQ ID NO: 3236 - DNA, 354 bp, Homo sapiens
gccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagag

SEQ ID NO: 3237 - DNA, 36 bp, Homo sapiens
agcacagagcaaaagaggaatcctgaccctgaagta

SEQ ID NO: 3238 - DNA, 400 bp, Homo sapiens
cagatccagtccggcccgcagcgcaactcggtccagtcggggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtg

SEQ ID NO: 3239 - DNA, 113 bp, Homo sapiens
tagaaatggaagctcttaaaaccgtgtataagtcaggggaaacgattgtggtcacctgtgctgtttttaacaatgaggtggttgaccttcaatggacttaccctggagaagtg

SEQ ID NO: 3240 - DNA, 500 bp, Homo sapiens; identical to SEQ ID NO: 3206

SEQ ID NO: 3241 - DNA, 500 bp, Homo sapiens; identical to SEQ ID NO: 3090

SEQ ID NO: 3242 - DNA, 315 bp, Homo sapiens
tctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggc

SEQ ID NO: 3243 - DNA, 158 bp, Homo sapiens
gctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattct

SEQ ID NO: 3244 - DNA, 501 bp, Homo sapiens; identical to SEQ ID NO: 3227

SEQ ID NO: 3245 - DNA, 271 bp, Homo sapiens
gtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagca

SEQ ID NO: 3246 - DNA, 62 bp, Homo sapiens
tactcatgtctcctgactgaccaaggtccacatttgtcaaggtcaagagttgggcagaagct

SEQ ID NO: 3247 - DNA, 482 bp, Homo sapiens
tccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagag

SEQ ID NO: 3248 - DNA, 58 bp, Homo sapiens
gcagctccaccactgtgcacttagccatgatggcaacagaaaccaagagacacaatta

SEQ ID NO: 3249 - DNA, 288 bp, Homo sapiens
agccatttggacagaagccctaaatggcccagaggcacagccatttagaactcttttcttttttttttttttttcagtagaatattttgacccccagaggtatgcgtagctatatcggggatccaaaggtttcacacaggatgagtcctgtgtctacatgcagcgtagcaggagctgggaatggaagcaaaccaatattccagcatctgcttctagaacagtgatcaggatcgctatcgttaataagatgggtgtatgtgggacccaagactcatctgtcaagccctt

SEQ ID NO: 3250 - DNA, 116 bp, Homo sapiens; identical to SEQ ID NO: 3168

SEQ ID NO: 3251 - DNA, 93 bp, Homo sapiens; identical to SEQ ID NO: 3184

SEQ ID NO: 3252 - DNA, 338 bp, Homo sapiens; identical to SEQ ID NO: 3179

SEQ ID NO: 3253 - DNA, 36 bp, Homo sapiens; identical to SEQ ID NO: 3230

SEQ ID NO: 3254 - DNA, 36 bp, Homo sapiens
tcgacaactcccgggtcatcctggagatcgacaatg

SEQ ID NO: 3255 - DNA, 500 bp, Homo sapiens
tacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctg

SEQ ID NO: 3256 - DNA, 434 bp, Homo sapiens; identical to SEQ ID NO: 3211

SEQ ID NO: 3257 - DNA, 36 bp, Homo sapiens
gagctctcggcgtcctcggtttacaacctgctacca

SEQ ID NO: 3258 - DNA, 491 bp, Homo sapiens
tgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacag

SEQ ID NO: 3259 - DNA, 500 bp, Homo sapiens
gggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaa

SEQ ID NO: 3260 - DNA, 201 bp, Homo sapiens
gctccgggactaggagagcgggacggggacctcgggcctggggtctgcagggggcccggcctccgctgccgcgacactgcgagggagcagccagccaagagccgggcgttatattgcgattggcactttatgctgaccatcggtaacggacatttatcactggagttttttttttttttaactattaaataaacggttatt

SEQ ID NO: 3261 - DNA, 159 bp, Homo sapiens
tctggctgggactgacttggccatgttctcagctgagccacgcggctggtagtgcagccttctgtgaccccgctgtggtaagtccagcctgcccagggctgctgagggctgcctcttgacagtgcagtcttatcgagacccaatgcctcagtctgctca

SEQ ID NO: 3262 - DNA, 500 bp, Homo sapiens
cgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccaaccagcccagaatgcgactacagccaatacttcaagaccatt

SEQ ID NO: 3263 - DNA, 429 bp, Homo sapiens
gtcttgcacagtatagtggtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaac

SEQ ID NO: 3264 - DNA, 500 bp, Homo sapiens
aagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctca

SEQ ID NO: 3265 - DNA, 36 bp, Homo sapiens
gccctggaggaggccaacgctgacctggaggtgaag

SEQ ID NO: 3266 - DNA, 36 bp, Homo sapiens
gctgtttgagcgcatcattgacgaggactttgagct

SEQ ID NO: 3267 - DNA, 36 bp, Homo sapiens
aagaagaaccacgaggaggagatgaacgccctgcga

SEQ ID NO: 3268 - DNA, 365 bp, Homo sapiens
tctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatcctt

SEQ ID NO: 3269 - DNA, 36 bp, Homo sapiens; identical to SEQ ID NO: 3072

SEQ ID NO: 3270 - DNA, 36 bp, Homo sapiens; identical to SEQ ID NO: 3230

SEQ ID NO: 3271 - DNA, 415 bp, Homo sapiens
agcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactg

SEQ ID NO: 3272 - DNA, 154 bp, Homo sapiens
aggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtc

SEQ ID NO: 3273 - DNA, 354 bp, Homo sapiens; identical to SEQ ID NO: 3236

SEQ ID NO: 3274 - DNA, 36 bp, Homo sapiens
agctggctttggaggtggcttcggtggccctggctt

SEQ ID NO: 3275 - DNA, 418 bp, Homo sapiens
atgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgc

SEQ ID NO: 3276 - DNA, 123 bp, Homo sapiens
gacggagcgtgagtgcatcaagtacatgcggcagatctcggagggagtggagtacatccacaagcagggcatcgtgcacctggacctcaagccggagaacatcatgtgtgtcaacaagacggg

SEQ ID NO: 3277 - DNA, 25 bp, Homo sapiens
actctgatcaacttctggccagtag

SEQ ID NO: 3278 - DNA, 112 bp, Homo sapiens; identical to SEQ ID NO: 3216

SEQ ID NO: 3279 - DNA, 34 bp, Homo sapiens
gtgtcctgtgatgctggtggtaggagaccaagca

SEQ ID NO: 3280 - DNA, 500 bp, Homo sapiens
gcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatg

SEQ ID NO: 3281 - DNA, 500 bp, Homo sapiens
gaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctca

SEQ ID NO: 3282 - DNA, 36 bp, Homo sapiens
cgcagcgcggtggaagagatggaggcagaagaagct

SEQ ID NO: 3283 - DNA, 500 bp, Homo sapiens; identical to SEQ ID NO: 3224

SEQ ID NO: 3284 - DNA, 36 bp, Homo sapiens
ttggccaggccgctgcaggtaggcacggcccccacc

SEQ ID NO: 3285 - DNA, 500 bp, Homo sapiens; identical to SEQ ID NO: 3218

SEQ ID NO: 3286 - DNA, 154 bp, Homo sapiens; identical to SEQ ID NO: 3272

SEQ ID NO: 3287 - DNA, 112 bp, Homo sapiens; identical to SEQ ID NO: 3216

SEQ ID NO: 3288 - DNA, 500 bp, Homo sapiens
tacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgtta

SEQ ID NO: 3289 - DNA, 114 bp, Homo sapiens
gtacgtgccctggaggaggccaatgctgacctggaggtgaagatccatgactggtaccagaagcagaccccaaccagcccagaatgcgactacagccaatacttcaagaccatt

SEQ ID NO: 3290 - DNA, 311 bp, Homo sapiens
gccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttt

SEQ ID NO: 3291 - DNA, 36 bp, Homo sapiens
aagaagaaccacgaagaggagatgaaggagttcagc

SEQ ID NO: 3292 - DNA, 378 bp, Homo sapiens
agaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcact

SEQ ID NO: 3293 - DNA, 36 bp, Homo sapiens
ccttacatggtcaccaatagtcagcgtgggagaaat

SEQ ID NO: 3294 - DNA, 359 bp, Homo sapiens
ccagtcaccccggccacctgcggtgctatctcccccagccccatcctctgtacagagcccacgcccccactggtgacatgtcttttcttgcatgaggctagtgtggtgtttcctggcactgcttccagtgaggctctgcccttggttaggcattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagc

SEQ ID NO: 3295 - DNA, 32 bp, Homo sapiens; identical to SEQ ID NO: 2997

SEQ ID NO: 3296 - DNA, 279 bp, Homo sapiens
caaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctatt

SEQ ID NO: 3297 - DNA, 36 bp, Homo sapiens
gacgattcccaccataaggctgaaaaatcatcagta

SEQ ID NO: 3298 - DNA, 419 bp, Homo sapiens
caccagcgggagcaggagctgagagagtggatcgagggggtgacaggccgtcgcatcggcaacaacttcatggacggcctcaaagatggcatcattctttgcgaattcatcaataagctgcagccaggctccgtgaagaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgca

SEQ ID NO: 3299 - DNA, 36 bp, Homo sapiens
attccttcgttactactgctgagcgtgagattgtcc

SEQ ID NO: 3300 - DNA, 500 bp, Homo sapiens
aagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagt

SEQ ID NO: 3301 - DNA, 201 bp, Homo sapiens
ttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaag

SEQ ID NO: 3302 - DNA, 25 bp, Homo sapiens
accaccaacttttcctccaaccatt

SEQ ID NO: 3303 - DNA, 26 bp, Homo sapiens
ctggaaagcatgaagactgggccttt

SEQ ID NO: 3304 - DNA, 500 bp, Homo sapiens; identical to SEQ ID NO: 3127

SEQ ID NO: 3305 - DNA, 471 bp, Homo sapiens
tcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagct

SEQ ID NO: 3306 - DNA, 409 bp, Homo sapiens; identical to SEQ ID NO: 3181

SEQ ID NO: 3307 - DNA, 500 bp, Homo sapiens
actgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaa

SEQ ID NO: 3308 - DNA, 443 bp, Homo sapiens
gcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaa

SEQ ID NO: 3309 - DNA, 500 bp, Homo sapiens
ccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgagattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgc

SEQ ID NO: 3310 - DNA, 500 bp, Homo sapiens; identical to SEQ ID NO: 3137

SEQ ID NO: 3311 - DNA, 236 bp, Homo sapiens
tgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcac

SEQ ID NO: 3312 - DNA, 409 bp, Homo sapiens; identical to SEQ ID NO: 3181

SEQ ID NO: 3313 - DNA, 500 bp, Homo sapiens
caggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacat

SEQ ID NO: 3314 - DNA, 45 bp, Homo sapiens
gagcagcgcgcgcaagcaggccaggggaaggtgggcgcaggtgag

SEQ ID NO: 3315 - DNA, 28 bp, Homo sapiens
tggctatccaggcggtgctgtctctcta

SEQ ID NO: 3316 - DNA, 373 bp, Homo sapiens
ggtacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaat

SEQ ID NO: 3317 - DNA, 500 bp, Homo sapiens; identical to SEQ ID NO: 3262

SEQ ID NO: 3318 - DNA, 36 bp, Homo sapiens
ggtgtttgattattggaatggtgccatattgtcact

SEQ ID NO: 3319 - DNA, 500 bp, Homo sapiens; identical to SEQ ID NO: 3109

SEQ ID NO: 3320 - DNA, 155 bp, Homo sapiens; identical to SEQ ID NO: 3139

SEQ ID NO: 3321 - DNA, 36 bp, Homo sapiens; identical to SEQ ID NO: 3299

SEQ ID NO: 3322 - DNA, 36 bp, Homo sapiens; identical to SEQ ID NO: 3076

SEQ ID NO: 3323 - DNA, 36 bp, Homo sapiens
ggagtgtggaggttcaaagagaatgtggaagatggc

SEQ ID NO: 3324 - DNA, 27 bp, Homo sapiens
gaccccctgggcaaaaaggagagatgg

SEQ ID NO: 3325 - DNA, 152 bp, Homo sapiens
caatgaccacactgatgatcgggtcccgcacttctcttcccaacaccaactgcttcatcaaggccatcgatgtgtacctggggatctgctttagctttgtgtttggggccttgctagaatatgcagttgctcactacagttccttacagcag

SEQ ID NO: 3326 - DNA, 481 bp, Homo sapiens
ccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctca

SEQ ID NO: 3327 - DNA, 500 bp, Homo sapiens; identical to SEQ ID NO: 3109

SEQ ID NO: 3328 - DNA, 26 bp, Homo sapiens
gaaccagctacaaccatagtgcctac

SEQ ID NO: 3329 - DNA, 36 bp, Homo sapiens
gaagtgtcaccattgcagcctgtaaatgaaaatatg

SEQ ID NO: 3330 - DNA, 229 bp, Homo sapiens
cagattgtcttgttattttctggattttggggactcgccatgggagcctttccgagcagcgtgcaaataggtggtctcttcatccgaaacacagatcaggaatacactgcttttcgattagcaatttttcttcataacaccgcccccaatgcgtcggaagctccttttaatttggtacctcatgtggacaacattgagacagccaacagttttgctgtaacaaacgcct

SEQ ID NO: 3331 - DNA, 36 bp, Homo sapiens
aacctcaatgaccgcctggcctcctacctggacaag

SEQ ID NO: 3332 - DNA, 500 bp, Homo sapiens
cgcaaccaggagatcctgcatcgatgaatcccagatttctgctgaagaagcggaggatcatggacgcatccccgaccctgatgattttgtgccgcctgtgcctcccccttcctattttgccacgttttactcgtgcacaccccggatgaaccgcaggatggttggtcctgatgttattcccctgccacacatctacggagctcgaatcaaaggtgtggaagtgttctgtcctctggatcccccgccgccatatgaagctgtggtgagccagatggaccaggagcagggatcttcattccaaatgtcagaaggatcagaagctgctgtgatcccattggatctgggctgcacacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctcc

SEQ ID NO: 3333 - DNA, 29 bp, Homo sapiens
ggacaaaaagacagctacgtgggtgacga

SEQ ID NO: 3334 - DNA, 93 bp, Homo sapiens; identical to SEQ ID NO: 3155

SEQ ID NO: 3335 - DNA, 36 bp, Homo sapiens
cagcaacctgcagcacatcaattttacccgaaacaa

SEQ ID NO: 3336 - DNA, 359 bp, Homo sapiens; identical to SEQ ID NO: 3163

SEQ ID NO: 3337 - DNA, 25 bp, Homo sapiens
gtggagaaggagttggaccagtcaa

SEQ ID NO: 3338 - DNA, 36 bp, Homo sapiens
gggaaggggaagaggaagaagagtgaaacaaagcca

SEQ ID NO: 3339 - DNA, 36 bp, Homo sapiens; identical to SEQ ID NO: 3329

SEQ ID NO: 3340 - DNA, 271 bp, Homo sapiens; identical to SEQ ID NO: 3245

SEQ ID NO: 3341 - DNA, 188 bp, Homo sapiens
ctttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttc

SEQ ID NO: 3342 - DNA, 414 bp, Homo sapiens
aactctaagcttggggccctggagagaacagttgtggcctgcaggtcattagtgaggtgagcagaagggaatcctggacttcccagagaaagaggagaccatgccagcctcgtggaacacagctaccaggaaatacagaagcaggtctattccttgcgaactccgaagtccatgaaaaaacggacccacagtggggtggctaaaatgtcccagcgcaagctgccgctgctgctgatggaccatagctcaagggcaaggcttgtaaaggattttacaaaggattttaaagtatagccagaaaagatacggtgtttagaagttaaacgctgttgtctgaaggaagtttgccggaaagatgtaggcttcaagggctactggacaatgattggtctgaacttcaacttacgggaactg

SEQ ID NO: 3343 - DNA, 36 bp, Homo sapiens
ggacatcttttcagccaggaagagctctctggaaat

SEQ ID NO: 3344 - DNA, 469 bp, Homo sapiens
gagccggccttgctggtggctttgggggccctggcttccctgtgtgcccccctggaggcatccaagaggtcactgtcaaccagagtctcctgactcccctcaacctgcaaattgaccccgccatccagcgggtgcgggccgaggagcgtgagcagatcaagaccctcaacaacaagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaa

SEQ ID NO: 3345 - DNA, 236 bp, Homo sapiens; identical to SEQ ID NO: 3141

SEQ ID NO: 3346 - DNA, 116 bp, Homo sapiens; identical to SEQ ID NO: 3168

SEQ ID NO: 3347 - DNA, 36 bp, Homo sapiens
tgggctgtgagctgaacggatgcgccaatcccctgg

SEQ ID NO: 3348 - DNA, 500 bp, Homo sapiens
atgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagca

SEQ ID NO: 3349 - DNA, 39 bp, Homo sapiens
gagatttgcttagattgttgtactgctgccatttttatt

SEQ ID NO: 3350 - DNA, 63 bp, Homo sapiens
caggaggtgcagatcacagaggagaagccactgttgccaggacagacgcctgaggcggccaag

SEQ ID NO: 3351 - DNA, 500 bp, Homo sapiens; identical to SEQ ID NO: 3218

SEQ ID NO: 3352 - DNA, 198 bp, Homo sapiens
aaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaact

SEQ ID NO: 3353 - DNA, 500 bp, Homo sapiens
cctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggc

SEQ ID NO: 3354 - DNA, 36 bp, Homo sapiens
cagcgtctcttcaaaaaggtgggtgcaggctgggca

SEQ ID NO: 3355 - DNA, 409 bp, Homo sapiens
aaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaa

SEQ ID NO: 3356 - DNA, 365 bp, Homo sapiens
agagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcgg

SEQ ID NO: 3357 - DNA, 380 bp, Homo sapiens
cagcagcagcagcagctttggtagtggctttgggggaggatatggtggtggccttggtgctggcttgggtggtggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttcc

SEQ ID NO: 3358 - DNA, 36 bp, Homo sapiens
cttcccaaatgcatccgggtcagtgtgcagctgaaa

SEQ ID NO: 3359 - DNA, 500 bp, Homo sapiens
cctgcagccgccagttcacctcctccagctccatgaagggctcctgcggcatcgggggcggcatcgggggcggctccagccgcatctcctccgtcctggccggagggtcctgccgcgcccccagcacctacgggggcggcctgtctgtctcatcctcccgcttctcctctgggggagcctacgggctggggggcggctatggcggtggcttcagcagcagcagcagcagctttggtagtggctttgggggaggatatggtggtggccttggtgctggcttgggtggtggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctgctgagatcaaagactacagtccctacttcaagaccatt

SEQ ID NO: 3360 - DNA, 500 bp, Homo sapiens
atcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgc

SEQ ID NO: 3361 - DNA, 36 bp, Homo sapiens; identical to SEQ ID NO: 3052

SEQ ID NO: 3362 - DNA, 500 bp, Homo sapiens
gtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcgga

SEQ ID NO: 3363 - DNA, 500 bp, Homo sapiens; identical to SEQ ID NO: 3171

SEQ ID NO: 3364 - DNA, 181 bp, Homo sapiens
aggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctg

SEQ ID NO: 3365 - DNA, 36 bp, Homo sapiens
gcacttacttcagaaacagacctcaatacagtctcc

SEQ ID NO: 3366 - DNA, 25 bp, Homo sapiens
atgagtcaacccaaaattggcacca

SEQ ID NO: 3367 - DNA, 500 bp, Homo sapiens
tgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgt

SEQ ID NO: 3368 - DNA, 36 bp, Homo sapiens
cctttctgtaccccaagccagcacaagattggacca

SEQ ID NO: 3369 - DNA, 470 bp, Homo sapiens
tcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagct

SEQ ID NO: 3370 - DNA, 500 bp, Homo sapiens
ccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctga

SEQ ID NO: 3371 - DNA, 61 bp, Homo sapiens
ggacaaaaagacagctacgtgggtgacgaagcacagagcaaaagaggaatcctgaccctga

SEQ ID NO: 3372 - DNA, 500 bp, Homo sapiens; identical to SEQ ID NO: 3109

SEQ ID NO: 3373 - DNA, 394 bp, Homo sapiens
gagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttc

SEQ ID NO: 3374 - DNA, 500 bp, Homo sapiens
tcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctg

SEQ ID NO: 3375 - DNA, 500 bp, Homo sapiens
cagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtc

SEQ ID NO: 3376 - DNA, 36 bp, Homo sapiens; identical to SEQ ID NO: 3282

SEQ ID NO: 3377 - DNA, 42 bp, Homo sapiens
aacgaccgcctggcctcctacctggacaaggtgcgcgccctg

SEQ ID NO: 3378 - DNA, 59 bp, Homo sapiens
gttgaaatcacctgtgtgtcttaatttctcaattcctttttggcaagaatatcaagcaa

SEQ ID NO: 3379 - DNA, 207 bp, Homo sapiens
cctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaa

SEQ ID NO: 3380 - DNA, 36 bp, Homo sapiens
aaaaagaaccacgaagaggagatgaaggctctgcag

SEQ ID NO: 3381 - DNA, 25 bp, Homo sapiens
tctggagatggtgtcacccacaatg

SEQ ID NO: 3382 - DNA, 25 bp, Homo sapiens
ctggtgatcgctgccaaaactacgt

SEQ ID NO: 3383 - DNA, 36 bp, Homo sapiens; identical to SEQ ID NO: 3358

SEQ ID NO: 3384 - DNA, 437 bp, Homo sapiens
ctctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacgaagaaggcaagacatggaaggatatagtagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatat

SEQ ID NO: 3385 - DNA, 500 bp, Homo sapiens
gaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtga

SEQ ID NO: 3386 - DNA, 30 bp, Homo sapiens
ccaggctggctgcggacgacttcaggctca

SEQ ID NO: 3387 - DNA, 126 bp, Homo sapiens
agaaattattcacatcatcagttgaacaggagcagtaaacatagccaaggcctaagggatcaaggaaaccaagagcaggatccaaatatttccaatggagaagaggaagaagaaaaagagccaggt

SEQ ID NO: 3388 - DNA, 500 bp, Homo sapiens; identical to SEQ ID NO: 3353

SEQ ID NO: 3389 - DNA, 158 bp, Homo sapiens
gcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtg

SEQ ID NO: 3390 - DNA, 500 bp, Homo sapiens
aggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgc

SEQ ID NO: 3391 - DNA, 368 bp, Homo sapiens
aagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaa

SEQ ID NO: 3392 - DNA, 26 bp, Homo sapiens
tggccaccaccatcgacaactcccgg

SEQ ID NO: 3393 - DNA, 500 bp, Homo sapiens; identical to SEQ ID NO: 3360

SEQ ID NO: 3394 - DNA, 313 bp, Homo sapiens
tgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatacta

SEQ ID NO: 3395 - DNA, 28 bp, Homo sapiens
cttcgttactactgctgagcgtgagatt

SEQ ID NO: 3396 - DNA, 500 bp, Homo sapiens; identical to SEQ ID NO: 3218

SEQ ID NO: 3397 - DNA, 45 bp, Homo sapiens; identical to SEQ ID NO: 3314

SEQ ID NO: 3398 - DNA, 68 bp, Homo sapiens
cgtaattatccacaggttaatgtaatcaacttcaccaccagctggtctgatggcctggctttgaatgc

SEQ ID NO: 3399 - DNA, 146 bp, Homo sapiens
tccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcaccc

SEQ ID NO: 3400 - DNA, 36 bp, Homo sapiens
tttattgaagaattggaggctgttgaagccaaggaa

SEQ ID NO: 3401 - DNA, 167 bp, Homo sapiens
attctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagca

SEQ ID NO: 3402 - DNA, 36 bp, Homo sapiens
ctccacttcttctacaaggttgcatgagcccgagaa

SEQ ID NO: 3403 - DNA, 500 bp, Homo sapiens; identical to SEQ ID NO: 3255

SEQ ID NO: 3404 - DNA, 36 bp, Homo sapiens
aactggatatcccaacaggtacgacaccacagagga

SEQ ID NO: 3405 - DNA, 36 bp, Homo sapiens
caacgaccgcctggcctcctacctggacaaggtgcg

SEQ ID NO: 3406 - DNA, 35 bp, Homo sapiens
ggggagtgcttcatggtgaaagacctttcaaaccc

SEQ ID NO: 3407 - DNA, 224 bp, Homo sapiens
cctattcacttcattaaatctagaggcagttgagcatgggagccgtctgtatgttgaattagggctcgcactcttgcgcaacacgtcaccagtcggaaactgggggtttgcttctgtgatttatttcattattgtgctggtaaaagctgatgaagagactagcagctcgctgctttgctggcttgttaattttatccccactaactgtgatttctgatagccgg

SEQ ID NO: 3408 - DNA, 28 bp, Homo sapiens
cttcgttactactgctgagcgtgagatt

SEQ ID NO: 3409 - DNA, 36 bp, Homo sapiens
tgtcctgtgatgctggtggtaggagaccaagcacct

SEQ ID NO: 3410 - DNA, 500 bp, Homo sapiens
caccccaacctttgcctcacgggttcaagggattctcgtgcctcagccttccaagtagctgggattacaggtgtgcgccagtacgcctggctagttttagtattttttgttacagacggggtttcaccatgttggctgggctggtctcaaacttctgatctcaagtgatccatctgccttggcctcccaaagtgctgggattacaggcatgagccactgcacctggcctacgtattaggctttatgtaagatgtacatagtactccatactcctttccttttcctcctattgaaactgttcctataaactttataaaattaatcagagaagaagagagggtgagaaacataaataatccaagcttgcaccacattcagcattaatcactaggtcactttgcttgctgaccccttcctcatagttgtttggctattgcttcagaattatgtggagtctgttacaagattatagttccccttaactgctctatagataacag

SEQ ID NO: 3411 - DNA, 36 bp, Homo sapiens
ccgtgtgtgtctctccaggaggctgagttagctgcc

SEQ ID NO: 3412 - DNA, 48 bp, Homo sapiens
ctgccatttttattggtgtttgattattggaatggtgccatattgtca

SEQ ID NO: 3413 - DNA, 36 bp, Homo sapiens
aagccctctgcagtcatggtttgctgagctacaaag

SEQ ID NO: 3414 - DNA, 148 bp, Homo sapiens
ccctccttcatccagacagcaggtctcatcctaggtccttagagaaaagtgcctggagggcttttaaggagtcacagtgccatcacatgctcaaacatctccacaatggtgcaaggatcacagtgcagatgccacctacaatcgaggg

SEQ ID NO: 3415 - DNA, 36 bp, Homo sapiens
gaaaatgctccacctcatcactcctggaagcctgca

SEQ ID NO: 3416 - DNA, 354 bp, Homo sapiens
agcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaaca

SEQ ID NO: 3417 - DNA, 28 bp, Homo sapiens
cagagcaaaagaggaatcctgaccctga

SEQ ID NO: 3418 - DNA, 36 bp, Homo sapiens; identical to SEQ ID NO: 3204

SEQ ID NO: 3419 - DNA, 36 bp, Homo sapiens; identical to SEQ ID NO: 3415

SEQ ID NO: 3420 - DNA, 25 bp, Homo sapiens
aaactaccttcccaaatgcatccgg

SEQ ID NO: 3421 - DNA, 36 bp, Homo sapiens
ttaagacaaatatttcagactggtgtaaaggacaaa

SEQ ID NO: 3422 - DNA, 65 bp, Homo sapiens
tccatgaaaccacctacaacagcatcatgaagtgtgatattgacatcaggaaggacctctatgct

SEQ ID NO: 3423 - DNA, 36 bp, Homo sapiens
ccaagagctgggattgaaggatcaaggaaaccaaga

SEQ ID NO: 3424 - DNA, 287 bp, Homo sapiens; identical to SEQ ID NO: 3128

SEQ ID NO: 3425 - DNA, 127 bp, Homo sapiens
aacaaaaacgcggtgcatgtcaacctgtttgagacccctgtggaggctcagtacgtgagattgtaccccacgagctgccacacggcctgcactctgcgctttgagctactgggctgtgagctgaacg

SEQ ID NO: 3426 - DNA, 36 bp, Homo sapiens
agaagccggaaaatccagggactcctgaagtcatgt

SEQ ID NO: 3427 - DNA, 500 bp, Homo sapiens
gacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatg

SEQ ID NO: 3428 - DNA, 359 bp, Homo sapiens
tgcggtgctatctcccccagccccatcctctgtacagagcccacgcccccactggtgacatgtcttttcttgcatgaggctagtgtggtgtttcctggcactgcttccagtgaggctctgcccttggttaggcattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagcctcacagtccttaccagc

SEQ ID NO: 3429 - DNA, 462 bp, Homo sapiens
accccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttg

SEQ ID NO: 3430 - DNA, 500 bp, Homo sapiens
aatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctcta

SEQ ID NO: 3431 - DNA, 96 bp, Homo sapiens
tccttgaggctgttgctgaggaaaagcctcatgtaaaaccctatttctctaagaccattcgcgatttagaagttgtggagggaagtgctgctagat

SEQ ID NO: 3432 - DNA, 500 bp, Homo sapiens
aaaccagacggagaaacagtccacgggtgtgtacaaccgggaggccatgctcaacttctgtgaaaaggagaccaagaaacttatgcagagggagatgtccatggatgaaagcaagcaagtggagaccaagacagatgccaagaatggacaggaaaggggcagagatgccagcaaaaaagccctgggccccagacggaactcagatctggggaaggagccaaagaggggtggtttaaagaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggggtgacaggaacacaggcttgagcagggacaaggataaaaagagagaggagatgaaggaggtggccaagaaagagg

SEQ ID NO: 3433 - DNA, 500 bp, Homo sapiens; identical to SEQ ID NO: 3313

SEQ ID NO: 3434 - DNA, 427 bp, Homo sapiens
gacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggata

SEQ ID NO: 3435 - DNA, 36 bp, Homo sapiens; identical to SEQ ID NO: 3415

SEQ ID NO: 3436 - DNA, 36 bp, Homo sapiens; identical to SEQ ID NO: 3415

SEQ ID NO: 3437 - DNA, 36 bp, Homo sapiens
ccaagtttggcatgaaaggttttgttttgtttcata

SEQ ID NO: 3438 - DNA, 36 bp, Homo sapiens
atctacataagtcctttcaattccaccagggccaga

SEQ ID NO: 3439 - DNA, 132 bp, Homo sapiens
tggatttggattcagatgaagatttctcagattttgatgaaaaaactgatgatgaagattttgtcccatcagatgctagtccacctaagaccaaaacttccccaaaacttagtaacaaagaactgaaaccac

SEQ ID NO: 3440 - DNA, 63 bp, Homo sapiens; identical to SEQ ID NO: 3350

SEQ ID NO: 3441 - DNA, 126 bp, Homo sapiens
gagatggtgtcacccacaatgtccccatctatgagggctatgccttgccccatgccatcatgcgtctggatctggctggccgagatctcactgactacctcatgaagatcctgactgagcgtggct

SEQ ID NO: 3442 - DNA, 431 bp, Homo sapiens
caggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctgg

SEQ ID NO: 3443 - DNA, 150 bp, Homo sapiens
gacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctga

SEQ ID NO: 3444 - DNA, 63 bp, Homo sapiens; identical to SEQ ID NO: 3350

SEQ ID NO: 3445 - DNA, 26 bp, Homo sapiens
gttagctgcccgaatcctcctggacc

SEQ ID NO: 3446 - DNA, 36 bp, Homo sapiens
gaaccttgcccagcacaggtggctgctacaccccat

SEQ ID NO: 3447 - DNA, 500 bp, Homo sapiens
acttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctctttctagtaactatattgctcagatttccaacggccagcaactcatgagccagccacagctacataggcgctctaactcttgcagcagcatttctgtagcttcctgtatttcggaatgggagcagaaaattcctacgtacaacacacctctcaaagtcacatctattgcaaggcgtaggcagcaggagccaggacaaagcaaaacttgtatcgtgtcagacagaaggc

SEQ ID NO: 3448 - DNA, 36 bp, Homo sapiens
ctgcaagaacctgcattggagtgacgaccgtgttat

SEQ ID NO: 3449 - DNA, 257 bp, Homo sapiens
aaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttca

SEQ ID NO: 3450 - DNA, 115 bp, Homo sapiens
actgtctgcactcacggcacacacactttgtatcatgcaggccacactcagagctagtcagtacatgaacagtggtgcggtgccagtctgtgtccgttgtgatcacaggccttgc

SEQ ID NO: 3451 - DNA, 98 bp, Homo sapiens
tccctgaaccgccgcattcagctggttgaggaggagctggaccgggcccaggagcgcctggctacagccctgcagaagctggaggaggccgagaaggc

SEQ ID NO: 3452 - DNA, 192 bp, Homo sapiens
gtcgtcccattccacctacatcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggcccc

SEQ ID NO: 3453 - DNA, 421 bp, Homo sapiens
gaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtcc

SEQ ID NO: 3454 - DNA, 63 bp, Homo sapiens
gccaccatggcggagctgcaggaggtgcagatcacagaggagaagccactgttgccaggacag

SEQ ID NO: 3455 - DNA, 36 bp, Homo sapiens; identical to SEQ ID NO: 3297

SEQ ID NO: 3456 - DNA, 36 bp, Homo sapiens; identical to SEQ ID NO: 3207

SEQ ID NO: 3457 - DNA, 452 bp, Homo sapiens
ggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgc

SEQ ID NO: 3458 - DNA, 443 bp, Homo sapiens
acccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagca

SEQ ID NO: 3459 - DNA, 442 bp, Homo sapiens
gagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgg

SEQ ID NO: 3460 - DNA, 500 bp, Homo sapiens; identical to SEQ ID NO: 3375

SEQ ID NO: 3461 - DNA, 41 bp, Homo sapiens
tggtgatcgctgccaaaactacgtaatggccagcttctaca

SEQ ID NO: 3462 - DNA, 130 bp, Homo sapiens
gtgagaaccctgacccctaatcccactgcatccagccaataggagcccagccaccatggcggagctgcaggaggtgcagatcacagaggagaagccactgttgccaggacagacgcctgaggcggccaag

SEQ ID NO: 3463 - DNA, 35 bp, Homo sapiens
gtacactaattatgacttcccccagctctgaggta

SEQ ID NO: 3464 - DNA, 500 bp, Homo sapiens
tacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcaggagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcag

SEQ ID NO: 3465 - DNA, 116 bp, Homo sapiens; identical to SEQ ID NO: 3168

SEQ ID NO: 3466 - DNA, 36 bp, Homo sapiens
tgcaaagccgcgatcacggagttcagatgtgttcta

SEQ ID NO: 3467 - DNA, 36 bp, Homo sapiens
actttactataaagccatgcaaatgacaaaaatcta

SEQ ID NO: 3468 - DNA, 231 bp, Homo sapiens
taaccatggaaaatgagacttaactcttcaagcaagataaattcatactttataaaagtatcaatgctgtagatggatggaagaggcttcccacaggaaggtgccaccagtcagttgtgcctatgtccctttggctggaaatgcagaatatgaattgattagttctctccaagccattgcttaaaatataacatgttttggatccaatacacacattgttacaactaacac

SEQ ID NO: 3469 - DNA, 36 bp, Homo sapiens
tgtgacttcctggtgaaggtgggcacggtcacaatg

SEQ ID NO: 3470 - DNA, 63 bp, Homo sapiens; identical to SEQ ID NO: 3350

SEQ ID NO: 3471 - DNA, 253 bp, Homo sapiens
aagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaagg

SEQ ID NO: 3472 - DNA, 61 bp, Homo sapiens; identical to SEQ ID NO: 3371

SEQ ID NO: 3473 - DNA, 487 bp, Homo sapiens
tacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaacta

SEQ ID NO: 3474 - DNA, 113 bp, Homo sapiens
ctggctcagcagattgcaaactgcaaacagtgcattgagcggtcagcatcactcatctcccaagcggaacactctctgaaggagaatgatcatgcgcgtttcctacagactgc

SEQ ID NO: 3475 - DNA, 36 bp, Homo sapiens
tgcaaggggctggtgaaggtgggtgccccaggcatc

SEQ ID NO: 3476 - DNA, 36 bp, Homo sapiens
tgcatctgtctgctctgcatatatgtctctttggag

SEQ ID NO: 3477 - DNA, 437 bp, Homo sapiens
gcgggtgcttgtggagtgggtggctatggcagccggagcctctacaacctggggggctccaagaggatatccatcagcactagaggaggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctgga

SEQ ID NO: 3478 - DNA, 36 bp, Homo sapiens
ccacatctgtgacttcagttttccagacgggaatca

SEQ ID NO: 3479 - DNA, 301 bp, Homo sapiens
caggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaa

SEQ ID NO: 3480 - DNA, 500 bp, Homo sapiens
agctgtctgaagcccaaagcctgaggacagaaagaccctgatgcaggtcagcccatggaggcagatgcccttgctgggcctgggggttttccaagccctcagctggtcctgaccaggatggagcaagctcttcccttgctcatgagctcctgatcagaggcatttgagcagctgaataacctgcacaggcttgctgtatgacccctggccacagccttccctctgcattgacctggaggggagaggtcagccttgacctaatgaggtagctatagttgcagcccaaggacagttcagagatcaggatcagctttgaaggctggattctatctacataagtcctttcaattccaccagggccagagcagctccaccactgtgcacttagccatgatggcaacagaaaccaagagacacaattacgcaggtatttagaagcagagggacaaccagaaggcccttaactatcaccagtgcatcacatctgcacactctcttct

SEQ ID NO: 3481 - DNA, 36 bp, Homo sapiens
ctacacaggcgctttcaggtgtctggttgagaaggg

SEQ ID NO: 3482 - DNA, 332 bp, Homo sapiens
gccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggag

SEQ ID NO: 3483 - DNA, 35 bp, Homo sapiens; identical to SEQ ID NO: 3406

SEQ ID NO: 3484 - DNA, 36 bp, Homo sapiens
ctggaatgaatttaggagcacgaaagtcaaagaagt

SEQ ID NO: 3485 - DNA, 36 bp, Homo sapiens
cagcaaaagatggccacaaactcctaaggaaaaggc

SEQ ID NO: 3486 - DNA, 500 bp, Homo sapiens
ggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttgatgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagac

SEQ ID NO: 3487 - DNA, 239 bp, Homo sapiens
gaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagag

SEQ ID NO: 3488 - DNA, 66 bp, Homo sapiens
gaggtctattataagaactccctgcccatccttttaacaagaggcttagaaagagacatgccaaaa

SEQ ID NO: 3489 - DNA, 36 bp, Homo sapiens
tggctgaagaatggcgtgattctgagcaagctggtg

SEQ ID NO: 3490 - DNA, 63 bp, Homo sapiens; identical to SEQ ID NO: 3350

SEQ ID NO: 3491 - DNA, 126 bp, Homo sapiens
gcatcctcttgtgatgagactgagatacagatcagcaaccaggaagaagctgagagacagccacttggccatgtcaccaaaacaaggagaaggtgcaagactgtccgtgtggaccctgactcacag

SEQ ID NO: 3492 - DNA, 129 bp, Homo sapiens
aacctacggatgactcgtgctttgacccctacacagtttcccattatgccgttggagatgagtgggaacgaatgtctgaatcaggctttaaactgttgtgccagtgcttaggctttggaagtggtcatt

SEQ ID NO: 3493 - DNA, 357 bp, Homo sapiens
gaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctga

SEQ ID NO: 3494 - DNA, 500 bp, Homo sapiens
ctgacctggtatttatggtggatggatcctggagcattggagatgaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcc

SEQ ID NO: 3495 - DNA, 36 bp, Homo sapiens
acgtacaccctggaaaaggtgggtgcaggatgggag

SEQ ID NO: 3496 - DNA, 36 bp, Homo sapiens
gcattggcatcagggaagcctcttcaggaggtggtg

SEQ ID NO: 3497 - DNA, 500 bp, Homo sapiens
agccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctgg

SEQ ID NO: 3498 - DNA, 500 bp, Homo sapiens
acatggagagatcggttcccagcctacctcactaacttggtctccatcatcttcatgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgat

SEQ ID NO: 3499 - DNA, 36 bp, Homo sapiens
cttctgactgcttttaaggtgccagtcacgaattgc

SEQ ID NO: 3500 - DNA, 130 bp, Homo sapiens; identical to SEQ ID NO: 3462

SEQ ID NO: 3501 - DNA, 250 bp, Homo sapiens
cctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaag

SEQ ID NO: 3502 - DNA, 36 bp, Homo sapiens
gggggacaacatggaaacgtgagtagtagcaaaagc

SEQ ID NO: 3503 - DNA, 330 bp, Homo sapiens
agtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggcc

SEQ ID NO: 3504 - DNA, 59 bp, Homo sapiens
ttctcctgttatgttctggttgaaatcacctgtgtgtcttaatttctcaattccttttt

SEQ ID NO: 3505 - DNA, 500 bp, Homo sapiens
attattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcat

SEQ ID NO: 3506 - DNA, 120 bp, Homo sapiens
aaggaggtgacaggcatcatcacccagggggcccgtaactttggctctgtccagtttgtggcatcctacaaggttgcctacagtaatgacagtgcgaactggactgagtaccaggacccc

SEQ ID NO: 3507 - DNA, 63 bp, Homo sapiens; identical to SEQ ID NO: 3350

SEQ ID NO: 3508 - DNA, 105 bp, Homo sapiens
gccaccatggcggagctgcaggaggtgcagatcacagaggagaagccactgttgccaggacagacgcctgaggcggccaaggaggctgagttagctgcccgaatc

SEQ ID NO: 3509 - DNA, 364 bp, Homo sapiens
ccttaactatcaccagtgcatcacatctgcacactctcttctccattccctagcaggaacttctagctcatttaacagataaagaaactgaggcccacggtttcagctagacaatgatttggccaggcctagtaaccaaggccctgtctctggctactccctggaccacgaggctgattcctctcatttccagcttctcagtttctgcctgggcaatggccaggggccaggagtggggagagttgtgatggaggggagaggggtcacacccaccccctgcctggttctaggctgctgcacaccaaggccctgcatctgtctgctctgcatatatgtctctttggagttggaatttcattatatg

SEQ ID NO: 3510 - DNA, 301 bp, Homo sapiens; identical to SEQ ID NO: 3479

SEQ ID NO: 3511 - DNA, 28 bp, Homo sapiens
acagagcaaaagaggaatcctgaccctg

SEQ ID NO: 3512 - DNA, 325 bp, Homo sapiens
acagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtgg

SEQ ID NO: 3513 - DNA, 36 bp, Homo sapiens
cctggagagcaccaagaggccaagaaagcagagaac

SEQ ID NO: 3514 - DNA, 36 bp, Homo sapiens; identical to SEQ ID NO: 3347

SEQ ID NO: 3515 - DNA, 33 bp, Homo sapiens
actacctcatgaagatcctgactgagcgtggct

SEQ ID NO: 3516 - DNA, 240 bp, Homo sapiens
aggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgc

SEQ ID NO: 3517 - DNA, 55 bp, Homo sapiens
gtagcagcagcaatttccacatcaatgtagaagagtcagtggatggacaggtggt

SEQ ID NO: 3518 - DNA, 384 bp, Homo sapiens
cgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggctt

SEQ ID NO: 3519 - DNA, 447 bp, Homo sapiens
agacttgaatgtgcctctgggcaaagaagcagagctaacgaggaaagggatttaaagagtttttcttgggtgtttgtcaaacttttattccctgtctgtgtgcagaggggattcaacttcaattttctgcagtggctctgggtccagccccttacttaaagatctggaaagcatgaagactgggccttttttcctatgtctcttgggaactgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctag

SEQ ID NO: 3520 - DNA, 152 bp, Homo sapiens
ctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattattcaacagagt

SEQ ID NO: 3521 - DNA, 36 bp, Homo sapiens; identical to SEQ ID NO: 3297

SEQ ID NO: 3522 - DNA, 36 bp, Homo sapiens
atgaactgtgttgtaaagcatgccaaggcaaaggct

SEQ ID NO: 3523 - DNA, 330 bp, Homo sapiens
aacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcaga

SEQ ID NO: 3524 - DNA, 290 bp, Homo sapiens
ccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagaca

SEQ ID NO: 3525 - DNA, 500 bp, Homo sapiens
agcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggacacaaatgatatcacatatgcagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggacc

SEQ ID NO: 3526 - DNA, 61 bp, Homo sapiens
tgagcgtggaggtgatatcaccctcaggtgtcctgtgatgctggtggtaggagaccaagca

SEQ ID NO: 3527 - DNA, 36 bp, Homo sapiens
aagtggagaccaagacagatgccaagaatggacagg

SEQ ID NO: 3528 - DNA, 500 bp, Homo sapiens
gtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcgg

SEQ ID NO: 3529 - DNA, 335 bp, Homo sapiens
gatacagaaaccagcctcgaggtccagttggaaatgaaccattggttactgacgtggttttgcagagttttccacctttgccgtcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaac

SEQ ID NO: 3530 - DNA, 176 bp, Homo sapiens
ctgggccttttttcctatgtctcttgggaactgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaa

SEQ ID NO: 3531 - DNA, 353 bp, Homo sapiens
catgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatgg

SEQ ID NO: 3532 - DNA, 40 bp, Homo sapiens
caggaggtgcagatcacagaggagaagccactgttgccag

SEQ ID NO: 3533 - DNA, 501 bp, Homo sapiens
cgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatcctt

SEQ ID NO: 3534 - DNA, 498 bp, Homo sapiens; identical to SEQ ID NO: 3226

SEQ ID NO: 3535 - DNA, 471 bp, Homo sapiens
acttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgta

SEQ ID NO: 3536 - DNA, 36 bp, Homo sapiens; identical to SEQ ID NO: 3358

SEQ ID NO: 3537 - DNA, 36 bp, Homo sapiens
agggagatgtccatggatgaaagcaagcaagtggag

SEQ ID NO: 3538 - DNA, 252 bp, Homo sapiens
gccaatatttccatagccgccaatacaagcatccagatggatttgagggaaaacgcatcctggtgattggaatgggaaactcaggctcagatattgctgttgagctgagtaagaatgctgctcaggtttttatcagcaccaggcatggcacctgggtcatgagccgtatctctgaagatggctatccttgggactcagtgttccacacccggtttcgttctatgctccgcaatgtactgccacgaacagctg

SEQ ID NO: 3539 - DNA, 36 bp, Homo sapiens
gtggaggtcttgccggaggtagcagtggaagctact

SEQ ID NO: 3540 - DNA, 287 bp, Homo sapiens; identical to SEQ ID NO: 3128

SEQ ID NO: 3541 - DNA, 36 bp, Homo sapiens
atcctggcgagatatgctcttaaccacccggacact

SEQ ID NO: 3542 - DNA, 36 bp, Homo sapiens
gagaagaaggccactgatgctgaggcagatgtggcc

SEQ ID NO: 3543 - DNA, 500 bp, Homo sapiens
agttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctga

SEQ ID NO: 3544 - DNA, 32 bp, Homo sapiens; identical to SEQ ID NO: 2997

SEQ ID NO: 3545 - DNA, 71 bp, Homo sapiens
gctgaatgtgcggaatctgtttgagcagcttgtgcgccgggtggagattctcagtgaaggaaatgaagtcc

SEQ ID NO: 3546 - DNA, 291 bp, Homo sapiens
agcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcct

SEQ ID NO: 3547 - DNA, 36 bp, Homo sapiens
taactaggatatcagaaaatcagggagtccctgtac

SEQ ID NO: 3548 - DNA, 36 bp, Homo sapiens
ttggtgctggcttgggtggtggctttggtggtggct

SEQ ID NO: 3549 - DNA, 347 bp, Homo sapiens
aatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagaga

SEQ ID NO: 3550 - DNA, 36 bp, Homo sapiens
caactgctcagtattctggtggctcatccacaataa

SEQ ID NO: 3551 - DNA, 36 bp, Homo sapiens
ccctactttgtccatcaggtggtgaggtttctgaag

SEQ ID NO: 3552 - DNA, 500 bp, Homo sapiens; identical to SEQ ID NO: 3109

SEQ ID NO: 3553 - DNA, 200 bp, Homo sapiens
ctaattatcttgtcaaagatctaattgcagaaattctgcatttttgcacaaatgaccagctactccccaaagatcatattctaagtgtatgtggctctgaagaatttttacaaaacgaccactgtttggggagccacaaaatgtttcaaaaagataaatctgttattcagctccacctgcagaaaagtagggaagctcca

SEQ ID NO: 3554 - DNA, 63 bp, Homo sapiens; identical to SEQ ID NO: 3454

SEQ ID NO: 3555 - DNA, 500 bp, Homo sapiens; identical to SEQ ID NO: 3109

SEQ ID NO: 3556 - DNA, 480 bp, Homo sapiens
gcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctct

SEQ ID NO: 3557 - DNA, 482 bp, Homo sapiens
tggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttg

SEQ ID NO: 3558 - DNA, 36 bp, Homo sapiens
tttatgtgtttgttagagatcctgccaagcttttcc

SEQ ID NO: 3559 - DNA, 36 bp, Homo sapiens
tcttgaggaagaaaacaggaatctgcaagcagaata

SEQ ID NO: 3560 - DNA, 117 bp, Homo sapiens
gggagcccagcacattcccccagagagaatggcctagacaagacacgcctgctcaagaaagatgccccgattagtccagcctctattgcatcttccagcagtactccctcctccaaa

SEQ ID NO: 3561 - DNA, 35 bp, Homo sapiens
gaatcttaccaagctgaaaaacaagcatgaatcta

SEQ ID NO: 3562 - DNA, 287 bp, Homo sapiens; identical to SEQ ID NO: 3128

SEQ ID NO: 3563 - DNA, 500 bp, Homo sapiens
gaagaagtcagtattactaatatcatcaacagctccatctccagctttaaacggaagatcagctttgccagcattgaaatttccagcgacaacgttgactacagtgacttgacaatgaaaaccagcgacaagttcaagtttgtcttccgagaaaagatgggcaggattgttgattatttcacaattcaaaaccccagtaatgttgatcactattccaaactactgtttcctttgatttttatgctagccaatgtattttactgggcatactacatgtatttttgagtcaatgttaaatttcttgcatgccataggtcttcaacaggacaagataatgatgtaaatggtattttaggccaagtgtgcacccacatccaatggtgctacaagtgactgaaataatatttgagtctttctgctcaaagaatgaagctccaaccattgttctaagctgtgtagaagtcctagcattataggatcttgtaatagaaacatcagtc

SEQ ID NO: 3564 - DNA, 500 bp, Homo sapiens
gctcgccagaagcccttgattccactggttgacatggcagcagttactggcaagagggagaaaggacgctgccgcctaagagtgcaaggctgctcaggtctccaagcgccgtaggaggtcacctggcagtgactgtagggagctgggtcatagtgcacgtcgtgggtattaggaaagcctgtattctttcaatgaatgtcagtaggaccttcctttagctgtaagacttggtgggcggggtggggtggggagggaggaaagggtaggaagggtgggaagggagaagcagacatagtcatttatgatttgaaagttggaagtttgtaccatctgtttgagtatatgcacatttaaaaaatatcatatagtaaatgcaaacatgccaagtattttataaagattaataacagacctactcttacctggcagtttacttaacttactgttttgagtcctaaacttagagttgttaatgcttatatataatctaaccaaagagt

SEQ ID NO: 3565 - DNA, 25 bp, Homo sapiens
tcacgtcaagaagccaaattgacag

SEQ ID NO: 3566 - DNA, 500 bp, Homo sapiens
gtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaag

SEQ ID NO: 3567 - DNA, 500 bp, Homo sapiens
cacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggt

SEQ ID NO: 3568 - DNA, 36 bp, Homo sapiens
gaagttggtacccacaatgataaccaagaaagaaag

SEQ ID NO: 3569 - DNA, 303 bp, Homo sapiens
agagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaa

SEQ ID NO: 3570 - DNA, 36 bp, Homo sapiens; identical to SEQ ID NO: 3541

SEQ ID NO: 3571 - DNA, 41 bp, Homo sapiens
atacagtctccatcttcatatggtaacagctccccacctct

SEQ ID NO: 3572 - DNA, 25 bp, Homo sapiens
gaggctgagttagctgcccgaatcc

SEQ ID NO: 3573 - DNA, 162 bp, Homo sapiens
agtaataaagaaggcagaacaaaatgagctgggctttggaagaatggaaagaagggctgcctacaagagctcttcagaaaattcaagagcttgaaggacagcttgacaaactgaagaaggaaaagcagcaaaggcagtttcagcttgacagtctcgaggctg

SEQ ID NO: 3574 - DNA, 93 bp, Homo sapiens
tccattgcaaatcgggtgtttgcattccaagccagtatcaatgcaatggtgaggtggactgcattacaggggaagatgaagttggctgtgcag

SEQ ID NO: 3575 - DNA, 214 bp, Homo sapiens
ggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtca

SEQ ID NO: 3576 - DNA, 89 bp, Homo sapiens
atggcaaaagatgttgacgtacaactggctcctgaggctgtcaattgtttagagctcccaagtagtactgcattacggaatctactact

SEQ ID NO: 3577 - DNA, 112 bp, Homo sapiens
cgaatcctcctggaccagggacagactcactctgtggagacaccatacggctctgtcactttcactgtctatggcacccccaaacccaaacgcccagcgatccttacctacc

SEQ ID NO: 3578 - DNA, 301 bp, Homo sapiens
gttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtac

SEQ ID NO: 3579 - DNA, 492 bp, Homo sapiens
ggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgcc

SEQ ID NO: 3580 - DNA, 333 bp, Homo sapiens
actcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctac

SEQ ID NO: 3581 - DNA, 41 bp, Homo sapiens; identical to SEQ ID NO: 3571

SEQ ID NO: 3582 - DNA, 36 bp, Homo sapiens
ggaggagatcgcagcagggtaagagacaccaacacc

SEQ ID NO: 3583 - DNA, 314 bp, Homo sapiens
gtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgagg

SEQ ID NO: 3584 - DNA, 36 bp, Homo sapiens
ctagagaaacaattccagctcctgagccagtcaaat

SEQ ID NO: 3585 - DNA, 500 bp, Homo sapiens
acctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgta

SEQ ID NO: 3586 - DNA, 44 bp, Homo sapiens
gccaccatggcggagctgcaggaggtgcagatcacagaggagaa

SEQ ID NO: 3587 - DNA, 90 bp, Homo sapiens
gtcaatgcatcacgtcaagaagccaaattgacagaggagtgtgatcttctcattgagatcattcagcaaagacgacagattattggaacc

SEQ ID NO: 3588 - DNA, 36 bp, Homo sapiens
gattgggcagcccacaagctaacaggcctcacctct

SEQ ID NO: 3589 - DNA, 445 bp, Homo sapiens
tgtttgagtgcaccctgctggtcagaggtgcaagcagatgagaatccagacattgcatgtggaggtctccagctcaggaaagtggggagggaaataattttggttcttgtgcaataaaagttgaccttgactctctgaggaagattttgctgcttttgcctgaagaaaacagacccatctctggaggtctcaggaagggcccagcgaacacactctcttggataattaccacgatggcgtcagcaaacactccaccctgtgcctttttagtccttcccgccctcctgcctctcccttacacccctcttaacgactttcaaactaaaggatacatcatatactgacaaactcaatgtggtcctttcaagaattagccatgagtctcaaaaaggcaataaatggctctaagtggacaggtttgcttcaaacaagtaacatctacatt

SEQ ID NO: 3590 - DNA, 36 bp, Homo sapiens
agaaggaagtggctaaaacattgcacaggagaagtc

SEQ ID NO: 3591 - DNA, 36 bp, Homo sapiens; identical to SEQ ID NO: 3347

SEQ ID NO: 3592 - DNA, 383 bp, Homo sapiens
ccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaag

SEQ ID NO: 3593 - DNA, 44 bp, Homo sapiens
gctctgtcactgagcaatggtaactgcacctgggcagctcctcc

SEQ ID NO: 3594 - DNA, 267 bp, Homo sapiens
gtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccatag

SEQ ID NO: 3595 - DNA, 36 bp, Homo sapiens
gacaatgtcaagaaacagtgcgccaatctgcagaac

SEQ ID NO: 3596 - DNA, 36 bp, Homo sapiens
ctggagggccgctttcgcctgtcccacgtcctgcaa

SEQ ID NO: 3597 - DNA, 500 bp, Homo sapiens
gtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcc

SEQ ID NO: 3598 - DNA, 36 bp, Homo sapiens
tgaatgtatctgcccacagggatgatgtgaagctca

SEQ ID NO: 3599 - DNA, 36 bp, Homo sapiens
ccgtgctaggaactgagagtgatgcgactgtgaaaa

SEQ ID NO: 3600 - DNA, 36 bp, Homo sapiens
acgcctgaggcggccaaggaggctgagttagctgcc

SEQ ID NO: 3601 - DNA, 500 bp, Homo sapiens
tgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgca

SEQ ID NO: 3602 - DNA, 36 bp, Homo sapiens
tttgtgatgctgaagaaggatgtagatgctgcctac

SEQ ID NO: 3603 - DNA, 36 bp, Homo sapiens
taagaatatcaccgagagagtctccatggcaactgc

SEQ ID NO: 3604 - DNA, 36 bp, Homo sapiens
acagtcagcagaacagggcaagagttctagccaaga

SEQ ID NO: 3605 - DNA, 500 bp, Homo sapiens
gacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcc

SEQ ID NO: 3606 - DNA, 69 bp, Homo sapiens
gttgaaggtcttgtcctcatcaacattgatcccaatgccaagggttggatggattgggcagcccacaag

SEQ ID NO: 3607 - DNA, 36 bp, Homo sapiens
ccccatgttgcatatcagggtgctcaaggattggag

SEQ ID NO: 3608 - DNA, 36 bp, Homo sapiens
ttgtcaccactctggagaatgtcagcccaccaagaa

SEQ ID NO: 3609 - DNA, 130 bp, Homo sapiens; identical to SEQ ID NO: 3462

SEQ ID NO: 3610 - DNA, 36 bp, Homo sapiens
tttgatcagggtaaccaagaacaagaagataactcc

SEQ ID NO: 3611 - DNA, 71 bp, Homo sapiens
atgaaaaagaaacagcagtatccacagaagacgattcccaccataaggctgaaaaatcatcagtactaaag

SEQ ID NO: 3612 - DNA, 500 bp, Homo sapiens
gacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaa

SEQ ID NO: 3613 - DNA, 36 bp, Homo sapiens; identical to SEQ ID NO: 3297

SEQ ID NO: 3614 - DNA, 36 bp, Homo sapiens
aaggacgatatgaacgaggtagggccgagagctcag

SEQ ID NO: 3615 - DNA, 458 bp, Homo sapiens
ggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaa

SEQ ID NO: 3616 - DNA, 36 bp, Homo sapiens
gatctcagtcaacttcaagaggcttggttagctgaa

SEQ ID NO: 3617 - DNA, 500 bp, Homo sapiens
atttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccct

SEQ ID NO: 3618 - DNA, 152 bp, Homo sapiens
actgcagaggatgggaaatgctatactgccatgcctggaaacacccacaggaaaattaccagttttgagcttgctcaactgcaagaaaaactgaaggagacagaagcagccatggaaaaattattcaacagagtgggacctaatggtgagag

SEQ ID NO: 3619 - DNA, 500 bp, Homo sapiens
cagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccga

SEQ ID NO: 3620 - DNA, 34 bp, Homo sapiens
ggatttccagaaccacacttgaaaccttttttta

SEQ ID NO: 3621 - DNA, 240 bp, Homo sapiens
ctgggccttttttcctatgtctcttgggaactgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaagacgattcccaccataaggctgaaaaatcatcagtactaaagtcaaaagaggaaagccatgaac

SEQ ID NO: 3622 - DNA, 378 bp, Homo sapiens
ctgggccttttttcctatgtctcttgggaactgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgattgagc

SEQ ID NO: 3623 - DNA, 130 bp, Homo sapiens; identical to SEQ ID NO: 3462

SEQ ID NO: 3624 - DNA, 500 bp, Homo sapiens
accgaggaaccagggcaacttttattgacttctcagtgtacaacgccaacattaacctgttctgtgtggtcaggttattggttgaattcccagcaacaggtggtgtgattccatcttggcaatttcagcctttaaagctgatccgatatgtcacaacttttgatttcttcctggcagcctgtgagattatcttttgtttctttatcttttactatgtggtggaagagatattggaaattcgcattcacaaactacactatttcaggagtttctggaattgtctggatgttgtgatcgttgtgctgtcagtggtagctataggaattaacatatacagaacatcaaatgtggaggtgctactacagtttctggaagatcaaaatactttccccaactttgagcatctggcatattggcagatacagttcaacaatatagctgctgtcacagtattttttgtctggattaagctcttcaaattcatcaattttaacaggacc

SEQ ID NO: 3625 - DNA, 132 bp, Homo sapiens
gttctccagcttcagctcaactcacagcttctccaagcatcaccctgggagtttcctgagggttttctcataaatgagggctgcacattgcctgttctgcttcgaagtattcaataccgctcagtattttaa

SEQ ID NO: 3626 - DNA, 481 bp, Homo sapiens
ttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcg

SEQ ID NO: 3627 - DNA, 500 bp, Homo sapiens
caatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacacttaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacata

SEQ ID NO: 3628 - DNA, 77 bp, Homo sapiens
tcattgacattctaactaagcgaaacaatgcacagcgtcaacagatcaaagcagcatatctccaggaaacaggaaag

SEQ ID NO: 3629 - DNA, 93 bp, Homo sapiens
catgccaaggcaaaggcttccattgcaaatcgggtgtttgcattccaagccagtatcaatgcaatggtgaggtggactgcattacaggggaag

SEQ ID NO: 3630 - DNA, 36 bp, Homo sapiens
gaaattgcagctcgttatgacagcgatggtgagaaa

SEQ ID NO: 3631 - DNA, 36 bp, Homo sapiens
actgcagctgcaatcccgacaaatgcaagattatta

SEQ ID NO: 3632 - DNA, 363 bp, Homo sapiens
gaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatac

SEQ ID NO: 3633 - DNA, 36 bp, Homo sapiens
gcaaacgggaattctcgcccgagcctcttgaagcca

SEQ ID NO: 3634 - DNA, 500 bp, Homo sapiens
ggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaag

SEQ ID NO: 3635 - DNA, 83 bp, Homo sapiens
atgtgctggaagaaatgattgcatcattgataagattcgacgaaagaattgtcctgcttgcagacttcagaaatgtcttcaag

SEQ ID NO: 3636 - DNA, 36 bp, Homo sapiens; identical to SEQ ID NO: 3590

SEQ ID NO: 3637 - DNA, 500 bp, Homo sapiens; identical to SEQ ID NO: 3612

SEQ ID NO: 3638 - DNA, 36 bp, Homo sapiens; identical to SEQ ID NO: 3466

SEQ ID NO: 3639 - DNA, 90 bp, Homo sapiens
aaggtgatcatggatgctctggatgagagagccaaggtgctgcatgaggacaagcagacccgggagcagctgcatagcatcagcgactct

SEQ ID NO: 3640 - DNA, 130 bp, Homo sapiens; identical to SEQ ID NO: 3462

SEQ ID NO: 3641 - DNA, 326 bp, Homo sapiens
ggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctccc

SEQ ID NO: 3642 - DNA, 36 bp, Homo sapiens; identical to SEQ ID NO: 3542

SEQ ID NO: 3643 - DNA, 500 bp, Homo sapiens
aaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagt

SEQ ID NO: 3644 - DNA, 109 bp, Homo sapiens
ggtgacggtgctgaagaaggccctggatgaagagacgcggtcccatgaggctcaggtccaggagatgaggcagaaacacgcacaggcggtggaggagctcacagagcag

SEQ ID NO: 3645 - DNA, 36 bp, Homo sapiens
tcccaactggtttatgaagaaagcgcaggagcataa

SEQ ID NO: 3646 - DNA, 156 bp, Homo sapiens
tgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaa

SEQ ID NO: 3647 - DNA, 138 bp, Homo sapiens
aagtgaaatttgtctgtcaaactccagcaattgctgacattgtaatcctggtcgatggttcatggagtattggaagattcaacttcagactggttcggcatttcttggaaaacctggttacagcattcgatgtgggct

SEQ ID NO: 3648 - DNA, 501 bp, Homo sapiens
atccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtaattggtcctgatggtttaatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaa

SEQ ID NO: 3649 - DNA, 426 bp, Homo sapiens
ctaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgattgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaat

SEQ ID NO: 3650 - DNA, 500 bp, Homo sapiens
gttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctt

SEQ ID NO: 3651 - DNA, 36 bp, Homo sapiens; identical to SEQ ID NO: 3293

SEQ ID NO: 3652 - DNA, 420 bp, Homo sapiens
aattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggc

SEQ ID NO: 3653 - DNA, 364 bp, Homo sapiens
gggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctct

SEQ ID NO: 3654 - DNA, 501 bp, Homo sapiens
ctctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgc

SEQ ID NO: 3655 - DNA, 116 bp, Homo sapiens; identical to SEQ ID NO: 3168

SEQ ID NO: 3656 - DNA, 262 bp, Homo sapiens
gcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtaccc

SEQ ID NO: 3657 - DNA, 171 bp, Homo sapiens
ctgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctaca

SEQ ID NO: 3658 - DNA, 500 bp, Homo sapiens
cacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgct

SEQ ID NO: 3659 - DNA, 35 bp, Homo sapiens; identical to SEQ ID NO: 3406

SEQ ID NO: 3660 - DNA, 500 bp, Homo sapiens
gaatccttctgccagcgtttggggaaataccggatgccctttgcctgggcacccataagcttatcaagcttcttcaatgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgt

SEQ ID NO: 3661 - DNA, 36 bp, Homo sapiens
gaatcagacagaagaaagcccagggctccacttctt

SEQ ID NO: 3662 - DNA, 36 bp, Homo sapiens
cgccgcgcgcctgccccggtaccagtacctgagacg

SEQ ID NO: 3663 - DNA, 498 bp, Homo sapiens
gacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgat

SEQ ID NO: 3664 - DNA, 36 bp, Homo sapiens
aacaacaaggcctagaagaaaaccatgagctgtttt

SEQ ID NO: 3665 - DNA, 36 bp, Homo sapiens; identical to SEQ ID NO: 3603

SEQ ID NO: 3666 - DNA, 202 bp, Homo sapiens
gttggagccatcagtgggatacgccacattttggaagccccagcatcgtgtacttaccagtgtgttcacaaaatgaaatttgtgtgagagctgtacattaaaaaaaatcatcattattattattatttgcagtcatggagaaccacctacccctgacttctgtttagtctcctttttaaataaaaattactgtgttagagaa

SEQ ID NO: 3667 - DNA, 500 bp, Homo sapiens
ccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagt

SEQ ID NO: 3668 - DNA, 187 bp, Homo sapiens
tccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagataga

SEQ ID NO: 3669 - DNA, 500 bp, Homo sapiens
aacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaat

SEQ ID NO: 3670 - DNA, 500 bp, Homo sapiens
gcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgta

SEQ ID NO: 3671 - DNA, 36 bp, Homo sapiens
aaaatgaaaaagaaacagcagtatccacagaagacg

SEQ ID NO: 3672 - DNA, 36 bp, Homo sapiens
tcagatgtgattcatctagatggtgccatgacaatg

SEQ ID NO: 3673 - DNA, 500 bp, Homo sapiens
tcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtgg

SEQ ID NO: 3674 - DNA, 500 bp, Homo sapiens
gcttaaactctaaccaggctttggcaaacccagtttcaacacacaccattttaactcccaattccagcctcctgtctacttctcacgggacaagaatgccatcattatctacagcagttcagaatatggggatgtatggaaatctgccttgtaatcaacctaacacatacagtgtcacttcaggaatgaatcaattgacccaacagagaaacccaaagcaattgttagcaaatcaaaacaaccctatgatgccacggccacctaccttagggccaagtaataataacaatgtagccacttttggagctggatctgttggtaattcacaacaattgagaccaaatttaacccatagtatggcaagcatgccaccacagagaacatcaaacgtaatgatcacatccaacacaactgcaccaaactgggcctctcaagaaggaacaagcaaacagcaagaagccctgacgtctgcaggagtccgcttccccacaggtacacct

SEQ ID NO: 3675 - DNA, 500 bp, Homo sapiens
cccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctc

SEQ ID NO: 3676 - DNA, 117 bp, Homo sapiens; identical to SEQ ID NO: 3560

SEQ ID NO: 3677 - DNA, 36 bp, Homo sapiens
ccaagagctgggattgaaggatcaagaggacagtga

SEQ ID NO: 3678 - DNA, 36 bp, Homo sapiens
ctcacagtccttaccagcagagcaccttagacagtc

SEQ ID NO: 3679 - DNA, 500 bp, Homo sapiens
gcccgtgagaaaaatggagtgtatatttctgaagaaaattttagagtcatgagtggaaaattaactgttcaagaagagcagattgtagaattgattgaaaaaattggtgctgttgaggaggagctgaatagggttacagagttgtttatggataataaaaatgaacttgaccagtgtaaatctgacctgcaaaataaaacacaagaacttgaaaccactcaaaaacatttgcaagaaactaaattacaacttgttaaagaagaatatatcacatcagctttggaaagtactgaggagaaacttcatgatgctgccagcaagctgcttaacacagttgaagaaactacaaaagatgtatctggtctccattccaaactggatcgtaagaaggcagttgaccaacacaatgcagaagctcaggatatttttggcaaaaacctgaatagtctgtttaataatatggaagaattaattaaggatggcagctcaaagcaaaaggc

SEQ ID NO: 3680 - DNA, 404 bp, Homo sapiens
cccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactg

SEQ ID NO: 3681 - DNA, 500 bp, Homo sapiens
tcaaacatctccacaatggtgcaaggatcacagtgcagatgccacctacaatcgagggccactgggtctccacaggctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaac

SEQ ID NO: 3682 - DNA, 88 bp, Homo sapiens
agaaccggtgaccacccgtcaggtgcgtaccattgtggaagaggtccaggatggcaaggtcatctcctcccgcgagcaggtccaccag

SEQ ID NO: 3683 - DNA, 36 bp, Homo sapiens
ccagcactggggctgcaggtaggccacctgttgaga

SEQ ID NO: 3684 - DNA, 130 bp, Homo sapiens
agttggtgttggagctggagcctacatcctggcgagatatgctcttaaccacccggacactgttgaaggtcttgtcctcatcaacattgatcccaatgccaagggttggatggattgggcagcccacaag

SEQ ID NO: 3685 - DNA, 31 bp, Homo sapiens
gccatggtgagatcagtggcgcgtcaagtat

SEQ ID NO: 3686 - DNA, 36 bp, Homo sapiens
gtcccctgagaaggccaagtccccagagaaggaaga

SEQ ID NO: 3687 - DNA, 99 bp, Homo sapiens
cctgccaggtggagcatgacgggcagccagcggtcagcaaaagccatgacctgaaggtctcagcccacccgaaggagcagggctcaaataccgccgctg

SEQ ID NO: 3688 - DNA, 36 bp, Homo sapiens; identical to SEQ ID NO: 3645

SEQ ID NO: 3689 - DNA, 379 bp, Homo sapiens
gctctgggtccagccccttacttaaagatctggaaagcatgaagactgggccttttttcctatgtctcttgggaactgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgc

SEQ ID NO: 3690 - DNA, 239 bp, Homo sapiens; identical to SEQ ID NO: 3487

SEQ ID NO: 3691 - DNA, 34 bp, Homo sapiens
aaatagcctgcaaatctccaccaccagaatcagt

SEQ ID NO: 3692 - DNA, 36 bp, Homo sapiens
atcaatgtcaactgacagatggagtggatgttgaag

SEQ ID NO: 3693 - DNA, 28 bp, Homo sapiens
gcctgaagaataacagcatccctgacaa

SEQ ID NO: 3694 - DNA, 36 bp, Homo sapiens
aaaatgatccttgcagggccaaaggaaggacaaaca

SEQ ID NO: 3695 - DNA, 47 bp, Homo sapiens
gacaactcccgggtcatcctggagatcgacaatgccaggctggctgc

SEQ ID NO: 3696 - DNA, 130 bp, Homo sapiens; identical to SEQ ID NO: 3462

SEQ ID NO: 3697 - DNA, 25 bp, Homo sapiens
gagaccaagcacctcatgaagatgc

SEQ ID NO: 3698 - DNA, 500 bp, Homo sapiens
agaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggggtgacaggaacacaggcttgagcagggacaaggataaaaagagagaggagatgaaggaggtggccaagaaagaggatgatgagaaggtaaaaggggagcgtaggaacacagacaccagaaaagagggtgagaagatgaaaagagcaggtgggaacacagacatgaaaaaggaggatgagaaggtaaaaagaggaactgggaacacagacaccaaaaaggacgatgaaaaagtcaagaagaatgaacccttacatgaaaaggaagccaaggatgacagcaagaccaaaacacccgagaaacagacgcccagt

SEQ ID NO: 3699 - DNA, 181 bp, Homo sapiens
ctgggccttttttcctatgtctcttgggaactgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaagacga

SEQ ID NO: 3700 - DNA, 500 bp, Homo sapiens
agttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagt

SEQ ID NO: 3701 - DNA, 273 bp, Homo sapiens
atgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaag

SEQ ID NO: 3702 - DNA, 500 bp, Homo sapiens
gtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggtcttcacactcaaggccacggtcctaaactac

SEQ ID NO: 3703 - DNA, 399 bp, Homo sapiens
agactggcaatggaggaaacattcctgaagccatttcagagtctgatatttcttgttcgagactggagtttcccatacgaattttcatatggagccgatggtggtgccaaattcttggaaaaacgcctcaaggtctcagggaaccagcatgaagaactacagaacgtcagaaaacacatccattcctgtttcaccaacatttcctgttttctgctacctcatcctggcttaaaagtagctaccaatccaaactttgatggaaaattgaaagaaatagatgatgaattcatcaaaaacttgaaaatactgattccttggctacttagtcccgagagcctagatattaaagagatcaatgggaataaaatcacctgccggggtctggtggagtacttcaag

SEQ ID NO: 3704 - DNA, 56 bp, Homo sapiens
atggtgccatgacaatggtgtgaactacaagattggagagaagtgggaccgtcagg

SEQ ID NO: 3705 - DNA, 481 bp, Homo sapiens; identical to SEQ ID NO: 3326

SEQ ID NO: 3706 - DNA, 36 bp, Homo sapiens
aggcgggcccgggaacaggctgaggctgaggtggcc

SEQ ID NO: 3707 - DNA, 499 bp, Homo sapiens
tgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcag

SEQ ID NO: 3708 - DNA, 36 bp, Homo sapiens
agccacggagagcagcaacaaaaacaaaattcacaa

SEQ ID NO: 3709 - DNA, 500 bp, Homo sapiens
ccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgc

SEQ ID NO: 3710 - DNA, 234 bp, Homo sapiens
ggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctct

SEQ ID NO: 3711 - DNA, 500 bp, Homo sapiens
gatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaactaaaaagaagtgaaggcaacatgtatcgtctggcagaactaaatcttggagtggggtgagggatgaaagactacatattgggtacagtgtacactgctcgggtgatgggtgcgctaaagt

SEQ ID NO: 3712 - DNA, 500 bp, Homo sapiens
gggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggaga

SEQ ID NO: 3713 - DNA, 36 bp, Homo sapiens; identical to SEQ ID NO: 3706

SEQ ID NO: 3714 - DNA, 36 bp, Homo sapiens
ggacgacttcaggctcaagtatgagaatgagctggc

SEQ ID NO: 3715 - DNA, 427 bp, Homo sapiens
ggccctgaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgcc

SEQ ID NO: 3716 - DNA, 36 bp, Homo sapiens
ggatgtgtctacctccagacatccttgaaatacaat

SEQ ID NO: 3717 - DNA, 393 bp, Homo sapiens
gtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccc

SEQ ID NO: 3718 - DNA, 500 bp, Homo sapiens
ccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggacctt

SEQ ID NO: 3719 - DNA, 36 bp, Homo sapiens; identical to SEQ ID NO: 3608

SEQ ID NO: 3720 - DNA, 36 bp, Homo sapiens
cgagggccaggatgccaagatggctggcattggcat

SEQ ID NO: 3721 - DNA, 43 bp, Homo sapiens
agttggtgttggagctggagcctacatcctggcgagatatgct

SEQ ID NO: 3722 - DNA, 36 bp, Homo sapiens
caggaaaatgcaaagctggtatgagcaatcctgcat

SEQ ID NO: 3723 - DNA, 126 bp, Homo sapiens; identical to SEQ ID NO: 3491

SEQ ID NO: 3724 - DNA, 500 bp, Homo sapiens
aacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtt

SEQ ID NO: 3725 - DNA, 25 bp, Homo sapiens
tctgtggagacaccatacggctctg

SEQ ID NO: 3726 - DNA, 90 bp, Homo sapiens
aggaggaagaagaagaggaagaggaggaggaggatgacgatgatgacaaaggagatggcttcgtggaaggtttgggcacccatgccgaag

SEQ ID NO: 3727 - DNA, 36 bp, Homo sapiens; identical to SEQ ID NO: 3706

SEQ ID NO: 3728 - DNA, 313 bp, Homo sapiens; identical to SEQ ID NO: 3394

SEQ ID NO: 3729 - DNA, 130 bp, Homo sapiens; identical to SEQ ID NO: 3462

SEQ ID NO: 3730 - DNA, 500 bp, Homo sapiens
caccatgaccaccaccatccaccagttcacctcctccagctccatcaagggctcctccggcctgggagtggctcatcccgcacctcctgccggctgtctggcggcctgggtgccggctcctgcaggctgggatctgctggtggcctgggcagtgccctccggggtagcagctattccagctgctactgctttggctctggcggtggctatggcagcagctttgggggcgttgatgggctgctggccggaggtgagaaggccaccatgcagaacctcaatgaccgcctggcctcctacctggacaagatgcgcgccctggaggaggccaacactgagctggaggtgaagatccgtgactggtaccagaggcaggccccggggcccgcccgtgactacagccagtactacaggacaatcgaggagctgcagaacaagatcctcacagccaccttgaacaatgccaacatcctgctacagattgacaatgcccatctggctgc

SEQ ID NO: 3731 - DNA, 36 bp, Homo sapiens
ttgctttctcttgctaagggtgaccgatctgaggac

SEQ ID NO: 3732 - DNA, 413 bp, Homo sapiens
cagcgatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttagggaggaaaagctgaactccttaaaactaaag

SEQ ID NO: 3733 - DNA, 48 bp, Homo sapiens
ttaaaaagaaagagtccatcagatttgtggaaagaagacttggctaca

SEQ ID NO: 3734 - DNA, 500 bp, Homo sapiens
agtgggtggctatggcagccggagcctctacaacctggggggctccaagaggatatccatcagcactagaggaggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtaca

SEQ ID NO: 3735 - DNA, 420 bp, Homo sapiens
agtagacttgaatgtgcctctgggcaaagaagcagagctaacgaggaaagggatttaaagagtttttcttgggtgtttgtcaaacttttattccctgtctgtgtgcagaggggattcaacttcaattttctgcagtggctctgggtccagccccttacttaaagatctggaaagcatgaagactgggccttttttcctatgtctcttgggaactgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaagacgattcccaccataaggctgaaaaatcatcagtactaaagtcaaaagaggaaagccatga

SEQ ID NO: 3736 - DNA, 36 bp, Homo sapiens
ttgtgaagcaggaagacatgaagggccatttttcca

SEQ ID NO: 3737 - DNA, 500 bp, Homo sapiens
aaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccc

SEQ ID NO: 3738 - DNA, 43 bp, Homo sapiens
gtatgaggatgaaatcaacaagcgtaccactgctgagaatgag

SEQ ID NO: 3739 - DNA, 196 bp, Homo sapiens
agtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgcca

SEQ ID NO: 3740 - DNA, 36 bp, Homo sapiens
tatctgatcattccaaaccaactgctgaaacggtag

SEQ ID NO: 3741 - DNA, 36 bp, Homo sapiens
gctgtggaccaagtgaaggtgatcatggatgctctg

SEQ ID NO: 3742 - DNA, 478 bp, Homo sapiens
agagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctg

SEQ ID NO: 3743 - DNA, 36 bp, Homo sapiens
ggggcggcgttggtggtctccgcggcggcgacgagg

SEQ ID NO: 3744 - DNA, 102 bp, Homo sapiens
atgctgctgggacttcctatgtggtcggagaaacgtgggagaagccctaccaaggctggatgatggtagattgtacttgcctgggagaaggcagcggacgca

SEQ ID NO: 3745 - DNA, 171 bp, Homo sapiens; identical to SEQ ID NO: 3657

SEQ ID NO: 3746 - DNA, 54 bp, Homo sapiens
ccatacggctctgtcactttcactgtctatggcacccccaaacccaaacgccca

SEQ ID NO: 3747 - DNA, 501 bp, Homo sapiens
gcaccgccgttcacgaaagccatgcaaagaatgcttctttttatgccaactcttcaactctgtattaccaaatagatagccacattccaggaactccaaatcagatctctgagaactattctgaaagagacactgtcaaaaatggtaccctttcgctggtgccttacaccatgaccccggagcaattcgttgactatgcccgacaagcagaagaggcctatggtgcctcccactacccagctgccaacccctctgtaatcgtttgctgctcctcttccgaaaatgatagcggtgtgccctgcaatagtttatatcctgaacacaggtccaatcaccctcaagtggaatttcactcatacttgaaaggcccctcccaagaagggtttgtctctgcattgaatggtgacagtcacatttcagagcatcctgctgaaaattctttgagccttgcagaaaagagcatattgcatgaagagtgcatcaaatcacccgtggttgaga

SEQ ID NO: 3748 - DNA, 36 bp, Homo sapiens
tcaggcccaattttggtggagaacccgtacagatag

SEQ ID NO: 3749 - DNA, 500 bp, Homo sapiens
caacttcaattttctgcagtggctctgggtccagccccttacttaaagatctggaaagcatgaagactgggccttttttcctatgtctcttgggaactgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgattgagcctcaggagaaaaaactctcagagaacactgattttttggctcctggtgttagttcc

SEQ ID NO: 3750 - DNA, 36 bp, Homo sapiens; identical to SEQ ID NO: 3293

SEQ ID NO: 3751 - DNA, 30 bp, Homo sapiens
ctggaccccacccagacctcgttcctcaag

SEQ ID NO: 3752 - DNA, 43 bp, Homo sapiens
aggcctaagggatcaaggaaaccaagagcaggatccaaatatt

SEQ ID NO: 3753 - DNA, 222 bp, Homo sapiens
cagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacatgctggttatctaaat

SEQ ID NO: 3754 - DNA, 255 bp, Homo sapiens
ccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgagccctcggggcagggattcaaagttagtgaggtctatgtccagagaagctgagatatggcatataataggcatctaataaatgcttaagaggtgg

SEQ ID NO: 3755 - DNA, 104 bp, Homo sapiens
tcaccaccatcgaggcggtgaagcgcaagatccaggttctgcagcagcaggcagatgatgcagaggagcgagctgagcgcctccagcgagaagttgagggagaa

SEQ ID NO: 3756 - DNA, 36 bp, Homo sapiens
ctcatggaacctactgatgatggtaataccacgccc

SEQ ID NO: 3757 - DNA, 499 bp, Homo sapiens
gacagtctgaaatactctctggtgccaacctccaaattctcgtctgtcacttcagacccccactagttgacagagcagcagaatatcaactccagtagacttgaatgtgcctctgggcaaagaagcagagctaacgaggaaagggatttaaagagtttttcttgggtgtttgtcaaacttttattccctgtctgtgtgcagaggggattcaacttcaattttctgcagtggctctgggtccagccccttacttaaagatctggaaagcatgaagactgggccttttttcctatgtctcttgggaactgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaagacgattcccaccataaggctgaaaaatcatcagtactaaagtcaaaa

SEQ ID NO: 3758 - DNA, 163 bp, Homo sapiens
gtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggca

SEQ ID NO: 3759 - DNA, 500 bp, Homo sapiens
tgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgagga

SEQ ID NO: 3760 - DNA, 78 bp, Homo sapiens
tctttcagtgtgtgaatgggaaatacatttctcagatgaaagcctgtgatggtatcaatgattgtggagaccaaagtg

SEQ ID NO: 3761 - DNA, 36 bp, Homo sapiens
caccaggatcaagctcatcgactttggtctggccag

SEQ ID NO: 3762 - DNA, 345 bp, Homo sapiens
tggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacct

SEQ ID NO: 3763 - DNA, 500 bp, Homo sapiens
gagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttg

SEQ ID NO: 3764 - DNA, 500 bp, Homo sapiens
atcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatct

SEQ ID NO: 3765 - DNA, 36 bp, Homo sapiens
gtcccctgagaaggccaagtcccctgagaaggccaa

SEQ ID NO: 3766 - DNA, 500 bp, Homo sapiens
cattctgaatcattctaagcctctggagagactgtaatgatccattcatgagctggtatgaaatcagtgggaagcagaacaacagaaggaactttaaaagcaacaagcaattatgtaccatatatacactgtagcaaatattttatatttgagagtctttacagcttacatttccattccattattacaagtgatgaaaaacaaaaaattgcaagtagtatgcaaattataaatatacagtcttcccacttcactaaccaaattcctactttccagtgttacttcccaatttatgcaggaaacctcctgcaaagctgaaactgattagaaaattctttatattttaaaatagctctttctcatttttagagaagtcaaatagccaaccatcaaaattaagaataaattgaattgtcacagtccattacagttattgttgctagatccacctcatttgcagatgtccaaacttaaattcatctgttcttaaaatgctactt

SEQ ID NO: 3767 - DNA, 500 bp, Homo sapiens
atctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtgtagttgtgtatgttttttta

SEQ ID NO: 3768 - DNA, 441 bp, Homo sapiens
gagacttcagcaaaaggcttgatagagaaggtaacaactgaactatccacatccatctaccagctaatcaatgtctactgtaacagcttttatgcagattttcagcctgtaaatgtacctagatgcacttcctatctaaatcccgggcttccttcccacctcagcttcacagtgtatgcagcacacaacattccagaaacctgggtgcacaggatcaattttccccttgaaataaagtcacttccaagggaatccatgctcactgtaaaactgtttgggattgcctgtgcaaccaacaatgcaaatttactggcgtggacttgtcttccactgtttccaaaagaaaaatccattctcgggtctatgctgttcagcatgacattacagagtgagcctcccgtagaaatgataactccaggagtgtgggatgtaagtcagcca

SEQ ID NO: 3769 - DNA, 36 bp, Homo sapiens; identical to SEQ ID NO: 3714

SEQ ID NO: 3770 - DNA, 214 bp, Homo sapiens
tctgatcattccaaaccaactgctgaaacggtagcacctgacaacactgcaatccccagtttatgggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgg

SEQ ID NO: 3771 - DNA, 36 bp, Homo sapiens; identical to SEQ ID NO: 3692

SEQ ID NO: 3772 - DNA, 479 bp, Homo sapiens
atatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaat

SEQ ID NO: 3773 - DNA, 363 bp, Homo sapiens
aataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattct

SEQ ID NO: 3774 - DNA, 500 bp, Homo sapiens
ccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaa

SEQ ID NO: 3775 - DNA, 141 bp, Homo sapiens
gagtgcttcatgcctttagatgtacaggctgacagagaagattcccgagagtaaatcatctttccaatccagaggaacaagcatgtctctctgccaagatccatctaaactggagtgatgttagcagacccagcttagagt

SEQ ID NO: 3776 - DNA, 36 bp, Homo sapiens
aaaaactagaatctgaagaagatgtgtcccaagctt

SEQ ID NO: 3777 - DNA, 254 bp, Homo sapiens
gtgagagagatacaaaggttattgaaatctgggccttaaaagatgaagaagatggaactccaggaaatccaactcaaagaagctaagcacattgcagatgaggcagatgggaagtatgaagaggtggcttgtaagttggtgatcattgaaggagacatgggatgcacagaggaacgagctgagctggcagagtcccgttgctgagagatggatgagcagatcagactgatggaccagaacctgaagtgtctgag

SEQ ID NO: 3778 - DNA, 36 bp, Homo sapiens
gagtcaagtcaattccaggcttgctaagactggaga

SEQ ID NO: 3779 - DNA, 248 bp, Homo sapiens
tcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaa

SEQ ID NO: 3780 - DNA, 469 bp, Homo sapiens
ctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagc

SEQ ID NO: 3781 - DNA, 292 bp, Homo sapiens
atgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcag

SEQ ID NO: 3782 - DNA, 422 bp, Homo sapiens
gccgccagacctacacgcgctaccagacgctggagctggagaaggagttccacttcaaccgctacctgacgcggcgccgccgcattgaaatcgcccacgcgctctgcctcaccgagcgccagattaagatctggttccagaaccgccgcatgaagtggaagaaagagcataaggacgaaggtccgactgccgccgcagctcccgagggcgccgtgccctctgccgccgccactgctgccgcggacaaggccgacgaggaggacgatgatgaagaagaggaagacgaggaggaatgaggggccgatccggggccctctctgcaccggacagtcggaaaagcgtctttaagagactcactggttttacttacaaaaatgggaaaaataaaagaaaatgtaaaaaacaaaaacaaaaacaaaaaa

SEQ ID NO: 3783 - DNA, 193 bp, Homo sapiens
gcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggct

SEQ ID NO: 3784 - DNA, 36 bp, Homo sapiens
atgattactacgagacggatgagtttgcaattgctg

SEQ ID NO: 3785 - DNA, 500 bp, Homo sapiens
ggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacggcctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccaggg

SEQ ID NO: 3786 - DNA, 138 bp, Homo sapiens
cctgtaaatgaaaatatgcaagtcaacaaaataaagaaaaatgaagatgctaagaaaagactgtctgttgaaagaatctatcaaaagaaaacacaattggaacatattttgctccgcccagacacctacattggttct

SEQ ID NO: 3787 - DNA, 474 bp, Homo sapiens
gtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaa

SEQ ID NO: 3788 - DNA, 66 bp, Homo sapiens; identical to SEQ ID NO: 3488

SEQ ID NO: 3789 - DNA, 36 bp, Homo sapiens; identical to SEQ ID NO: 3631

SEQ ID NO: 3790 - DNA, 45 bp, Homo sapiens
tcagccctggccaagctttgaggctctgtcactgagcaatggtaa

SEQ ID NO: 3791 - DNA, 36 bp, Homo sapiens; identical to SEQ ID NO: 3706

SEQ ID NO: 3792 - DNA, 452 bp, Homo sapiens
gtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatat

SEQ ID NO: 3793 - DNA, 36 bp, Homo sapiens
tacctattgaaaacccaggaaaacgtgtataatatt

SEQ ID NO: 3794 - DNA, 68 bp, Homo sapiens
ctttccgtagaccttaaaatctcagaggtagggctgccaccaaggtgaagatgggaacgcagatgatc

SEQ ID NO: 3795 - DNA, 500 bp, Homo sapiens
ggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcga

SEQ ID NO: 3796 - DNA, 129 bp, Homo sapiens
agttggtgttggagctggagcctacatcctggcgagatatgctcttaaccacccggacactgttgaaggtcttgtcctcatcaacattgatcccaatgccaagggttggatggattgggcagcccacaa

SEQ ID NO: 3797 - DNA, 36 bp, Homo sapiens
attcaacaaaaccttcaggaagccctttggaagaaa

SEQ ID NO: 3798 - DNA, 500 bp, Homo sapiens
ctaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgattgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatc

SEQ ID NO: 3799 - DNA, 36 bp, Homo sapiens
cagatccaggggctgattggcagcgtggaggagcag

SEQ ID NO: 3800 - DNA, 36 bp, Homo sapiens
tgaggacctcatcaacagtttgcaggacatggtgac

SEQ ID NO: 3801 - DNA, 36 bp, Homo sapiens
gaaacaggctgagttttgggaaaaccctgggtgctg

SEQ ID NO: 3802 - DNA, 29 bp, Homo sapiens
ggacaaaaagacagctacgtgggtgacga

SEQ ID NO: 3803 - DNA, 164 bp, Homo sapiens
ctgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaagacgattcccaccataag

SEQ ID NO: 3804 - DNA, 406 bp, Homo sapiens
agaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaacccc

SEQ ID NO: 3805 - DNA, 60 bp, Homo sapiens
attgagaccaagatgcacgtccgcttccttaacatggaaaccatggccctctgccactga

SEQ ID NO: 3806 - DNA, 391 bp, Homo sapiens
ttgacttttttgtcttacattatatttttatagattttgttataaacatggtgctgggaaaggtgaagagtttgacaataagctttgactgtcttaatgacagcaatgtccctgtgtattctagtggggataccgtctcaggaagggtaaatttagaagttactggggaaatcagagtaaaatctcttaaaattcatgcaagaggacatgcgaaagtacgctggactgaatctagaaacgccggctccaatactgcctatacacagaattacactgaagaagtagagtatttcaaccataaagacatcttaattgggcacgaaagagatgatgataattccgaagaaggcttccacactattcattcaggaaggcatgaatatgcattcag

SEQ ID NO: 3807 - DNA, 332 bp, Homo sapiens
aggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcat

SEQ ID NO: 3808 - DNA, 36 bp, Homo sapiens
cactgtgtcgccttcgctgtcccaaagtcttcatcc

SEQ ID NO: 3809 - DNA, 319 bp, Homo sapiens
ggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgct

SEQ ID NO: 3810 - DNA, 63 bp, Homo sapiens; identical to SEQ ID NO: 3454

SEQ ID NO: 3811 - DNA, 36 bp, Homo sapiens
caaaagttgctacggcagctggaaatgcagaaatca

SEQ ID NO: 3812 - DNA, 36 bp, Homo sapiens
acatagccaaggcctaagggatcaaggaaaccaaga

SEQ ID NO: 3813 - DNA, 182 bp, Homo sapiens
ctttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgatttta

SEQ ID NO: 3814 - DNA, 134 bp, Homo sapiens
cgctgactctggacattgcaagtatctctagcatttcagagagtaacatggactacacagccaccatatacctccgacagcgctggatggaccagcggctggtgtttgaaggcaacaagagcttcactctggat

SEQ ID NO: 3815 - DNA, 402 bp, Homo sapiens
tacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatat

SEQ ID NO: 3816 - DNA, 196 bp, Homo sapiens
ccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtg

SEQ ID NO: 3817 - DNA, 500 bp, Homo sapiens; identical to SEQ ID NO: 3774

SEQ ID NO: 3818 - DNA, 350 bp, Homo sapiens
aggtatagcagatttgggtgaaatgatcctccttctgcccgtatgtccacctgaggaaaaagatgccaagcttgccttgatcaaagagaaaataaaaaatcgctacttccctgcctttgaaaaagtcttaaagagccatggacaagactaccttgttggcaacaagctgagccgggctgacattcatctggtggaacttctctactacgtcgaggagcttgactccagtcttatctccagcttccctctgctgaaggccctgaaaaccagaatcagcaacctgcccacagtgaagaagtttctacagcctggcagcccaaggaagcctcccatggatgagaaatctttag

SEQ ID NO: 3819 - DNA, 36 bp, Homo sapiens
accctcggaaggaatttgcatcttcttcaaccagag

SEQ ID NO: 3820 - DNA, 500 bp, Homo sapiens
gcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatt

SEQ ID NO: 3821 - DNA, 36 bp, Homo sapiens
tgagggtgcatgctgtggattcttgcatgagcttcc

SEQ ID NO: 3822 - DNA, 210 bp, Homo sapiens
atcctgggctcccagctggagaggcggaggcagctccagggggctggaagtggaagcgcagcggcagaaggagagggagagagaaagagagagaggctaattaaaaaaggatactccgagggaagagagcaagggcggtgcgccgccaaggaccaactagcggcggagcttcgatcttgcctaggcgcggagagctcccaacctgggctg

SEQ ID NO: 3823 - DNA, 72 bp, Homo sapiens
cgccatcgtcttcaatgcttctctgaacagcctttaggaagagtgcgagagaaagagagagagcgcgcgcca

SEQ ID NO: 3824 - DNA, 36 bp, Homo sapiens
catctctggtaggcgcaggtgtgatgctgctcctga

SEQ ID NO: 3825 - DNA, 476 bp, Homo sapiens
ctgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgct

SEQ ID NO: 3826 - DNA, 42 bp, Homo sapiens
gtgagtgtctatgctcttaaggacactttgacaagcagacca

SEQ ID NO: 3827 - DNA, 489 bp, Homo sapiens
cagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccatgacacgagttttgcaaaaacatttgttggcacaccttattacatgtctcct

SEQ ID NO: 3828 - DNA, 176 bp, Homo sapiens
tttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttag

SEQ ID NO: 3829 - DNA, 61 bp, Homo sapiens
aataagccagccttcctcaagaatgccagacagtggacagagaagcatgcaagacagaaac

SEQ ID NO: 3830 - DNA, 29 bp, Homo sapiens
acccgatagaacatggcatcatcaccaac

SEQ ID NO: 3831 - DNA, 25 bp, Homo sapiens
cctgatccatgggctaagaatctga

SEQ ID NO: 3832 - DNA, 257 bp, Homo sapiens
gacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccgacatcaacggcctgcgccgggtgctgga

SEQ ID NO: 3833 - DNA, 211 bp, Homo sapiens
ctcatcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggtcttcacactcaaggccacggtcctaaactac

SEQ ID NO: 3834 - DNA, 36 bp, Homo sapiens
gaggaaagccatgaacagtcagcagaacagggcaag

SEQ ID NO: 3835 - DNA, 58 bp, Homo sapiens
tccctgaaccgccgcattcagctggttgaggaggagctggaccgggcccaggagcgcc

SEQ ID NO: 3836 - DNA, 331 bp, Homo sapiens
agcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggctt

SEQ ID NO: 3837 - DNA, 263 bp, Homo sapiens
aatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaac

SEQ ID NO: 3838 - DNA, 500 bp, Homo sapiens; identical to SEQ ID NO: 3634

SEQ ID NO: 3839 - DNA, 76 bp, Homo sapiens
acatcccagttaccagtgtccttgaattgatagtggcttctgtttgtcagtctcatataagaactacagctcatca

SEQ ID NO: 3840 - DNA, 196 bp, Homo sapiens; identical to SEQ ID NO: 3816

SEQ ID NO: 3841 - DNA, 153 bp, Homo sapiens
caatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcata

SEQ ID NO: 3842 - DNA, 162 bp, Homo sapiens
accccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagatta

SEQ ID NO: 3843 - DNA, 158 bp, Homo sapiens; identical to SEQ ID NO: 3389

SEQ ID NO: 3844 - DNA, 255 bp, Homo sapiens; identical to SEQ ID NO: 3754

SEQ ID NO: 3845 - DNA, 36 bp, Homo sapiens
tttagaacacacatccttcagcagctgagaaatgaa

SEQ ID NO: 3846 - DNA, 36 bp, Homo sapiens
gagctgatgaccctcatgatgtctggcgataaaggg

SEQ ID NO: 3847 - DNA, 500 bp, Homo sapiens
tcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggat

SEQ ID NO: 3848 - DNA, 152 bp, Homo sapiens; identical to SEQ ID NO: 3520

SEQ ID NO: 3849 - DNA, 369 bp, Homo sapiens
ataggattaacaacttggaaaaggcctatgatactcctggtaaacctctttgtgctgctctctgtggtttgtgtcctcttaaatctagctggatttatcctaggctgccaaggggcccagtttgtgtccagcgtgcccaggtgtgatctggtggacttaggtgaaggcaagatttgcttctgttgtgaagaatttcaaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgca

SEQ ID NO: 3850 - DNA, 36 bp, Homo sapiens
catcgacaaggtgcgcttcctggagcagcagaataa

SEQ ID NO: 3851 - DNA, 36 bp, Homo sapiens
attttggagcctgcaaatctattcctacttgtacgg

SEQ ID NO: 3852 - DNA, 86 bp, Homo sapiens
cagcccaacttcttacccgaaagcatcactgccttggcccctccctcccggctgcccccatcacctctactgtctcctccctgggc

SEQ ID NO: 3853 - DNA, 500 bp, Homo sapiens; identical to SEQ ID NO: 3627

SEQ ID NO: 3854 - DNA, 51 bp, Homo sapiens
caaaatgaagcagtgtgtgaggggctgcgtactcaaatccgagagctctgg

SEQ ID NO: 3855 - DNA, 78 bp, Homo sapiens
ctcaccaaccttattaagaggaacacagaactggagacccttttggctaaactcatccaaacctgtcaacatgttgaa

SEQ ID NO: 3856 - DNA, 36 bp, Homo sapiens
tccgtgactggtaccagaggcagcggcccagtgaga

SEQ ID NO: 3857 - DNA, 148 bp, Homo sapiens
atcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaaca

SEQ ID NO: 3858 - DNA, 500 bp, Homo sapiens
agagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggtcagtgtgcagctgaaagcctctccagccttcctagcttcccaaaatacaaagggagaagaatcctattgtatctgtggaagtgagagacaaaccttgtcttggacagtgactcctaaaactctggggaatgtgaac

SEQ ID NO: 3859 - DNA, 488 bp, Homo sapiens
tactgattttgagaatttaaagcagattaccttttaaaactggaccaactaagtaattggtatttaatcaaagagaaaatggtaataaacttttcaaaatctttgttaaaccaaacattcaacacaaaataaactagaaggccagaggataatggaataaaagatcattgcaattacttatccttcctaaaaatatagttttatattaattgtgcttatggaagaaacaatgtcagccaagtccattttatagtttgagtgcaattctttgaacaatagaaatatctgcagtctttcacagatttgtattatgctgaagagtttcatctgacaatctgcttcaagaaatctcagaaaatatgataacattttaactttcgttttagagcacgttttggtcatttttaaaaatacctaaagtgccagaccggaacctatagctactgctagaagtcttaaaaaaaccaacagcagcacaggatgtatta

SEQ ID NO: 3860 - DNA, 108 bp, Homo sapiens
cgccgatcccaggtgcgtgtgtctctgtctctcctagcccctctctcacacatcacattcccatggtggcctcaagaaaggcccggaagccccaggctggagataaca

SEQ ID NO: 3861 - DNA, 99 bp, Homo sapiens
actttgaagtgattcagtttcctctacggatgagagactggctcaagaatatcctcatgcagctttatgaagccaactctgaacatgctggttatctaa

SEQ ID NO: 3862 - DNA, 491 bp, Homo sapiens
ataggattaacaacttggaaaaggcctatgatactcctggtaaacctctttgtgctgctctctgtggtttgtgtcctcttaaatctagctggatttatcctaggctgccaaggggcccagtttgtgtccagcgtgcccaggtgtgatctggtggacttaggtgaaggcaagatttgcttctgttgtgaagaatttcaaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgtt

SEQ ID NO: 3863 - DNA, 25 bp, Homo sapiens
agagttagatttttgcacattaaaa

SEQ ID NO: 3864 - DNA, 242 bp, Homo sapiens
gtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatag

SEQ ID NO: 3865 - DNA, 31 bp, Homo sapiens
ggcacccttaaaacttccactacctttaaaa

SEQ ID NO: 3866 - DNA, 223 bp, Homo sapiens
atgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaa

SEQ ID NO: 3867 - DNA, 36 bp, Homo sapiens
ggctgaggtggccgagagccgagccagacagctgga

SEQ ID NO: 3868 - DNA, 317 bp, Homo sapiens
cagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatgg

SEQ ID NO: 3869 - DNA, 311 bp, Homo sapiens
cctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaa

SEQ ID NO: 3870 - DNA, 181 bp, Homo sapiens
aaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgt

SEQ ID NO: 3871 - DNA, 229 bp, Homo sapiens
ccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtct

SEQ ID NO: 3872 - DNA, 500 bp, Homo sapiens
gatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgt

SEQ ID NO: 3873 - DNA, 36 bp, Homo sapiens
ccagacactcccttctcccaccttagttggttacag

SEQ ID NO: 3874 - DNA, 36 bp, Homo sapiens
gtcattggtggtggcttgattgtatcccaaggtatt

SEQ ID NO: 3875 - DNA, 36 bp, Homo sapiens
gaaaagtattctgaatccgtgaaggaggcccaggag

SEQ ID NO: 3876 - DNA, 500 bp, Homo sapiens
gctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttgg

SEQ ID NO: 3877 - DNA, 257 bp, Homo sapiens
tctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgct

SEQ ID NO: 3878 - DNA, 36 bp, Homo sapiens
atgctccttgcagcaaagatcttggaaatgcttgaa

SEQ ID NO: 3879 - DNA, 358 bp, Homo sapiens
gctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggttatgtacttattattttagctctttctgtaatatttacattttttaccatatgtacatttgtacttttattttacacataagggaaaaaataagaccactttg

SEQ ID NO: 3880 - DNA, 36 bp, Homo sapiens
gatcaccccgaggtgaaggtgggtgtctctgggcct

SEQ ID NO: 3881 - DNA, 36 bp, Homo sapiens
ggaaccacatggagaacggtggtgaccatcgctatg

SEQ ID NO: 3882 - DNA, 469 bp, Homo sapiens
ccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaac

SEQ ID NO: 3883 - DNA, 77 bp, Homo sapiens
tcctgcaaagccattgagagagtcccagagccaccttcttactgattctcagtcttggacggagagcagcataaacc

SEQ ID NO: 3884 - DNA, 500 bp, Homo sapiens
acaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaag

SEQ ID NO: 3885 - DNA, 36 bp, Homo sapiens
gcacaacagctcaagcaggaacgtcaaaaagaacta

SEQ ID NO: 3886 - DNA, 36 bp, Homo sapiens
atgatgagaaggtaaaaggggagcgtaggaacacag

SEQ ID NO: 3887 - DNA, 25 bp, Homo sapiens
cgcaagtagagggagtgcaggaaac

SEQ ID NO: 3888 - DNA, 36 bp, Homo sapiens; identical to SEQ ID NO: 3426

SEQ ID NO: 3889 - DNA, 500 bp, Homo sapiens; identical to SEQ ID NO: 3566

SEQ ID NO: 3890 - DNA, 36 bp, Homo sapiens
aggctacggagagaactggtgcataaggcaaatcca

SEQ ID NO: 3891 - DNA, 198 bp, Homo sapiens
aaatgttgttctttgctgaattgccacacacaggtggctattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaaca

SEQ ID NO: 3892 - DNA, 500 bp, Homo sapiens; identical to SEQ ID NO: 3876

SEQ ID NO: 3893 - DNA, 307 bp, Homo sapiens
ctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcc

SEQ ID NO: 3894 - DNA, 25 bp, Homo sapiens
tcttgggaacggaaaaggagaattc

SEQ ID NO: 3895 - DNA, 177 bp, Homo sapiens
acaaggcttgaacttctatgccaaagaactaactacatatgaaattgaggaattcaaaaaaacaaaagaagcaattagaagattcctcctggcttataaaatgatgctagaattttttggaataaaactgactgataaaactggaaatgttgctcgggctgttaactggcaggaaag

SEQ ID NO: 3896 - DNA, 500 bp, Homo sapiens; identical to SEQ ID NO: 3820

SEQ ID NO: 3897 - DNA, 70 bp, Homo sapiens
acatgagactggtggttacatgttagagtgtgtgtgtcttggtaatggaaaaggagaatggacctgcaag

SEQ ID NO: 3898 - DNA, 271 bp, Homo sapiens
ccggatcctgcggagtactgtgatggttcgtgttggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccct

SEQ ID NO: 3899 - DNA, 500 bp, Homo sapiens
gacataaaagaagatatgattgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagca

SEQ ID NO: 3900 - DNA, 36 bp, Homo sapiens
ggacctgcaagcccatagctgagaagtgttttgatc

SEQ ID NO: 3901 - DNA, 36 bp, Homo sapiens
atgatatcacatatgcagacctgaacctgcccaagg

SEQ ID NO: 3902 - DNA, 198 bp, Homo sapiens
gcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacct

SEQ ID NO: 3903 - DNA, 36 bp, Homo sapiens
ggctgatgagagcgagagaggaatgaaggtcatcga

SEQ ID NO: 3904 - DNA, 50 bp, Homo sapiens
aacatccagtgtaaaaaggaagttggaatgggagttggcgggcagtgaac

SEQ ID NO: 3905 - DNA, 93 bp, Homo sapiens
atacgcaagtaccagggtctggagataaagtcaagtgaccagcctctgactgtgcctgtatctcccaaattctccactcgattccactgctaa

SEQ ID NO: 3906 - DNA, 36 bp, Homo sapiens
cccgtgtggtaccttcagccctggccaagctttgag

SEQ ID NO: 3907 - DNA, 36 bp, Homo sapiens; identical to SEQ ID NO: 3603

SEQ ID NO: 3908 - DNA, 234 bp, Homo sapiens; identical to SEQ ID NO: 3710

SEQ ID NO: 3909 - DNA, 379 bp, Homo sapiens
atggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaat

SEQ ID NO: 3910 - DNA, 500 bp, Homo sapiens; identical to SEQ ID NO: 3709

SEQ ID NO: 3911 - DNA, 203 bp, Homo sapiens
atcaatgatacttactctgaagtgaaatctgacttggcacagcagaaagctgaaatggaactctcagatcttatcagaaagggctaccataaagctttggtcaaactaaaactgaaaaaaaataccgtggatgacatttcagagagtctgcggcaaggaggaggcaagttaaactttgacgaacttcgacaagatctcaaagg

SEQ ID NO: 3912 - DNA, 354 bp, Homo sapiens
ctgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctg

SEQ ID NO: 3913 - DNA, 25 bp, Homo sapiens
agaacagcctggaggagaccaaagg

SEQ ID NO: 3914 - DNA, 120 bp, Homo sapiens
tggtgaagaaatcagcttctgacctcacctgggacaatctgaaaggcaagaagtcctgccatacggcagttggcagaaccgctggctggaacatccccatgggcctgctctacaataaga

SEQ ID NO: 3915 - DNA, 501 bp, Homo sapiens
aattttctgcagtggctctgggtccagccccttacttaaagatctggaaagcatgaagactgggccttttttcctatgtctcttgggaactgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgattgagcctcaggagaaaaaactctcagagaacactgattttttggctcctggtgttagttccttcacaga

SEQ ID NO: 3916 - DNA, 36 bp, Homo sapiens; identical to SEQ ID NO: 3706

SEQ ID NO: 3917 - DNA, 36 bp, Homo sapiens; identical to SEQ ID NO: 3631

SEQ ID NO: 3918 - DNA, 36 bp, Homo sapiens
ctgcctatggtgtgagagatctgatcccctacaatg

SEQ ID NO: 3919 - DNA, 447 bp, Homo sapiens
aggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaac

SEQ ID NO: 3920 - DNA, 36 bp, Homo sapiens
ctggagctcatggtattggtgatgtggaaacagctg

SEQ ID NO: 3921 - DNA, 113 bp, Homo sapiens
tctacaatccctgatggagaagaatcagtccctggtagaggagaatgaaaaattaagtcgtggtctgagcgaggcagctggtcagacagcccagatgttggagaggatcattt

SEQ ID NO: 3922 - DNA, 326 bp, Homo sapiens
actgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgtttgtactcacggcgataatagcttgatttatttggtttctacaccaaata

SEQ ID NO: 3923 - DNA, 87 bp, Homo sapiens
agttccacaggaaataccggatcccagctgatgtagaccctctcaccattacttcatccctgtcatctgatggggtcctcactgtga

SEQ ID NO: 3924 - DNA, 221 bp, Homo sapiens
cctggaactctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattct

SEQ ID NO: 3925 - DNA, 203 bp, Homo sapiens
gggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacag

SEQ ID NO: 3926 - DNA, 36 bp, Homo sapiens
gaggcattaaaattcactgtgcccagcacatgggtg

SEQ ID NO: 3927 - DNA, 36 bp, Homo sapiens
catacggctctgtcactttcactgtctatggcaccc

SEQ ID NO: 3928 - DNA, 76 bp, Homo sapiens
tccttgaattgatagtggcttctgtttgtcagtctcatataagaactacagctcatcaggaggagatcgcagcagg

SEQ ID NO: 3929 - DNA, 374 bp, Homo sapiens
cctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaag

SEQ ID NO: 3930 - DNA, 36 bp, Homo sapiens
acaaaaccccttgatcaagtttgtggcactgacaat

SEQ ID NO: 3931 - DNA, 36 bp, Homo sapiens; identical to SEQ ID NO: 3776

SEQ ID NO: 3932 - DNA, 36 bp, Homo sapiens; identical to SEQ ID NO: 3867

SEQ ID NO: 3933 - DNA, 216 bp, Homo sapiens
ctggcttgaaagagctcttccagacaccagtatgcactgacaagcccacgactcacgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatgg

SEQ ID NO: 3934 - DNA, 28 bp, Homo sapiens
gcgtctggatctggctggccgagatctc

SEQ ID NO: 3935 - DNA, 344 bp, Homo sapiens
tcattgacattctaactaagcgaaacaatgcacagcgtcaacagatcaaagcagcatatctccaggaaacaggaaagcccctggatgaaacacttaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgct

SEQ ID NO: 3936 - DNA, 307 bp, Homo sapiens; identical to SEQ ID NO: 3893

SEQ ID NO: 3937 - DNA, 500 bp, Homo sapiens
ttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatct

SEQ ID NO: 3938 - DNA, 36 bp, Homo sapiens
agaagacatattcaacacatgcacagggcagccact

SEQ ID NO: 3939 - DNA, 199 bp, Homo sapiens
gtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctg

SEQ ID NO: 3940 - DNA, 354 bp, Homo sapiens
tcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctact

SEQ ID NO: 3941 - DNA, 404 bp, Homo sapiens; identical to SEQ ID NO: 3680

SEQ ID NO: 3942 - DNA, 104 bp, Homo sapiens
tttcatgctgttgctgcttagaaaagagctttgaactacaggaacgcaatgtgggactaaagagcaagatccagaagtgggatgagtcatgcaactcagaggac

SEQ ID NO: 3943 - DNA, 36 bp, Homo sapiens
ctgccaagaatcctccaggttaccttgaggatagtt

SEQ ID NO: 3944 - DNA, 91 bp, Homo sapiens
tggtggaggctgtgaccattgtagagacaccacccatggtggttgtgggcattgtgggctacgtggaaacccctcgaggcctccggacctt

SEQ ID NO: 3945 - DNA, 301 bp, Homo sapiens
gccagagggacctgtctgcagctaccagatgctccccaccctgggagagctcagcggcatgtctgcacatgggccttttcagccttcttcatcccgcaattggaactgactttcccactcccatctcacacttgagaatctctgtttcttgtttcttgttttttattttatttttattttttctcccccctggtggacaatggtgaggagggtgaaggaaggttaaaagccactgctctacgggatgaaaaactaaacttgtcattcttcagatccctcccagtctggccccagcctaccc

SEQ ID NO: 3946 - DNA, 404 bp, Homo sapiens; identical to SEQ ID NO: 3680

SEQ ID NO: 3947 - DNA, 36 bp, Homo sapiens
gataaccaagaaagaaagacagaattgcccagggag

SEQ ID NO: 3948 - DNA, 491 bp, Homo sapiens; identical to SEQ ID NO: 3862

SEQ ID NO: 3949 - DNA, 245 bp, Homo sapiens
ttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtct

SEQ ID NO: 3950 - DNA, 500 bp, Homo sapiens
ctgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcac

SEQ ID NO: 3951 - DNA, 36 bp, Homo sapiens; identical to SEQ ID NO: 3539

SEQ ID NO: 3952 - DNA, 26 bp, Homo sapiens
gaggctgaggtggcctccttgaaccg

SEQ ID NO: 3953 - DNA, 39 bp, Homo sapiens
tttggtgtgaatgaagacttggctgattcagatgccagg

SEQ ID NO: 3954 - DNA, 217 bp, Homo sapiens
gtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatga

SEQ ID NO: 3955 - DNA, 54 bp, Homo sapiens; identical to SEQ ID NO: 3746

SEQ ID NO: 3956 - DNA, 36 bp, Homo sapiens; identical to SEQ ID NO: 3846

SEQ ID NO: 3957 - DNA, 500 bp, Homo sapiens
ctacgtgagcttccagtcggacatcggcccgtaccagagcgggcgcttctacaccaagccacctcagtgcgtggacatccccgcggacctgcggctgtgccacaacgtgggctacaagaagatggtgctgcccaacctgctggagcacgagaccatggcggaggtgaagcagcaggccagcagctgggtgcccctgctcaacaagaactgccacgccggcacccaggtcttcctctgctcgctcttcgcgcccgtctgcctggaccggcccatctacccgtgtcgctggctctgcgaggccgtgcgcgactcgtgcgagccggtcatgcagttcttcggcttctactggcccgagatgcttaagtgtgacaagttccccgagggggacgtctgcatcgccatgacgccgcccaatgccaccgaagcctccaagccccaaggcacaacggtgtgtcctccctgtgacaacgagttgaaatctgaggccatcattgaacatc

SEQ ID NO: 3958 - DNA, 208 bp, Homo sapiens
gagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacacc

SEQ ID NO: 3959 - DNA, 42 bp, Homo sapiens
gggctcgtgtgacagatgctactgagaccaccatcaccatta

SEQ ID NO: 3960 - DNA, 291 bp, Homo sapiens
ccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaa

SEQ ID NO: 3961 - DNA, 36 bp, Homo sapiens; identical to SEQ ID NO: 3672

SEQ ID NO: 3962 - DNA, 68 bp, Homo sapiens
gggaagcgcagctcgaaaagcgatgccgattctggtttcctggggctgcggcccacttcggtggaccc

SEQ ID NO: 3963 - DNA, 188 bp, Homo sapiens; identical to SEQ ID NO: 3341

SEQ ID NO: 3964 - DNA, 36 bp, Homo sapiens
aaacatgaagagcgccaggatgaacatggtttcatc

SEQ ID NO: 3965 - DNA, 36 bp, Homo sapiens; identical to SEQ ID NO: 3706

SEQ ID NO: 3966 - DNA, 220 bp, Homo sapiens
tcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctg

SEQ ID NO: 3967 - DNA, 36 bp, Homo sapiens
ctgctgtcgggaccacacttgacagtttttggacag

SEQ ID NO: 3968 - DNA, 36 bp, Homo sapiens; identical to SEQ ID NO: 3706

SEQ ID NO: 3969 - DNA, 91 bp, Homo sapiens
catttgtgagcaaacatgcggtaaaactccacctaagcaaaacgcacagcaagtcacccgaacaccattcacagtttgtaacagacgtgga

SEQ ID NO: 3970 - DNA, 36 bp, Homo sapiens
gttcaatgatctcagcagagttcttcatgtgaaacg

SEQ ID NO: 3971 - DNA, 191 bp, Homo sapiens
gatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccag

SEQ ID NO: 3972 - DNA, 36 bp, Homo sapiens
agctgagctggcagagtcccgttgccgagagatgga

SEQ ID NO: 3973 - DNA, 362 bp, Homo sapiens
ctgggccttttttcctatgtctcttgggaactgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaa

SEQ ID NO: 3974 - DNA, 459 bp, Homo sapiens
cagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactg

SEQ ID NO: 3975 - DNA, 190 bp, Homo sapiens
aataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgttt

SEQ ID NO: 3976 - DNA, 51 bp, Homo sapiens
ttggaatttcattatatgttaagaaaataaaggaaaatgacttgtaaggtc

SEQ ID NO: 3977 - DNA, 170 bp, Homo sapiens
gaggaggtcaccaagaaacatcagtatgaaattaggaattgttggccacctgtattatctggggggatcagtccttgcattatcattgaaacacctcacaaagaaataggaacaagtgatttctccagatttacaaattacagatttaaaaatctttttattaatccttc

SEQ ID NO: 3978 - DNA, 36 bp, Homo sapiens
gagaaaatggccagatgatgagctgcacatgtcttg

SEQ ID NO: 3979 - DNA, 305 bp, Homo sapiens
aggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaa

SEQ ID NO: 3980 - DNA, 80 bp, Homo sapiens
ctgggtcatgagccgtatctctgaagatggctatccttgggactcagtgttccacacccggtttcgttctatgctccgca

SEQ ID NO: 3981 - DNA, 275 bp, Homo sapiens
cgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaa

SEQ ID NO: 3982 - DNA, 476 bp, Homo sapiens; identical to SEQ ID NO: 3825

SEQ ID NO: 3983 - DNA, 415 bp, Homo sapiens
agaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatca

SEQ ID NO: 3984 - DNA, 173 bp, Homo sapiens
ctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctg

SEQ ID NO: 3985 - DNA, 155 bp, Homo sapiens
tccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaa

SEQ ID NO: 3986 - DNA, 382 bp, Homo sapiens
cagcgatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttag

SEQ ID NO: 3987 - DNA, 303 bp, Homo sapiens
aggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaag

SEQ ID NO: 3988 - DNA, 36 bp, Homo sapiens
ctcctggaccagggacagactcactctgtggagaca

SEQ ID NO: 3989 - DNA, 79 bp, Homo sapiens
tccttgaaccgtaggatccagctggttgaagaagagctggaccgtgctcaggagcgcctggccactgccctgcaaaagc

SEQ ID NO: 3990 - DNA, 36 bp, Homo sapiens
caaagtagggcgtgtggtccctgcccctgtccggac

SEQ ID NO: 3991 - DNA, 460 bp, Homo sapiens
gggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcagcgatgccagagagaatatccagagattctttggccatggtgcggaggactcgctggctgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaaga

SEQ ID NO: 3992 - DNA, 36 bp, Homo sapiens
ctgttcagagatgacacagtatgtttggccaaactt

SEQ ID NO: 3993 - DNA, 281 bp, Homo sapiens
ctgggccttttttcctatgtctcttgggaactgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctggga

SEQ ID NO: 3994 - DNA, 173 bp, Homo sapiens; identical to SEQ ID NO: 3984

SEQ ID NO: 3995 - DNA, 368 bp, Homo sapiens
atcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccaca

SEQ ID NO: 3996 - DNA, 36 bp, Homo sapiens
agtatcacaaagagagaggaaaaccaagaacaacct

SEQ ID NO: 3997 - DNA, 40 bp, Homo sapiens; identical to SEQ ID NO: 3532

SEQ ID NO: 3998 - DNA, 36 bp, Homo sapiens
gacactggactctcagagatgcgcctggagaaggac

SEQ ID NO: 3999 - DNA, 33 bp, Homo sapiens; identical to SEQ ID NO: 3515

SEQ ID NO: 4000 - DNA, 386 bp, Homo sapiens
ttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatccc

SEQ ID NO: 4001 - DNA, 36 bp, Homo sapiens
acagggtctacagagaggaactgaagagagatctgg

SEQ ID NO: 4002 - DNA, 36 bp, Homo sapiens
gaacatatcaccaaccagaaccccaagtttcacatg

SEQ ID NO: 4003 - DNA, 25 bp, Homo sapiens
agggacccgcagctcagctacagca

SEQ ID NO: 4004 - DNA, 36 bp, Homo sapiens
cccatctgtctcactcaggatgaatttcacccattc

SEQ ID NO: 4005 - DNA, 36 bp, Homo sapiens
acaggagcgcacgagcggtggcttgttgtcagaggc

SEQ ID NO: 4006 - DNA, 27 bp, Homo sapiens
tggaccccacccagacctcgttcctca

SEQ ID NO: 4007 - DNA, 36 bp, Homo sapiens
gttatacacagaaagcagattctccaatggatgact

SEQ ID NO: 4008 - DNA, 500 bp, Homo sapiens
aacaccacagtgatgcaaggcttcaacagatctgagcggtgccccagagacactcggatagtacagctggtattcccagccctctacacagtggttttcttgaccggcatcctgctgaatactttggctctgtgggtgtttgttcacatccccagctcctccaccttcatcatctacctcaaaaacactttggtggccgacttgataatgacactcatgcttcctttcaaaatcctctctgactcacacctggcaccctggcagctcagagcttttgtgtgtcgtttttcttcggtgatattttatgagaccatgtatgtgggcatcgtgctgttagggctcatagcctttgacagattcctcaagatcatcagacctttgagaaatatttttctaaaaaaacctgtttttgcaaaaacggtctcaatcttcatctggttctttttgttcttcatctccctgccaaatacgatcttgagcaacaaggaagcaacaccatc

SEQ ID NO: 4009 - DNA, 26 bp, Homo sapiens
aatgatgagcagtttgtaccagacta

SEQ ID NO: 4010 - DNA, 500 bp, Homo sapiens
gagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagact

SEQ ID NO: 4011 - DNA, 201 bp, Homo sapiens
tatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgacca

SEQ ID NO: 4012 - DNA, 36 bp, Homo sapiens
ttggaacccagtccacagctattcctgcaccaactg

SEQ ID NO: 4013 - DNA, 403 bp, Homo sapiens
gatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactc

SEQ ID NO: 4014 - DNA, 26 bp, Homo sapiens
gatggctggcattggcatcagggaag

SEQ ID NO: 4015 - DNA, 36 bp, Homo sapiens
aaggatcaggtcagccactccctggagacacagcct

SEQ ID NO: 4016 - DNA, 108 bp, Homo sapiens
gccaaggagaagttgctgcgggtgtcggaggacgagcgggaccgggtgctggaggagctgcacaaggcggaggacagcctcctggccgccgaagaggccgccgccaag

SEQ ID NO: 4017 - DNA, 69 bp, Homo sapiens
aactgcaagaaaaactgaaggagacagaagcagccatggaaaaattattcaacagagtgggacctaatg

SEQ ID NO: 4018 - DNA, 152 bp, Homo sapiens; identical to SEQ ID NO: 3520

SEQ ID NO: 4019 - DNA, 87 bp, Homo sapiens
aggttctctgtcaacctggatgtgaagcacttctccccagaggaactcaaagttaaggtgttgggagatgtgattgaggtgcatgga

SEQ ID NO: 4020 - DNA, 363 bp, Homo sapiens
gatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttca

SEQ ID NO: 4021 - DNA, 221 bp, Homo sapiens; identical to SEQ ID NO: 3924

SEQ ID NO: 4022 - DNA, 36 bp, Homo sapiens
ctgataccatcatcccagctgttcctcctcccactg

SEQ ID NO: 4023 - DNA, 291 bp, Homo sapiens; identical to SEQ ID NO: 3960

SEQ ID NO: 4024 - DNA, 52 bp, Homo sapiens
ctggcccagcttcgctgcgagatggagcagcagaaccaggaatacaaaatcc

SEQ ID NO: 4025 - DNA, 500 bp, Homo sapiens
atcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgaga

SEQ ID NO: 4026 - DNA, 500 bp, Homo sapiens; identical to SEQ ID NO: 3650

SEQ ID NO: 4027 - DNA, 85 bp, Homo sapiens
gcaaagacatggcagcagtgcagaggaccctgatggctttgggcagcttggcagtgaccaagaatgatgggcactaccgtggaga

SEQ ID NO: 4028 - DNA, 353 bp, Homo sapiens; identical to SEQ ID NO: 3531

SEQ ID NO: 4029 - DNA, 500 bp, Homo sapiens
tttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaac

SEQ ID NO: 4030 - DNA, 64 bp, Homo sapiens
aggtaccactgagcctggagagcaccaagaggccaagaaagcagagaactcatcaaatgaggag

SEQ ID NO: 4031 - DNA, 36 bp, Homo sapiens
catgttgagccatttcaggaagaaggagagacgacc

SEQ ID NO: 4032 - DNA, 220 bp, Homo sapiens; identical to SEQ ID NO: 3966

SEQ ID NO: 4033 - DNA, 500 bp, Homo sapiens
cttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaag

SEQ ID NO: 4034 - DNA, 404 bp, Homo sapiens; identical to SEQ ID NO: 3680

SEQ ID NO: 4035 - DNA, 171 bp, Homo sapiens
aaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagag

SEQ ID NO: 4036 - DNA, 220 bp, Homo sapiens; identical to SEQ ID NO: 3966

SEQ ID NO: 4037 - DNA, 330 bp, Homo sapiens
tccctgaagacctggccggcttcatcgagctcttccagacaccaagtcacactaaggaatcaatgactaatgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagca

SEQ ID NO: 4038 - DNA, 64 bp, Homo sapiens
gtagtagggaaagtgcctggccatttcactcctgtcttggcaccctctccccatcccagtgcag

SEQ ID NO: 4039 - DNA, 143 bp, Homo sapiens
cccgaaagcatcactgccttggcccctccctcccggctgcccccatcacctctactgtctcctccctgggctaagcaggggagaagcgggctgggggtagcctggatgtgggccaagtccactgtcctccttggcggcaaaag

SEQ ID NO: 4040 - DNA, 367 bp, Homo sapiens
aacggctcgcggagcggctacgcggagtgacatcgccggtgtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagtta

SEQ ID NO: 4041 - DNA, 36 bp, Homo sapiens; identical to SEQ ID NO: 3706

SEQ ID NO: 4042 - DNA, 36 bp, Homo sapiens; identical to SEQ ID NO: 4004

SEQ ID NO: 4043 - DNA, 472 bp, Homo sapiens
aaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgcccca

SEQ ID NO: 4044 - DNA, 29 bp, Homo sapiens
agatgtggcctttgtgaaacaccagactg

SEQ ID NO: 4045 - DNA, 322 bp, Homo sapiens
agcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcact

SEQ ID NO: 4046 - DNA, 36 bp, Homo sapiens; identical to SEQ ID NO: 3988

SEQ ID NO: 4047 - DNA, 66 bp, Homo sapiens
tcacccacaatgtccccatctatgagggctatgccttgccccatgccatcatgcgtctggatctgg

SEQ ID NO: 4048 - DNA, 322 bp, Homo sapiens
ctcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgt

SEQ ID NO: 4049 - DNA, 251 bp, Homo sapiens
cagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggattt

SEQ ID NO: 4050 - DNA, 255 bp, Homo sapiens; identical to SEQ ID NO: 3754

SEQ ID NO: 4051 - DNA, 500 bp, Homo sapiens
atggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaa

SEQ ID NO: 4052 - DNA, 25 bp, Homo sapiens
tgcacagaggaaagattggaagaca

SEQ ID NO: 4053 - DNA, 36 bp, Homo sapiens; identical to SEQ ID NO: 3998

SEQ ID NO: 4054 - DNA, 36 bp, Homo sapiens
ctggaacagctacaacaaccgccgagacctgaactt

SEQ ID NO: 4055 - DNA, 172 bp, Homo sapiens
gagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtgg

SEQ ID NO: 4056 - DNA, 490 bp, Homo sapiens
ggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctga

SEQ ID NO: 4057 - DNA, 360 bp, Homo sapiens
aatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctc

SEQ ID NO: 4058 - DNA, 500 bp, Homo sapiens
aggagagtagcttaagagacttaataaaagagctgccagacacccactactgcctcctcaagtacctttgccagttcttgacaaaagtagccaagcatcatgtgcagaatcgcatgaatgttcacaatctcgccactgtatttgggccaaattgctttcatgtgccacctgggcttgaaggcatgaaggaacaggacctgtgcaacaagataatggctaaaattctagaaaattacaataccctgtttgaagtagagtatacagaaaatgatcatctgagatgtgaaaacctggctaggcttatcatagtaaaagaggtctattataagaactccctgcccatccttttaacaagaggcttagaaagagacatgccaaaaccacctccaaaaaccaagatcccaaaatccaggagtgagggatctattcaggcccacagagtactgcaaccagagctatctgatggcattcctcagctcagcttgcggctaagttataga

SEQ ID NO: 4059 - DNA, 132 bp, Homo sapiens
caaactgctcaaccacctgctttaatggagggacctgtttctaccctggaaaatgtatttgccctccaggactagagggagagcagtgtgaaatcagcaaatgcccacaaccctgtcgaaatggaggtaaat

SEQ ID NO: 4060 - DNA, 500 bp, Homo sapiens
aactattttcaattgacgttgaataggatgagtcatggaatttaagtgatttactgaagattatactactggtagatagaagagctaaagaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagca

SEQ ID NO: 4061 - DNA, 126 bp, Homo sapiens
acctgtcatttactccatcctttatagtgatgctacaggacgaagaggaatggataaaaacattggcgagcaactcaataaagcgtatgaagccttccggcaggcatgcatggatagagattctgc

SEQ ID NO: 4062 - DNA, 36 bp, Homo sapiens
atgtggactctgtggttgggagaagctcagtgggtg

SEQ ID NO: 4063 - DNA, 221 bp, Homo sapiens; identical to SEQ ID NO: 3924

SEQ ID NO: 4064 - DNA, 126 bp, Homo sapiens
gtggaaaaactaaccagctgaatctgcagaacactgcaactaaagcaattattcaaggccttatgccagaccagaattacacagttcaaattattgcatacaataaagataaagaaagcaagccag

SEQ ID NO: 4065 - DNA, 36 bp, Homo sapiens
acatcatcagttgaacaggagcagtaaacatagcca

SEQ ID NO: 4066 - DNA, 412 bp, Homo sapiens
ggaagtttgcagattccttaaatgaatttaaatttcagtgcataggagatgcagaaacagatgatgagatgtgtatagcaaggtctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaaatatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttga

SEQ ID NO: 4067 - DNA, 166 bp, Homo sapiens
tcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtg

SEQ ID NO: 4068 - DNA, 213 bp, Homo sapiens
gcagaacagggcaagagttctagccaagagctgggattgaaggatcaagaggacagtgatggtcacttaagtgtgaatttggagtatgcaccaactgaaggtacattggacataaaagaagatatgattgagcctcaggagaaaaaactctcagagaacactgattttttggctcctggtgttagttccttcacagattctaaccaacaagaa

SEQ ID NO: 4069 - DNA, 500 bp, Homo sapiens; identical to SEQ ID NO: 3950

SEQ ID NO: 4070 - DNA, 36 bp, Homo sapiens; identical to SEQ ID NO: 3998

SEQ ID NO: 4071 - DNA, 332 bp, Homo sapiens
ccggtgtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagtta

SEQ ID NO: 4072 - DNA, 36 bp, Homo sapiens
acagccttggctttggaggtcggtgagctggtaaag

SEQ ID NO: 4073 - DNA, 36 bp, Homo sapiens; identical to SEQ ID NO: 3600

SEQ ID NO: 4074 - DNA, 500 bp, Homo sapiens
tggtgggccagcatggacgaactgctggagctatgcaagtagaaaaagctcaactggagaaagaaattaatgataggcggatggaactaaaggaacttaagatattaaaagataaaaaagatgcaaagatccgggagcttgaggccagagtgagtgacttggagctggaaaaggtgaagctggtgaatgcaggctctgagcggctccgtgcagtgaaggacatcaaacaagagagagatcaattattaaatgaggtgaaaacaagtaggagtgaattaaacaatctttcagaggagtatgaagtcttaaaaaggaatttccgaaacaaaagtgaagaaatggaaatgactacaaataagttgaaaatgcaattaaaatctgcacagtctgaactagaacagacaagaaatacattaaagtcaatggaaggatctgatggtcatgctatgaaagtggcaatggggatgcaaaagcaaatcacagccaaaagaggtcagata

SEQ ID NO: 4075 - DNA, 36 bp, Homo sapiens
aagatggctttgaactcagggtcaccaccagctatt

SEQ ID NO: 4076 - DNA, 36 bp, Homo sapiens
gcagatcacggcctccagcagctacaagacctgggg

SEQ ID NO: 4077 - DNA, 261 bp, Homo sapiens
gtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcga

SEQ ID NO: 4078 - DNA, 36 bp, Homo sapiens
gaggagaagctgaaggaggctgagacccgagcagag

SEQ ID NO: 4079 - DNA, 36 bp, Homo sapiens; identical to SEQ ID NO: 3964

SEQ ID NO: 4080 - DNA, 51 bp, Homo sapiens
gagatggtgtcacccacaatgtccccatctatgagggctatgccttgcccc

SEQ ID NO: 4081 - DNA, 352 bp, Homo sapiens
gcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcac

SEQ ID NO: 4082 - DNA, 25 bp, Homo sapiens
aggagaaactggagcaggccgagaa

SEQ ID NO: 4083 - DNA, 291 bp, Homo sapiens; identical to SEQ ID NO: 3960

SEQ ID NO: 4084 - DNA, 343 bp, Homo sapiens
tccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatgg

SEQ ID NO: 4085 - DNA, 249 bp, Homo sapiens
ggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttca

SEQ ID NO: 4086 - DNA, 158 bp, Homo sapiens
actattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaa

SEQ ID NO: 4087 - DNA, 36 bp, Homo sapiens
tggcagcaaaagatggccacaaactcctaaggaaaa

SEQ ID NO: 4088 - DNA, 96 bp, Homo sapiens
tcaatccattgcctatcacctcaaaattgaggagcaaagagaaaaagtacatgaaaatgaaaatataggtaccactgagcctggagagcaccaaga

SEQ ID NO: 4089 - DNA, 36 bp, Homo sapiens
tgggcccaaaggtaggtgcagggtctgctggagcca

SEQ ID NO: 4090 - DNA, 133 bp, Homo sapiens
tggtggaggctgtgaccattgtagagacaccacccatggtggttgtgggcattgtgggctacgtggaaacccctcgaggcctccggaccttcaagactgtctttgctgagcacatcagtgatgaatgcaagag

SEQ ID NO: 4091 - DNA, 500 bp, Homo sapiens
caagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggcacttgttcagattacccaaa

SEQ ID NO: 4092 - DNA, 387 bp, Homo sapiens
gtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcat

SEQ ID NO: 4093 - DNA, 69 bp, Homo sapiens
gcaggatccaaatatttccaatggagaagaggaagaagaaaaagagccaggtgaagttggtacccacaa

SEQ ID NO: 4094 - DNA, 36 bp, Homo sapiens; identical to SEQ ID NO: 3998

SEQ ID NO: 4095 - DNA, 36 bp, Homo sapiens
tcaaaagaggaaagccatgaacagtcagcagaacag

SEQ ID NO: 4096 - DNA, 88 bp, Homo sapiens
ccatacggctctgtcactttcactgtctatggcacccccaaacccaaacgcccagcgatccttacctaccacgatgtgggactcaact

SEQ ID NO: 4097 - DNA, 36 bp, Homo sapiens
cggtccaacagccaacagtgcaacacagatatctgt

SEQ ID NO: 4098 - DNA, 500 bp, Homo sapiens
gttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtgg

SEQ ID NO: 4099 - DNA, 89 bp, Homo sapiens
gccacatcgaagcatgctaagatcagcactctaccacagctgaattctgcactagttcaagatttagccaaggctgtggcaaaggtgta

SEQ ID NO: 4100 - DNA, 262 bp, Homo sapiens
cagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggacc

SEQ ID NO: 4101 - DNA, 362 bp, Homo sapiens; identical to SEQ ID NO: 3973

SEQ ID NO: 4102 - DNA, 174 bp, Homo sapiens
catcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggcccc

SEQ ID NO: 4103 - DNA, 450 bp, Homo sapiens
gggatttaaagagtttttcttgggtgtttgtcaaacttttattccctgtctgtgtgcagaggggattcaacttcaattttctgcagtggctctgggtccagccccttacttaaagatctggaaagcatgaagactgggccttttttcctatgtctcttgggaactgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagt

SEQ ID NO: 4104 - DNA, 56 bp, Homo sapiens
gagccagcttatcaaccctcagcagcgcaacgccctcactcctacaaccattcctg

SEQ ID NO: 4105 - DNA, 500 bp, Homo sapiens
acacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgc

SEQ ID NO: 4106 - DNA, 260 bp, Homo sapiens
gccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatga

SEQ ID NO: 4107 - DNA, 36 bp, Homo sapiens
cgcccggcgaccagcaagacggagtctcactctgtc

SEQ ID NO: 4108 - DNA, 500 bp, Homo sapiens
attcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgag

SEQ ID NO: 4109 - DNA, 500 bp, Homo sapiens
actacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacac

SEQ ID NO: 4110 - DNA, 210 bp, Homo sapiens
gctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgc

SEQ ID NO: 4111 - DNA, 220 bp, Homo sapiens; identical to SEQ ID NO: 3966

SEQ ID NO: 4112 - DNA, 156 bp, Homo sapiens
ggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaa

SEQ ID NO: 4113 - DNA, 501 bp, Homo sapiens
aaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagc

SEQ ID NO: 4114 - DNA, 71 bp, Homo sapiens; identical to SEQ ID NO: 3545

SEQ ID NO: 4115 - DNA, 467 bp, Homo sapiens
gggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggctgcagaagtgatcagcgatgccagagagaatatccagagattctttggccatggtgcggaggactcgctggctgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacacaatgggtatctaataaatacttaagaggtggaa

SEQ ID NO: 4116 - DNA, 36 bp, Homo sapiens; identical to SEQ ID NO: 4005

SEQ ID NO: 4117 - DNA, 26 bp, Homo sapiens
gttagctgcccgaatcctcctggacc

SEQ ID NO: 4118 - DNA, 26 bp, Homo sapiens
atgcaggccttggagatagagctgca

SEQ ID NO: 4119 - DNA, 433 bp, Homo sapiens
aaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaaggaagggctataccccaggtgaatcaattcagatatttgctgagattgagaactgctcttcccgaatggtggtgccaaaggcagccatttaccaaacacaggccttctatgccaaagggaaaatgaaggaagtaaa

SEQ ID NO: 4120 - DNA, 192 bp, Homo sapiens; identical to SEQ ID NO: 3452

SEQ ID NO: 4121 - DNA, 82 bp, Homo sapiens
atgctcataccaaagccaccaccaaagacagacatcttgaagagtctagatactatggatgatccagacaccgtgggaagca

SEQ ID NO: 4122 - DNA, 25 bp, Homo sapiens
tgcttgaagaccacaaggctgaaaa

SEQ ID NO: 4123 - DNA, 36 bp, Homo sapiens; identical to SEQ ID NO: 3846

SEQ ID NO: 4124 - DNA, 36 bp, Homo sapiens; identical to SEQ ID NO: 3998

SEQ ID NO: 4125 - DNA, 458 bp, Homo sapiens
gggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgagccctcggggcagggattcaaagttagtgaggtctatgtccagagaagctgagatatggcatat

SEQ ID NO: 4126 - DNA, 198 bp, Homo sapiens
tattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttct

SEQ ID NO: 4127 - DNA, 500 bp, Homo sapiens
cccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctag

SEQ ID NO: 4128 - DNA, 405 bp, Homo sapiens
cctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaat

SEQ ID NO: 4129 - DNA, 36 bp, Homo sapiens
agctacagcacagatcagcaccatgaagcttctcac

SEQ ID NO: 4130 - DNA, 291 bp, Homo sapiens; identical to SEQ ID NO: 3960

SEQ ID NO: 4131 - DNA, 140 bp, Homo sapiens
agataatgagcataagcgttcactgaccaagactccagccagaaagtctgcacatgtgaccgtgtctgggggcaccccaaaaggcgaggctgtgcttgggacacacaaattaaagaccatcacggggaattctgctgctg

SEQ ID NO: 4132 - DNA, 36 bp, Homo sapiens; identical to SEQ ID NO: 3998

SEQ ID NO: 4133 - DNA, 36 bp, Homo sapiens
aaactggaccccacccagacctcgttcctcaagatg

SEQ ID NO: 4134 - DNA, 499 bp, Homo sapiens
ccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccag

SEQ ID NO: 4135 - DNA, 36 bp, Homo sapiens
acattaaagcatttatgggaactccagtgcagaaac

SEQ ID NO: 4136 - DNA, 365 bp, Homo sapiens
agcagctttgtggacccggcactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaa

SEQ ID NO: 4137 - DNA, 45 bp, Homo sapiens
gagatcaacattgatgaattgttggagttagagagtgaagaggag

SEQ ID NO: 4138 - DNA, 36 bp, Homo sapiens
tgaaaaagatatttgttggtggctttggtggcagcc

SEQ ID NO: 4139 - DNA, 500 bp, Homo sapiens
attaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaag

SEQ ID NO: 4140 - DNA, 36 bp, Homo sapiens
gtaaagaagcatatcaaggaactcctggatatgatg

SEQ ID NO: 4141 - DNA, 36 bp, Homo sapiens
agctggggtctggaccttcaatcaaagccttagatg

SEQ ID NO: 4142 - DNA, 500 bp, Homo sapiens
aaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgtgttatagtctgatttggtgttaaacaggaccttcttcccccaaaattgttcagattataaaatgtgagccattcagcccccaaggtccagggcaggcgacaggaacgagcccagcgtgtgacaaagcctaacctactttcctctttcccaagctttttcagagactctggagtggacccagccctctggggaaagacagaacttagagacatcccagttactcaccacacccatagtgctgtccaatatggtagccactagctagctgtggctacttcaatttaaattcagttttaattttaattaaaa

SEQ ID NO: 4143 - DNA, 500 bp, Homo sapiens
aatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgta

SEQ ID NO: 4144 - DNA, 36 bp, Homo sapiens
agggccagtgtaaaactgcttccatgtctaagcaaa

SEQ ID NO: 4145 - DNA, 500 bp, Homo sapiens
ccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaatta

SEQ ID NO: 4146 - DNA, 36 bp, Homo sapiens
aggacagagaaattaaagcctcagcccatgccatca

SEQ ID NO: 4147 - DNA, 36 bp, Homo sapiens; identical to SEQ ID NO: 3988

SEQ ID NO: 4148 - DNA, 188 bp, Homo sapiens
gggacagggctgaggatgaggagaaccctggggacccagaagaccgtgccttgcccggaagtcctgcctgtaggcctgaaggacttgccctaacagagcctcaacaactacctggtgattcctacttcagccccttggtgtgagcagcttctcaacatgaactacagcctccacttggccttcgtgtg

SEQ ID NO: 4149 - DNA, 36 bp, Homo sapiens
tgtcagagagcatgcagcgtcagggcctactgcaag

SEQ ID NO: 4150 - DNA, 500 bp, Homo sapiens
gctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcc

SEQ ID NO: 4151 - DNA, 36 bp, Homo sapiens
atgagtccttggttccaattcatgctgtttatcctg

SEQ ID NO: 4152 - DNA, 36 bp, Homo sapiens
tggcacccacagtcagtggaacaagccgagtaagcc

SEQ ID NO: 4153 - DNA, 500 bp, Homo sapiens
gagttcttccgcttgttgttggctttcaactgttggatttgaggcgcttagcgccttcttcgtccgggtgcagcacattcttgattggtctcatgcctttgtggttgtaaatgtgcctggaatcctagcctttcatggtttgttctgagtaatgaataccctattactatgatactagtatcttccttaattatcctactcattgtctcaacattctgacagttggattgagcatattcaaattttgaaaattattgtagaaatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatcca

SEQ ID NO: 4154 - DNA, 36 bp, Homo sapiens
agaaagaagccaccaccagaagagaatggagactac

SEQ ID NO: 4155 - DNA, 500 bp, Homo sapiens
ccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgta

SEQ ID NO: 4156 - DNA, 105 bp, Homo sapiens
ctgttcctcctcccactgacctgcgattcaccaacattggtccagacaccatgcgtgtcacctgggctccacccccatccattgatttaaccaacttcctggtgc

SEQ ID NO: 4157 - DNA, 290 bp, Homo sapiens
ggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagc

SEQ ID NO: 4158 - DNA, 264 bp, Homo sapiens
ctgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctag

SEQ ID NO: 4159 - DNA, 262 bp, Homo sapiens; identical to SEQ ID NO: 3656

SEQ ID NO: 4160 - DNA, 500 bp, Homo sapiens
caaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaa

SEQ ID NO: 4161 - DNA, 101 bp, Homo sapiens
tttggatcgccatatgcaaacccaccacggacaccataaaccattccgatgcaaactctgctccttcaagtcctcctataacagccggctgaaaacacata

SEQ ID NO: 4162 - DNA, 428 bp, Homo sapiens
atctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgca

SEQ ID NO: 4163 - DNA, 245 bp, Homo sapiens; identical to SEQ ID NO: 3166

SEQ ID NO: 4164 - DNA, 36 bp, Homo sapiens
acacacccaaaccagcaggaggtgatgagaaagaca

SEQ ID NO: 4165 - DNA, 36 bp, Homo sapiens; identical to SEQ ID NO: 3972

SEQ ID NO: 4166 - DNA, 36 bp, Homo sapiens; identical to SEQ ID NO: 3972

SEQ ID NO: 4167 - DNA, 76 bp, Homo sapiens
ccattcccatctactgaaacagggtctccacaagaggggccagggaatatgggtttttaacaagcgtcttacaaaa

SEQ ID NO: 4168 - DNA, 28 bp, Homo sapiens
catcatgcgtctggatctggctggccga

SEQ ID NO: 4169 - DNA, 102 bp, Homo sapiens
gtagctgtgattggagctggggtcagtggcctaatttctctgaagtgctgtgtggatgagggacttgagcccacttgctttgagagaactgaagatattgga

SEQ ID NO: 4170 - DNA, 36 bp, Homo sapiens
tcgtttcagaactcagaggtcagcttctggaagcaa

SEQ ID NO: 4171 - DNA, 500 bp, Homo sapiens
cagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggacct

SEQ ID NO: 4172 - DNA, 500 bp, Homo sapiens
ttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacctagacaaaaacccagcaagctccaagcgacggctcaagacatccctggggaaagt

SEQ ID NO: 4173 - DNA, 207 bp, Homo sapiens
ctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcg

SEQ ID NO: 4174 - DNA, 361 bp, Homo sapiens
acttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccag

SEQ ID NO: 4175 - DNA, 137 bp, Homo sapiens
caccgttgccatttccaacacaagctatccttcctccagccccatcgagctacttttctcatccaacaatcagatatcctccccacctgaatcctcaggatactctgaagaactatgtaccttcttatgacccatcc

SEQ ID NO: 4176 - DNA, 36 bp, Homo sapiens; identical to SEQ ID NO: 3603

SEQ ID NO: 4177 - DNA, 340 bp, Homo sapiens
tacaatgagctgcgtgtagcacctgaagagcaccccaccctgctcacagaggctcccctaaatcccaaggccaacagggaaaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacag

SEQ ID NO: 4178 - DNA, 51 bp, Homo sapiens
gttgaaggtcttgtcctcatcaacattgatcccaatgccaagggttggatg

SEQ ID NO: 4179 - DNA, 406 bp, Homo sapiens
ccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaa

SEQ ID NO: 4180 - DNA, 80 bp, Homo sapiens; identical to SEQ ID NO: 3980

SEQ ID NO: 4181 - DNA, 148 bp, Homo sapiens
caacaccctgaagccacatgcaaaggatgaaccagactccccagtgctctatagaaccatgagtgaagcagctctggtgagaaaaaggatgaagcctctgatgatggacagaaaagaaagacagaaaaatagagcctctattaatgga

SEQ ID NO: 4182 - DNA, 371 bp, Homo sapiens
ggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaa

SEQ ID NO: 4183 - DNA, 36 bp, Homo sapiens; identical to SEQ ID NO: 3988

SEQ ID NO: 4184 - DNA, 483 bp, Homo sapiens
tactatcatgacatgaactcgggggtcaatcttcagaggtctctgtcttctccaccaagcagcaaaagacccaaaactatatccatagaygaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatcc

SEQ ID NO: 4185 - DNA, 36 bp, Homo sapiens; identical to SEQ ID NO: 3484

SEQ ID NO: 4186 - DNA, 239 bp, Homo sapiens
ctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttgcttgagagcaacaccatatcatgggagcag

SEQ ID NO: 4187 - DNA, 500 bp, Homo sapiens
agacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgaccctcctccaggtagccagcagacagaaacatcttcctaaggatacccttctatctccagactcttcttttgaatatgtccagcctaagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaatgtgtcc

SEQ ID NO: 4188 - DNA, 406 bp, Homo sapiens; identical to SEQ ID NO: 4179

SEQ ID NO: 4189 - DNA, 330 bp, Homo sapiens
atctgggagaagcaggcggctccgcgctcgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgcc

SEQ ID NO: 4190 - DNA, 110 bp, Homo sapiens
ccgaacattacctgctgatcagaagccagaatgtcggccatactgggaaaaggatgatgcttcgatgcctctgccgtttgacctcacagacatcgtttcagaactcagag

SEQ ID NO: 4191 - DNA, 167 bp, Homo sapiens
cacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccag

SEQ ID NO: 4192 - DNA, 49 bp, Homo sapiens
gccttaaaattccaaaagaagcatttgaacaacctcagaccagttccac

SEQ ID NO: 4193 - DNA, 36 bp, Homo sapiens; identical to SEQ ID NO: 3811

SEQ ID NO: 4194 - DNA, 519 bp, Homo sapiens
gtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatata

SEQ ID NO: 4195 - DNA, 216 bp, Homo sapiens
gaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgaca

SEQ ID NO: 4196 - DNA, 36 bp, Homo sapiens
ggacacatctctttgcaggtagcagcaacagttgta

SEQ ID NO: 4197 - DNA, 500 bp, Homo sapiens
cagggccctaggtttgctcgtcacagtgtggggaagcccattcctctgccaggctctaaagccaaaggtctagaaaagcatcctgtctggcattttgtagtcttaacttctccccatttcccccatcttttggttgccttaaaagaaatctctagctcagataatgcccagacatttttttcccttggtgttgcccctattagctcttttcttgggcattcttttgctgtttattaaaaatatattatatatattttgtttctttaaatttcaaatgttttgcaaacatcactgagttaggtgggggtggggaagagaaatacaagatacttttttttttttttttttttttttttttttaaatagggcctcactctgttgctcaggctggagtgcggtggtgtgatctcggctcatgtagcctcaacctccccggctcaagtgatcctcctgcctcagcctcccaagtagctgggactacaggcgttcactactacacc

SEQ ID NO: 4198 - DNA, 165 bp, Homo sapiens
gtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcaga

SEQ ID NO: 4199 - DNA, 36 bp, Homo sapiens
ccgcctggagcgcggcaggtcatattgaacattcca

SEQ ID NO: 4200 - DNA, 187 bp, Homo sapiens
ggtatatggacgacttcttactcatgttagcccattcatttcatcagagcatcttcacacatcagtgttcactctctatagatttatttgcatattgtctaaatatgtttttttctgttattattttacactttttattttgcttcattctctgttgagttcctcaaacctttaaaaaggaaataaa

SEQ ID NO: 4201 - DNA, 463 bp, Homo sapiens
cctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaa

SEQ ID NO: 4202 - DNA, 39 bp, Homo sapiens
ggtgatcctggaaggagagctggagcgctcggaggagag

SEQ ID NO: 4203 - DNA, 36 bp, Homo sapiens
tcaccgtggaggaatttgttcttcccaagtttgaag

SEQ ID NO: 4204 - DNA, 36 bp, Homo sapiens
ctgcacctgggcagctcctccctgtgcccccagcct

SEQ ID NO: 4205 - DNA, 36 bp, Homo sapiens
ctccaggaaacaggaaagcccctggatgaaacactt

SEQ ID NO: 4206 - DNA, 36 bp, Homo sapiens
cgcgtgctgatgatggcgattctttggatgggaaga

SEQ ID NO: 4207 - DNA, 36 bp, Homo sapiens; identical to SEQ ID NO: 3706

SEQ ID NO: 4208 - DNA, 131 bp, Homo sapiens
ctggctcagcagattgcaaactgcaaacagtgcattgagcggtcagcatcactcatctcccaagcggaacactctctgaaggagaatgatcatgcgcgtttcctacagactgctaagaatatcaccgagag

SEQ ID NO: 4209 - DNA, 130 bp, Homo sapiens; identical to SEQ ID NO: 3462

SEQ ID NO: 4210 - DNA, 36 bp, Homo sapiens; identical to SEQ ID NO: 3706

SEQ ID NO: 4211 - DNA, 427 bp, Homo sapiens
agctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataac

SEQ ID NO: 4212 - DNA, 36 bp, Homo sapiens
gtccgccatgaggagaagtgaggtgctggcggagga

SEQ ID NO: 4213 - DNA, 500 bp, Homo sapiens
ggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaagga

SEQ ID NO: 4214 - DNA, 500 bp, Homo sapiens
accccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtga

SEQ ID NO: 4215 - DNA, 36 bp, Homo sapiens
taattgggcacgaaagagatgatgataattccgaag

SEQ ID NO: 4216 - DNA, 96 bp, Homo sapiens
gggacagggctgaggatgaggagaaccctggggacccagaagaccgtgccttgcccggaagtcctgcctgtaggcctgaaggacttgccctaacag

SEQ ID NO: 4217 - DNA, 500 bp, Homo sapiens
cagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggca

SEQ ID NO: 4218 - DNA, 99 bp, Homo sapiens
tttctgatgttccgagggacctggaagttgttgctgcgacccccaccagcctactgatcagctgggatgctcctgctgtcacagtgagatattacagga

SEQ ID NO: 4219 - DNA, 36 bp, Homo sapiens
ggctgagctctcagaaggcaaatgtgccgagcttga

SEQ ID NO: 4220 - DNA, 433 bp, Homo sapiens
ctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacc

SEQ ID NO: 4221 - DNA, 500 bp, Homo sapiens
ccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaat

SEQ ID NO: 4222 - DNA, 36 bp, Homo sapiens; identical to SEQ ID NO: 3600

SEQ ID NO: 4223 - DNA, 36 bp, Homo sapiens
atgccatcatgcgtctggatctggctggccgagatc

SEQ ID NO: 4224 - DNA, 282 bp, Homo sapiens
gccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcaca

SEQ ID NO: 4225 - DNA, 248 bp, Homo sapiens
tcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggattt

SEQ ID NO: 4226 - DNA, 147 bp, Homo sapiens
tggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggacccc

SEQ ID NO: 4227 - DNA, 255 bp, Homo sapiens
tcagcaaatcacatgaacagttccctgctgtctttatatcggaaaggaaatcctgattctgtttcaaatactcctgagatggagcaaagagaaaccacctcttcaacaccacggataagttccaaaacaggctccattcccttgaagacccctgccaaagattctgaaggaggatggtttattgacaaaaccccaagtgtaaagaaagacagttttttcttggacctgtcatgtgagaaaagtaatcctaagaag

SEQ ID NO: 4228 - DNA, 36 bp, Homo sapiens; identical to SEQ ID NO: 3600

SEQ ID NO: 4229 - DNA, 425 bp, Homo sapiens
aaagaaaagacactctgttgctggttctgtacctcaggcccaatatccttaagtgccaaaattgaaaggaagggctataccccaggtgaatcaattcagatatttgctgagattgagaactgctcttcccgaatggtggtgccaaaggcagccatttaccaaacacaggccttctatgccaaagggaaaatgaaggaagtaaaacagcttgtggctaacttgcgtggggaatccttatcatctggaaagacagagacgtggaatggcaagttgctgaaaattccaccagtttctccctctatcctcgactgtagtataatccgcgtggaatattcactaatggtatatgtggatattcctggagctatggatttatttcttaatttgccacttgtcatcggtaccattcctctacatccatttgg

SEQ ID NO: 4230 - DNA, 36 bp, Homo sapiens
gagtgtggggaaggattggtgctggggcaacaggaa

SEQ ID NO: 4231 - DNA, 500 bp, Homo sapiens
atataacctgcaagcatataatacaaaaaaaaattgcaaaactgtttagaacgctaataaaatttatgcagttataaaaatggcattactgcacagttttaagatgatgcagatttttttacagttgtattgtggtgcagaactggattttctgtaacttaaaaaaaaatccacagttttaaaggcaataatcagtaaatgttattttcagggactgacatcctgtctttaaaaagaaatgaaaagtaaatcttaccacaataaatataaaaaaatcttgtcagttacttttcttttacatattttgctgtgcaaaattgttttatatcttgagttactaactaaccacgcgtgttgttcctatgtgcttttctttcattttcaattctggttatatcaagaaaagaataatctacaataataaacggcatttttttttgattctgtactcagtttcttagtgtacagtttaactgggcccaacaacctcgttaaaagtg

SEQ ID NO: 4232 - DNA, 459 bp, Homo sapiens; identical to SEQ ID NO: 3974

SEQ ID NO: 4233 - DNA, 141 bp, Homo sapiens
ctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattg

SEQ ID NO: 4234 - DNA, 419 bp, Homo sapiens
caaatactcctgagatggagcaaagagaaaccacctcttcaacaccacggataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaa

SEQ ID NO: 4235 - DNA, 500 bp, Homo sapiens
cctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaat

SEQ ID NO: 4236 - DNA, 500 bp, Homo sapiens; identical to SEQ ID NO: 3876

SEQ ID NO: 4237 - DNA, 235 bp, Homo sapiens
caacctccgtgaggacggcgagaaggcggcgcgcgaggtcaagctgctgctgctcggtgctggtgaatctggtaaaagtacaattgtgaagcagatgaaaattatccatgaagctggttattcagaagaggagtgtaaacaatacaaagcagtggtctacagtaacaccatccagtcaattattgctatcattagggctatggggaggttgaagatagactttggtgactcagcc

SEQ ID NO: 4238 - DNA, 287 bp, Homo sapiens; identical to SEQ ID NO: 3128

SEQ ID NO: 4239 - DNA, 26 bp, Homo sapiens
ctcagggagttgtcaccactctggag

SEQ ID NO: 4240 - DNA, 87 bp, Homo sapiens; identical to SEQ ID NO: 4019

SEQ ID NO: 4241 - DNA, 231 bp, Homo sapiens
cctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttca

SEQ ID NO: 4242 - DNA, 225 bp, Homo sapiens
gggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataa

SEQ ID NO: 4243 - DNA, 500 bp, Homo sapiens
acctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcc

SEQ ID NO: 4244 - DNA, 163 bp, Homo sapiens
tctgggagactttgaagaccagtcctgtttgcagggaagccccacttgaaggaagaagtctaagagtgaagtaggtgtgacttgaactagattgcatgcttcctcctttgctcttgggaagaccagctttgcagtgacagcttgagtgggttctctgcagccc

SEQ ID NO: 4245 - DNA, 500 bp, Homo sapiens
ttggaggcgaactaaaagaagtagtatctcacaattacttgatagtgatgaagagcttgatagtgaagaatttgatagtgatgaagagcttgatagtgatgaaagttttgaaaatgatgaagagcttgatagtaacaagggacctgattgtaataaaacaccaggaagtgaaagagagctcaacttaagtaaaattcaaagtgaaggaaatgacagtaagtgtctcattaactctggcaacggttcaacatatgaagaagaaacgaacaaaatcaaacataggaatattgacttacaagatcaggaaaaacatttaagtcaagaggataatgatctcaacaaacaaactggacaaataatagaggatgatcaggaaaaacatttaagtcaagaggataatgatctcaacaaacaaactggacaaataatagaggatgatttagaagaagaagacatcaagcgaggaaaaagaaaaaggctatcctctgtgatgtgtgaca

SEQ ID NO: 4246 - DNA, 64 bp, Homo sapiens
aaggcttccacactattcattcaggaaggcatgaatatgcattcagcttcgagcttccacagac

SEQ ID NO: 4247 - DNA, 69 bp, Homo sapiens
aaatgcaccaggtgcacgggggacaatgagaaggtgaaggctcacattctgctgacggctggaatcatc

SEQ ID NO: 4248 - DNA, 439 bp, Homo sapiens
cctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggctattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaaca

SEQ ID NO: 4249 - DNA, 152 bp, Homo sapiens
acctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtg

SEQ ID NO: 4250 - DNA, 500 bp, Homo sapiens
aagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattaca

SEQ ID NO: 4251 - DNA, 411 bp, Homo sapiens
ttgtagaggatcttcagggacaggctctgggcatttagtgaaagggacagcgattcctttgcctatactctggtggtttagaaaaggacctcagggaacatttgttttgttttgttttgttttccttttgattaaggcatttggggtctagaaaagaagattcaagcaggatccatttaatttatttagtttgcctcacagacatgaagcttcagaatggtcgtcccattccacctacatcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggcccc

SEQ ID NO: 4252 - DNA, 188 bp, Homo sapiens
aggagaaccctggggacccagaagaccgtgccttgcccggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactga

SEQ ID NO: 4253 - DNA, 36 bp, Homo sapiens
tcacccacggccgagagccgagctggaggactcctt

SEQ ID NO: 4254 - DNA, 223 bp, Homo sapiens
gggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctc

SEQ ID NO: 4255 - DNA, 500 bp, Homo sapiens; identical to SEQ ID NO: 4010

SEQ ID NO: 4256 - DNA, 48 bp, Homo sapiens
tgaagtgtggggaaaggacaacaaaaagcatgaggaacgtctgggcac

SEQ ID NO: 4257 - DNA, 49 bp, Homo sapiens
gaaaacaaccgggtcatcctggagattgacaatgccaggctggctgtgg

SEQ ID NO: 4258 - DNA, 36 bp, Homo sapiens
agtactgggattatataggcatgagccactgagcct

SEQ ID NO: 4259 - DNA, 266 bp, Homo sapiens
caatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaag

SEQ ID NO: 4260 - DNA, 442 bp, Homo sapiens
cccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctcc

SEQ ID NO: 4261 - DNA, 42 bp, Homo sapiens
tggaacccctcctatgcacggctggacaagcagggcaacttc

SEQ ID NO: 4262 - DNA, 36 bp, Homo sapiens; identical to SEQ ID NO: 4004

SEQ ID NO: 4263 - DNA, 500 bp, Homo sapiens
agctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtca

SEQ ID NO: 4264 - DNA, 305 bp, Homo sapiens
aaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaaggaagggc

SEQ ID NO: 4265 - DNA, 210 bp, Homo sapiens; identical to SEQ ID NO: 4110

SEQ ID NO: 4266 - DNA, 500 bp, Homo sapiens
tgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataa

SEQ ID NO: 4267 - DNA, 44 bp, Homo sapiens
aagaagaattgaaaactgtgacgaacaacttgaagtcactggag

SEQ ID NO: 4268 - DNA, 500 bp, Homo sapiens
agaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacct

SEQ ID NO: 4269 - DNA, 36 bp, Homo sapiens; identical to SEQ ID NO: 3964

SEQ ID NO: 4270 - DNA, 36 bp, Homo sapiens; identical to SEQ ID NO: 4199

SEQ ID NO: 4271 - DNA, 31 bp, Homo sapiens
tctgatcattccaaaccaactgctgaaacgg

SEQ ID NO: 4272 - DNA, 463 bp, Homo sapiens; identical to SEQ ID NO: 4201

SEQ ID NO: 4273 - DNA, 500 bp, Homo sapiens
gcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatc

SEQ ID NO: 4274 - DNA, 257 bp, Homo sapiens
aattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttc

SEQ ID NO: 4275 - DNA, 25 bp, Homo sapiens
gacaggagaaggatgtgtctacctc

SEQ ID NO: 4276 - DNA, 36 bp, Homo sapiens; identical to SEQ ID NO: 4005

SEQ ID NO: 4277 - DNA, 324 bp, Homo sapiens
tccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaac

SEQ ID NO: 4278 - DNA, 97 bp, Homo sapiens
acgagctcatctgcgcctttgtttagaacgcttaaaagttctgattccactaggaccagactgcacccggcacacaacacttggtttgctcaacaaa

SEQ ID NO: 4279 - DNA, 394 bp, Homo sapiens
ctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtc

SEQ ID NO: 4280 - DNA, 500 bp, Homo sapiens
aggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaa

SEQ ID NO: 4281 - DNA, 500 bp, Homo sapiens
aagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggaggctgtcaaggatcatcctagagctgaatacgaagccagagtcttggagaagtctctgaagaaa

SEQ ID NO: 4282 - DNA, 36 bp, Homo sapiens
acacttactgctctccagtttgccagtactgctaaa

SEQ ID NO: 4283 - DNA, 500 bp, Homo sapiens; identical to SEQ ID NO: 3763

SEQ ID NO: 4284 - DNA, 36 bp, Homo sapiens
cgcaggtatttagaagcagagggacaaccagaaggc

SEQ ID NO: 4285 - DNA, 201 bp, Homo sapiens
caccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatcc

SEQ ID NO: 4286 - DNA, 101 bp, Homo sapiens
attcttgcatgagcttccagtgtaaaagaggccacatctgtaaggcagaccaacagggaaaacctcactgtgtctgccaggatccagtgacttgtcctcca

SEQ ID NO: 4287 - DNA, 428 bp, Homo sapiens
gagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttaggcaggtggttatatgtgggaagataattttattcatggatccaaatgtttgttgagtcctttctttgtgctaaggttcttgcggtgaaccagaattataacagtgagctcatctgactgttttaggatgtacagcctagtgttaacattcttggtatctttttg

SEQ ID NO: 4288 - DNA, 96 bp, Homo sapiens; identical to SEQ ID NO: 4216

SEQ ID NO: 4289 - DNA, 81 bp, Homo sapiens
ctcaacatcgcaactgtgttgacctctattcagctgctcatgtcagaacccaaccctgatgacccgctcatggctgacata

SEQ ID NO: 4290 - DNA, 114 bp, Homo sapiens
gtaaaccctgttattttggaaacctacttctgggaattgtaggtgtggacgtgaatctggcttacattcttgaagacgtgacgtattaccaagactctttggcttcctatactt

SEQ ID NO: 4291 - DNA, 189 bp, Homo sapiens
gaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagt

SEQ ID NO: 4292 - DNA, 25 bp, Homo sapiens
gaaagatgaaggaccaaaaggccaa

SEQ ID NO: 4293 - DNA, 500 bp, Homo sapiens
ggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctga

SEQ ID NO: 4294 - DNA, 36 bp, Homo sapiens
cagaaaaggaagagttcccctttgctttaggagtgc

SEQ ID NO: 4295 - DNA, 36 bp, Homo sapiens
actttgagggaaacaaaggcttctaggcgtgaggag

SEQ ID NO: 4296 - DNA, 342 bp, Homo sapiens
atatgactccactcaggggtgtaaaagcaacccaagcatcaaagtctactcagctaaagactaacagaggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttaggaaagacgatggaggtggaatcctttaagattatgtccagttatttgctttaataaagaagaagttacccttgtcaaaa

SEQ ID NO: 4297 - DNA, 195 bp, Homo sapiens
ctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcatt

SEQ ID NO: 4298 - DNA, 115 bp, Homo sapiens
tattccaccaaagaagataaatatgaagaggagatcaaactgttggaggagaagctgaaggaggctgagacccgagcagagtttgccgagaggtctgtggcaaagttggagaaaa

SEQ ID NO: 4299 - DNA, 36 bp, Homo sapiens
agtgctgctgaagaaaagtactctcaaaaagaagat

SEQ ID NO: 4300 - DNA, 25 bp, Homo sapiens
gggagtaaaatgttacgttcggaat

SEQ ID NO: 4301 - DNA, 500 bp, Homo sapiens
aaatcccaagccaaccatactatcatgacatgaactcgggggtcaatcttcagaggtctctgtcttctccaccaagcagcaaaagacccaaaactatatccatagaygaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatcc

SEQ ID NO: 4302 - DNA, 500 bp, Homo sapiens; identical to SEQ ID NO: 4010

SEQ ID NO: 4303 - DNA, 36 bp, Homo sapiens; identical to SEQ ID NO: 4075

SEQ ID NO: 4304 - DNA, 213 bp, Homo sapiens
gggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtcc

SEQ ID NO: 4305 - DNA, 222 bp, Homo sapiens
gaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttctt

SEQ ID NO: 4306 - DNA, 89 bp, Homo sapiens
atgatgggaagacataccacgtaggagaacagtggcagaaggaatatctcggtgccatttgctcctgcacatgctttggaggccagcgg

SEQ ID NO: 4307 - DNA, 36 bp, Homo sapiens
cttaaaagatgaagaaaagatggaactccaggaaat

SEQ ID NO: 4308 - DNA, 486 bp, Homo sapiens
ctcatgagttttccgcttcatcatctgcttctgttttctccatcttagtttgcccaaagcttgctggccgctgtgtagggctggtgagtggctggggctgtctgagccatgaacaacttcagggccaccatcctcttctgggcagcggcagcatgggctaaatcaggcaagccttcgggagagatggacgaagttggagttcaaaaatgcaagaatgccttgaaactacctgtcctggaagtcctacctggagggggctgggacaatctgcggaatgtggacatgggacgagttatggaattgacttactccaactgcaggacaacagaggatggacagtatatcatccctgatgaaatcttcaccattccccagaaacagagcaacctggagatgaactcagaaatcctggaatcctgggcaaattaccagagtagcacctcctactccatcaacacagaactctctcttttttccaaagtcaat

SEQ ID NO: 4309 - DNA, 36 bp, Homo sapiens
acatagattcatggtttgaggagaaggccaatttgg

SEQ ID NO: 4310 - DNA, 500 bp, Homo sapiens
gcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgca

SEQ ID NO: 4311 - DNA, 158 bp, Homo sapiens; identical to SEQ ID NO: 4086

SEQ ID NO: 4312 - DNA, 36 bp, Homo sapiens
ggagaagcgtgtggagcagatccgtgaccacatcaa

SEQ ID NO: 4313 - DNA, 40 bp, Homo sapiens
agaagaattgaaaactgtgacgaacaacttgaagtcactg

SEQ ID NO: 4314 - DNA, 36 bp, Homo sapiens
ctggaccccatcttcaaggtgtttgatgcgatcatg

SEQ ID NO: 4315 - DNA, 401 bp, Homo sapiens
gctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgt

SEQ ID NO: 4316 - DNA, 52 bp, Homo sapiens
gtgagtgtctatgctcttaaggacactttgacaagcagaccagctcagggag

SEQ ID NO: 4317 - DNA, 36 bp, Homo sapiens
ccagccaataggagcccagccaccatggcggagctg

SEQ ID NO: 4318 - DNA, 428 bp, Homo sapiens
cagattgtcttgttattttctggattttggggactcgccatgggagcctttccgagcagcgtgcaaataggtggtctcttcatccgaaacacagatcaggaatacactgcttttcgattagcaatttttcttcataacaccgcccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcacta

SEQ ID NO: 4319 - DNA, 500 bp, Homo sapiens
ctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaatgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacc

SEQ ID NO: 4320 - DNA, 360 bp, Homo sapiens
agcaacctgcccacagtgaagaagtttctacagcctggcagcccaaggaagcctcccatggatgagaaatctttagaagaagcaaggaagattttcaggttttaataacgcagtcatggaggccaagaacttgcaataccaatgttctaaagttttgcaacaataaagtactttacctaagtgttgattgtgcctgttgtgaagctaatgaactctttcaaattatatgctaattaaataatacaactcctattcgctgacttagttaaaattgatttgttttcattaggatctgatgtgaattcagatttccaatcttctcctagccaaccattttcctggaattaaaaattcagtaaa

SEQ ID NO: 4321 - DNA, 320 bp, Homo sapiens
gctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacat

SEQ ID NO: 4322 - DNA, 187 bp, Homo sapiens
acttccactccccaaacttcctgaggatctcagaggtggaaatgagaggttccgaggatgcggcagctggaacagtattgcagcggctgatccaggaacaactgcggtatggcaccccaaccgagaacatgaacttgctggccattcagcaccaggccacagggagtgcaggaccagcccatcctac

SEQ ID NO: 4323 - DNA, 25 bp, Homo sapiens
ggagatctcaagtttcaacaccacg

SEQ ID NO: 4324 - DNA, 449 bp, Homo sapiens
gcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcatttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgccta

SEQ ID NO: 4325 - DNA, 183 bp, Homo sapiens
caaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttca

SEQ ID NO: 4326 - DNA, 500 bp, Homo sapiens
gatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacacc

SEQ ID NO: 4327 - DNA, 500 bp, Homo sapiens
ggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaaga

SEQ ID NO: 4328 - DNA, 36 bp, Homo sapiens; identical to SEQ ID NO: 3998

SEQ ID NO: 4329 - DNA, 142 bp, Homo sapiens
cttggttcctttccaagtgtcaaataggacacccatcttaccggccaatgtccaaaattacggtttgaacataattggagaacctttccttcaagcagaaacaagcaactgagggaaaaagaaacacaacaatagtttaaga

SEQ ID NO: 4330 - DNA, 369 bp, Homo sapiens; identical to SEQ ID NO: 3849

SEQ ID NO: 4331 - DNA, 273 bp, Homo sapiens
aagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaag

SEQ ID NO: 4332 - DNA, 500 bp, Homo sapiens
cctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaggcctgagtcaacactgttttgatggactagataacctggagaccttagacttgagttataataacttgggggaatttcctcaggctattaaagcccgtcctagccttaaagagctaggatttcatagtaatt

SEQ ID NO: 4333 - DNA, 36 bp, Homo sapiens; identical to SEQ ID NO: 4129

SEQ ID NO: 4334 - DNA, 36 bp, Homo sapiens
ctacttcacaaacaacagcgcctgatgcccctcctg

SEQ ID NO: 4335 - DNA, 500 bp, Homo sapiens; identical to SEQ ID NO: 4293

SEQ ID NO: 4336 - DNA, 26 bp, Homo sapiens
ccgttgccgagagatggatgagcaga

SEQ ID NO: 4337 - DNA, 246 bp, Homo sapiens
ctgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctac

SEQ ID NO: 4338 - DNA, 25 bp, Homo sapiens
atttcccccttcagatctaacgatt

SEQ ID NO: 4339 - DNA, 136 bp, Homo sapiens
agtctccggcgagttgttgcctgggctggacgtggttttgtctgctgcgcccgctcttcgcgctctcgtttcattttctgcagcgcgccacgaggatggcccacaagcagatctactactcggacaagtacttcga

SEQ ID NO: 4340 - DNA, 351 bp, Homo sapiens
cagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgcctt

SEQ ID NO: 4341 - DNA, 145 bp, Homo sapiens
agtgtgaacatggctacgcctcttcattcccgtccatgccgagcccccgactgcagcattcaaagcccccacggaggttgagccgggcacagaaacacagcagcgggagcagcaacaccagcactgccaacagatctacacacaa

SEQ ID NO: 4342 - DNA, 36 bp, Homo sapiens
tctgaagacctacctaagaatgcttccaggaccact

SEQ ID NO: 4343 - DNA, 381 bp, Homo sapiens
agagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggtgtactttcttaatgactgaaagataagtgggtagcaccgtcagagagaaaatgttggatctgccctaggttatagtagatgccggaattgcgtaaacccacttctctttaagctgcctgg

SEQ ID NO: 4344 - DNA, 76 bp, Homo sapiens; identical to SEQ ID NO: 3928

SEQ ID NO: 4345 - DNA, 66 bp, Homo sapiens
gacagcactgtttgcttcccagctagacctgtgtgagaggtgtctggaaatcatgcatggtgtatt

SEQ ID NO: 4346 - DNA, 434 bp, Homo sapiens
cgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctg

SEQ ID NO: 4347 - DNA, 464 bp, Homo sapiens
atgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagc

SEQ ID NO: 4348 - DNA, 500 bp, Homo sapiens; identical to SEQ ID NO: 3950

SEQ ID NO: 4349 - DNA, 448 bp, Homo sapiens
ctgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatg

SEQ ID NO: 4350 - DNA, 400 bp, Homo sapiens
ggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggcca

SEQ ID NO: 4351 - DNA, 36 bp, Homo sapiens
aattcaagtgtgaccctcatgaggcaacgtgttatg

SEQ ID NO: 4352 - DNA, 209 bp, Homo sapiens
tgtccggcaccccggtaggcctgattgggtttctagtcctccttaaccacttatctcccatatgagagtgtgaaaaataggaacacgtgctctacctccatttagggatttgcttgggatacagaagaggccatgtgtctcagagctgttaagggcttatttttttaaaacattggagtcatagcatgtgtgtaaactttaaatatgca

SEQ ID NO: 4353 - DNA, 109 bp, Homo sapiens
ttttcaaagcacagtactgttagctgtttttgtggacaggattcgattaagtattccctcttgtcaaactggaagctaggggaaaaagagggatttttatcctttactc

SEQ ID NO: 4354 - DNA, 501 bp, Homo sapiens
ctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccaa

SEQ ID NO: 4355 - DNA, 78 bp, Homo sapiens
tcaagaacatagcaaagaaagtccagctcgtagcacaccccacagaacccccattattactccaaatacaaaggccat

SEQ ID NO: 4356 - DNA, 36 bp, Homo sapiens
ggaggcagtaaattcagggcaagaagcgaaaccctg

SEQ ID NO: 4357 - DNA, 26 bp, Homo sapiens
gcaattgctgagtacaatgctccttg

SEQ ID NO: 4358 - DNA, 38 bp, Homo sapiens
gatatagaagacttagatcactacgagatgaaagcaga

SEQ ID NO: 4359 - DNA, 477 bp, Homo sapiens
atgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggagg

SEQ ID NO: 4360 - DNA, 331 bp, Homo sapiens
ctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttga

SEQ ID NO: 4361 - DNA, 36 bp, Homo sapiens; identical to SEQ ID NO: 3881

SEQ ID NO: 4362 - DNA, 500 bp, Homo sapiens
gataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatc

SEQ ID NO: 4363 - DNA, 36 bp, Homo sapiens
aggctaagaaatgaaaaagaacaagagctggacaca

SEQ ID NO: 4364 - DNA, 242 bp, Homo sapiens
gtaccatgtgccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctcatgctggcttttcaccccagaggacacaggcagcttccaaaatatatttatcttct

SEQ ID NO: 4365 - DNA, 101 bp, Homo sapiens
aacccaccacggacaccataaaccattccgatgcaaactctgctccttcaagtcctcctataacagccggctgaaaacacatatactcaaagctcatgctg

SEQ ID NO: 4366 - DNA, 36 bp, Homo sapiens; identical to SEQ ID NO: 4219

SEQ ID NO: 4367 - DNA, 500 bp, Homo sapiens
attcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgattgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgct

SEQ ID NO: 4368 - DNA, 36 bp, Homo sapiens
tgtgggaaacctgtcgaggacttcatccaggagctg

SEQ ID NO: 4369 - DNA, 36 bp, Homo sapiens
aggccataatggttaaaggtgtggatgaagcaacca

SEQ ID NO: 4370 - DNA, 36 bp, Homo sapiens
ggaaagcgagcacaactgggagacctcccatggcag

SEQ ID NO: 4371 - DNA, 500 bp, Homo sapiens
tcaatgcacggggcagaatggagtccacccggtggctcctggctgcagctggagtagagtttgaagagaaatttataaaatctgcagaagatttggacaagttaagaaatgatggatatttgatgttccagcaagtgccaatggttgagattgatgggatgaagctggtgcagaccagagccattctcaactacattgccagcaaatacaacctctatgggaaagacataaaggagagagccctgattgatatgtatatagaaggtatagcagatttgggtgaaatgatcctccttctgcccgtatgtccacctgaggaaaaagatgccaagcttgccttgatcaaagagaaaataaaaaatcgctacttccctgcctttgaaaaagtcttaaagagccatggacaagactaccttgttggcaacaagctgagccgggctgacattcatctggtggaacttctctactacgtcgaggagcttgactccagtcttatctcc

SEQ ID NO: 4372 - DNA, 36 bp, Homo sapiens
gcataatggaaaaaacacaatcacttcctacacgac

SEQ ID NO: 4373 - DNA, 39 bp, Homo sapiens; identical to SEQ ID NO: 4202

SEQ ID NO: 4374 - DNA, 387 bp, Homo sapiens
gcccagcctttcgcccaggcgcccaggcccgctgcgcgcgtgcgtgagcgcgcctgcgccgccagggccgctgcaaggggaggagagcggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccag

SEQ ID NO: 4375 - DNA, 394 bp, Homo sapiens; identical to SEQ ID NO: 4279

SEQ ID NO: 4376 - DNA, 477 bp, Homo sapiens
agtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagt

SEQ ID NO: 4377 - DNA, 44 bp, Homo sapiens
ccaaagacataacctcagacacatctggagattttcggaacgct

SEQ ID NO: 4378 - DNA, 500 bp, Homo sapiens; identical to SEQ ID NO: 3737

SEQ ID NO: 4379 - DNA, 213 bp, Homo sapiens; identical to SEQ ID NO: 4304

SEQ ID NO: 4380 - DNA, 500 bp, Homo sapiens
aatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagac

SEQ ID NO: 4381 - DNA, 84 bp, Homo sapiens
ggaggcagtggcgttggtgggaagcgcagctcgaaaagcgatgccgattctggtttcctggggctgcggcccacttcggtggac

SEQ ID NO: 4382 - DNA, 314 bp, Homo sapiens
ggaagtttgcagattccttaaatgaatttaaatttcagtgcataggagatgcagaaacagatgatgagatgtgtatagcaaggtctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaaatatgacaaagagacagaaaagtattgtggcatcttagaaaaacacttgaatttgtcttccaaaaagaaagaatctcagcttcaggag

SEQ ID NO: 4383 - DNA, 36 bp, Homo sapiens
cccgccatgcgtatgaagggagctccagtggcaact

SEQ ID NO: 4384 - DNA, 36 bp, Homo sapiens
tcatggacttcttccaaacttatggagccattcaag

SEQ ID NO: 4385 - DNA, 54 bp, Homo sapiens
agcactggatttggaaactttgaggaaattgggccccttgacagtgatctcaaa

SEQ ID NO: 4386 - DNA, 288 bp, Homo sapiens
gaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccag

SEQ ID NO: 4387 - DNA, 354 bp, Homo sapiens; identical to SEQ ID NO: 3912

SEQ ID NO: 4388 - DNA, 36 bp, Homo sapiens
taccaaaatagcctgcagatctccacaaccagaccc

SEQ ID NO: 4389 - DNA, 36 bp, Homo sapiens
tctgtttcctggcctcagagcttcctggggaccaag

SEQ ID NO: 4390 - DNA, 36 bp, Homo sapiens
aggcatagactagatatggaacgagagcgaaggcga

SEQ ID NO: 4391 - DNA, 353 bp, Homo sapiens
tgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctg

SEQ ID NO: 4392 - DNA, 330 bp, Homo sapiens
attctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtg

SEQ ID NO: 4393 - DNA, 386 bp, Homo sapiens
aaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtgtagttgtgtatgttttt

SEQ ID NO: 4394 - DNA, 115 bp, Homo sapiens
cagtggctcgtgtatgatcagcagcgggaagtctatgtaaaaggacttttagcaaagatctttgagttggaaaagaaaacggaaacagctgctcattcactcccacagcagacaa

SEQ ID NO: 4395 - DNA, 36 bp, Homo sapiens
ggggcggcgttggtggtcttcgcggcgcaactcggc

SEQ ID NO: 4396 - DNA, 36 bp, Homo sapiens
aagtttgtgcagtacgaggtgggtgcaggagccgat

SEQ ID NO: 4397 - DNA, 357 bp, Homo sapiens
gccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcatt

SEQ ID NO: 4398 - DNA, 141 bp, Homo sapiens
atggaagcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagt

SEQ ID NO: 4399 - DNA, 26 bp, Homo sapiens
tgtgacgaacaacttgaagtcactgg

SEQ ID NO: 4400 - DNA, 500 bp, Homo sapiens
catcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccacatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccag

SEQ ID NO: 4401 - DNA, 192 bp, Homo sapiens; identical to SEQ ID NO: 3452

SEQ ID NO: 4402 - DNA, 142 bp, Homo sapiens
tttgtcagtataaagagacagatcatactgtgtatggaagaattagaccacaccccagacacaagctttgaaagagatgtggtgtgtgaagacgaagatgccttttgtttgtctttggagaatattgcaacactacaaaagt

SEQ ID NO: 4403 - DNA, 328 bp, Homo sapiens
agttccctgctgtctttatatcggaaaggaaatcctgattctgtttcaaatactcctgagatggagcaaagagaaaccacctcttcaacaccacggataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaa

SEQ ID NO: 4404 - DNA, 271 bp, Homo sapiens
aaatatgaagaggagatcaaactgttggaggagaagctgaaggaggctgagacccgagcagagtttgccgagaggtctgtggcaaagttggagaaaaccatcgatgacctagaagagaccttggccagtgccaaggaggagaacgtcgagattcaccagaccttggaccagaccctgctggaactcaacaacctgtgagggccagccccacccccagccaggctatggttgccaccccaacccaataaaactgatgttactagcctctcaa

SEQ ID NO: 4405 - DNA, 83 bp, Homo sapiens
tcagttcaacgtcgaggtcggcagaagtgacaagctttccctgcctggctttgagaacctcacagcaggatataacaaatttc

SEQ ID NO: 4406 - DNA, 65 bp, Homo sapiens
tcggacccagtggatgaggaagtgctgatgtcgctggtggtggaactggggttggaccgagccaa

SEQ ID NO: 4407 - DNA, 114 bp, Homo sapiens
gcccagtggacaccacccaatgttcagctcactggatatcgagtgcgggtgacccccaaggagaagaccggaccaatgaaagaaatcaaccttgctcctgacagctcatccgtg

SEQ ID NO: 4408 - DNA, 160 bp, Homo sapiens
tcttctgatagtctagccaaggtccaagaagtagcaagctggcttttggaaatgaatcaggaactgctctctgtgggcagcaaaagacgacgaactggaggctctctgagaggtaacccttcctcaagccaggtagatgaagaacagatgaatcgtgtgg

SEQ ID NO: 4409 - DNA, 500 bp, Homo sapiens
gccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacagctgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccac

SEQ ID NO: 4410 - DNA, 87 bp, Homo sapiens
tacccatttgaacctcctcagatccgatttctcactccaatttatcatccaaacattgattctgctggaaggatttgtctggatgtt

SEQ ID NO: 4411 - DNA, 230 bp, Homo sapiens
ctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggac

SEQ ID NO: 4412 - DNA, 471 bp, Homo sapiens
cagcatagcatatcatatactttgtctcgggcccagactgtggtggttgaatatactcatgacagcaacacagatatgtttcagattggccggtcgactgaaagccccattgattttgtagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggagaaggctgccaaatggaagacatcagatggacagatggatggcttgaccactaatggtgttcttgtgatgcatccacgcaatgggttcacagaagactccaagcctggaatatggagagaaatatcggtgtgtggaaatgtatttagcctacgtgaaaccagatcggctcagcagagaggaaaaatg

SEQ ID NO: 4413 - DNA, 500 bp, Homo sapiens
aagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccaca

SEQ ID NO: 4414 - DNA, 193 bp, Homo sapiens
aaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcaga

SEQ ID NO: 4415 - DNA, 436 bp, Homo sapiens
gtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgc

SEQ ID NO: 4416 - DNA, 36 bp, Homo sapiens
gcccattagtgggaaaaagttggaggatgaaggaat

SEQ ID NO: 4417 - DNA, 373 bp, Homo sapiens
ctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagag

SEQ ID NO: 4418 - DNA, 36 bp, Homo sapiens; identical to SEQ ID NO: 4199

SEQ ID NO: 4419 - DNA, 205 bp, Homo sapiens
tccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctca

SEQ ID NO: 4420 - DNA, 36 bp, Homo sapiens
gaaccctttcccacgaacgtccacttcaaaagaacg

SEQ ID NO: 4421 - DNA, 183 bp, Homo sapiens
aatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaacaaacatgtgagatcagaaa

SEQ ID NO: 4422 - DNA, 500 bp, Homo sapiens
agccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaag

SEQ ID NO: 4423 - DNA, 249 bp, Homo sapiens
gtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtg

SEQ ID NO: 4424 - DNA, 500 bp, Homo sapiens
cccggagcccacgggtctggtgatgccatagcagccaccaccgcggcgcctagggctgcggcagggactcggcctctgggaggtttacctcgcccccacttgtgcccccagctcagcccccctgcacgcagcccgactagcagtctagaggcctgaggcttctgggtcctggtgacggggctggcatgaccccgggggtcgtccatgccagtccgcctcagtcgcagagggtccctcggcaagcgccctgtgagtgggccattcggaacattggacagaagcccaaagagccaaattgtcacaattgtggaacccacattggcctgagatccaaaacgcttcgaggcaccccaaattacctgcccattcgtcaggacacccacccacccagtgttatattctgcctcgccggagtgggtgttcccgggggcacttgccgaccagccccttgcgtccccaggtttgcagctctcccctgggccactaaccatcctggcccg

SEQ ID NO: 4425 - DNA, 500 bp, Homo sapiens
cagcgatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttagggaggaaaagctgaactccttaaaactaaagatgactaagaatggcacagtagaatcagaagaagccagcactcttacactggatgacatttctgatgatgacattgacctggacaac

SEQ ID NO: 4426 - DNA, 335 bp, Homo sapiens
caaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgc

SEQ ID NO: 4427 - DNA, 169 bp, Homo sapiens
aagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacatta

SEQ ID NO: 4428 - DNA, 419 bp, Homo sapiens
agaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccag

SEQ ID NO: 4429 - DNA, 36 bp, Homo sapiens
agcattggagaaaatcaggtagaggtgatggtggaa

SEQ ID NO: 4430 - DNA, 453 bp, Homo sapiens
aaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaag

SEQ ID NO: 4431 - DNA, 500 bp, Homo sapiens
aacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgca

SEQ ID NO: 4432 - DNA, 36 bp, Homo sapiens
accatcaacagctacgagatgcgaaatgcagtcaac

SEQ ID NO: 4433 - DNA, 43 bp, Homo sapiens
gggagaggggaagcagatctgaggacatctctgtgccaggcca

SEQ ID NO: 4434 - DNA, 36 bp, Homo sapiens
agaggagcaccaccccagacattactggttatagaa

SEQ ID NO: 4435 - DNA, 36 bp, Homo sapiens
cagtctgttctcctccagctccttctttctgcaaca

SEQ ID NO: 4436 - DNA, 106 bp, Homo sapiens
gatgaagctaccaaaaaggcctgttacagcaaaggcaaatcaaaggaggaatgtcagaactacatccgggtgcttctggtgggtggcgaccggttattcacctgtg

SEQ ID NO: 4437 - DNA, 36 bp, Homo sapiens; identical to SEQ ID NO: 4004

SEQ ID NO: 4438 - DNA, 432 bp, Homo sapiens
cctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgag

SEQ ID NO: 4439 - DNA, 117 bp, Homo sapiens
atatgtcttctccgactactatgaagaagcctgaaaagccattgttcagctctgcatctccacaggattcttccccaagactgagcactttcccccagcaccaccatcccggaatac

SEQ ID NO: 4440 - DNA, 170 bp, Homo sapiens
ggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagag

SEQ ID NO: 4441 - DNA, 36 bp, Homo sapiens; identical to SEQ ID NO: 3885

SEQ ID NO: 4442 - DNA, 34 bp, Homo sapiens
tgcaaggatgatgctgaaaggaataacaaggctt

SEQ ID NO: 4443 - DNA, 405 bp, Homo sapiens; identical to SEQ ID NO: 4128

SEQ ID NO: 4444 - DNA, 379 bp, Homo sapiens
cctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacg

SEQ ID NO: 4445 - DNA, 36 bp, Homo sapiens; identical to SEQ ID NO: 4199

SEQ ID NO: 4446 - DNA, 486 bp, Homo sapiens
aaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaa

SEQ ID NO: 4447 - DNA, 36 bp, Homo sapiens
gagtctcgggtctctgaaatccacagccttgttcat

SEQ ID NO: 4448 - DNA, 36 bp, Homo sapiens; identical to SEQ ID NO: 4317

SEQ ID NO: 4449 - DNA, 156 bp, Homo sapiens; identical to SEQ ID NO: 4112

SEQ ID NO: 4450 - DNA, 500 bp, Homo sapiens; identical to SEQ ID NO: 4235

SEQ ID NO: 4451 - DNA, 308 bp, Homo sapiens
ccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacaccccaaaaccagcagtaagtgatgagaaaaatatcaacacatttgtggaaactccagtgcagaaactggacc

SEQ ID NO: 4452 - DNA, 133 bp, Homo sapiens
ctatttgtggataatcccgtgggcactgggttcagttatgtgaatggtagtggtgcctatgccaaggacctggctatggtggcttcagacatgatggttctcctgaagaccttcttcagttgccacaaagaat

SEQ ID NO: 4453 - DNA, 219 bp, Homo sapiens
cgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactc

SEQ ID NO: 4454 - DNA, 221 bp, Homo sapiens; identical to SEQ ID NO: 3924

SEQ ID NO: 4455 - DNA, 36 bp, Homo sapiens
acaagagcatttaactgcaaactgttgtcgttgtca

SEQ ID NO: 4456 - DNA, 135 bp, Homo sapiens
tttgtcagtataaagagacagatcatactgtgtatggaagaattagaccacaccccagacacaagctttgaaagagatgtggtgtgtgaagacgaagatgccttttgtttgtctttggagaatattgcaacacta

SEQ ID NO: 4457 - DNA, 394 bp, Homo sapiens
tggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtg

SEQ ID NO: 4458 - DNA, 229 bp, Homo sapiens; identical to SEQ ID NO: 3330

SEQ ID NO: 4459 - DNA, 501 bp, Homo sapiens
taaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaag

SEQ ID NO: 4460 - DNA, 500 bp, Homo sapiens; identical to SEQ ID NO: 3498

SEQ ID NO: 4461 - DNA, 36 bp, Homo sapiens
caaaaggcaaaaacaaaggagctgatggcaaagaag

SEQ ID NO: 4462 - DNA, 42 bp, Homo sapiens
tgatggatctgcagcatgggagcttatttcttcagacaccta

SEQ ID NO: 4463 - DNA, 36 bp, Homo sapiens
gtctttttcggtgtgaaggtgggatgcaggcttcct

SEQ ID NO: 4464 - DNA, 36 bp, Homo sapiens; identical to SEQ ID NO: 4199

SEQ ID NO: 4465 - DNA, 500 bp, Homo sapiens
tgaccgtctctgttcttcccatacgcgaatggcaggcatccagatctccaagaatagaggattaggagagactccaccacctatgtcctcacagttaattatcgatttgtgtcacttgcccattttctcacttcctgtttgtgtgtcaaggagtattaataaatctttgcctatttaaagatactagccttggattttcaaatattgcatattttgacatgtaaaaatgtgttagttttattttttcaaccgatctgacctgtatagttgggcttgaggaagcttcctcattgtacatgttactatggattttctaatattaacacagggttgtattttttccatataactttctattgaatttctttttccatatgataggtggtgaaggtttagcccagtaaagcagagaggttaagaggttagactgggggctctggagccagacctatgtagatctgagtcctggctctggcacttgaaagccgtgtgaccttggt

SEQ ID NO: 4466 - DNA, 470 bp, Homo sapiens
acatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcag

SEQ ID NO: 4467 - DNA, 36 bp, Homo sapiens; identical to SEQ ID NO: 4219

SEQ ID NO: 4468 - DNA, 56 bp, Homo sapiens
aagcatgctggcgagcgcgataagaagctggcggccaagaaaaagacggacaagaa

SEQ ID NO: 4469 - DNA, 37 bp, Homo sapiens
tcatcaaatgaggaggaaacgtcaagtgaaggcaaca

SEQ ID NO: 4470 - DNA, 145 bp, Homo sapiens; identical to SEQ ID NO: 4341

SEQ ID NO: 4471 - DNA, 228 bp, Homo sapiens
tggtcacttaagtgtgaatttggagtatgcaccaactgaaggtacattggacataaaagaagatatgattgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaa

SEQ ID NO: 4472 - DNA, 500 bp, Homo sapiens
ctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctag

SEQ ID NO: 4473 - DNA, 267 bp, Homo sapiens
gatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagaca

SEQ ID NO: 4474 - DNA, 36 bp, Homo sapiens
aaagaattacagcaaaagactgagaactatgagcag

SEQ ID NO: 4475 - DNA, 169 bp, Homo sapiens
tataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctcca

SEQ ID NO: 4476 - DNA, 36 bp, Homo sapiens
cttgaagcagctggctgagaaacgagagcacgagaa

SEQ ID NO: 4477 - DNA, 36 bp, Homo sapiens
tgctgatgagagtgagagaggtatgaaggttattga

SEQ ID NO: 4478 - DNA, 77 bp, Homo sapiens
gtgtggatgaagcaaccatcattgacattctaactaagcgaaacaatgcacagcgtcaacagatcaaagcagcatat

SEQ ID NO: 4479 - DNA, 323 bp, Homo sapiens
tagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaa

SEQ ID NO: 4480 - DNA, 343 bp, Homo sapiens
ttgggggacagaaggaagtgcattaattccttccacgacccctgaagagcagcggtgggtctgagcatcctatctccaggaagcaggccagcaggcaagccagctgccacctcgtcctgtgcaaagcacaggcaccgtccccaaaagatttccaaagatgatgttaaacccagccacggttctgatctccaggaaagcaattgctgtggtacaaaaggacaagggttaaaagagaacagtgggagctctctttcccagctaactcacgcagtgtgacgcagaggctttcagcacagcccagggtgcccgggactgaaaactccttcaccagccccctccacag

SEQ ID NO: 4481 - DNA, 500 bp, Homo sapiens
ggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaa

SEQ ID NO: 4482 - DNA, 36 bp, Homo sapiens
atggcagccaaagatagggggacaacaaaggaagta

SEQ ID NO: 4483 - DNA, 408 bp, Homo sapiens
ctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctggg

SEQ ID NO: 4484 - DNA, 501 bp, Homo sapiens
ggcagcctggcgcgcggcgcccgccaggcgcccagtcctctgccatcgcccacgcctccctggtgccagggaacaggtatcagcgcgcctccccagcggctgggagagacgctgaatgaagaagagggaaggacggttagtcagcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatata

SEQ ID NO: 4485 - DNA, 36 bp, Homo sapiens
tttgctgcacgtggaaaggacaacaacatacctgga

SEQ ID NO: 4486 - DNA, 263 bp, Homo sapiens
atggaagcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctg

SEQ ID NO: 4487 - DNA, 36 bp, Homo sapiens; identical to SEQ ID NO: 3706

SEQ ID NO: 4488 - DNA, 500 bp, Homo sapiens
attgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaagg

SEQ ID NO: 4489 - DNA, 36 bp, Homo sapiens
ctggagttgcacacagtgtcatctcaactcgaactc

SEQ ID NO: 4490 - DNA, 36 bp, Homo sapiens
atggcctcagaggaggagtattccaccaaagaagat

SEQ ID NO: 4491 - DNA, 450 bp, Homo sapiens
gcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgaggaactcaataaagtgctttgaaaatgctgag

SEQ ID NO: 4492 - DNA, 168 bp, Homo sapiens
gcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgaggg

SEQ ID NO: 4493 - DNA, 36 bp, Homo sapiens
gaggctcaggctgagaagtactcgcagaaggaagac

SEQ ID NO: 4494 - DNA, 36 bp, Homo sapiens; identical to SEQ ID NO: 4474

SEQ ID NO: 4495 - DNA, 36 bp, Homo sapiens
acaaatctacgacaccaggaggaacaggaattaagc

SEQ ID NO: 4496 - DNA, 36 bp, Homo sapiens
ttcctcatttccattcaggatgccggctttattaac

SEQ ID NO: 4497 - DNA, 31 bp, Homo sapiens
acgccacatggtcatgtgtttctgtgtgaat

SEQ ID NO: 4498 - DNA, 78 bp, Homo sapiens
accgatgaccagttaatctgtgccttgtgtaaactggttgggcggcaccgcgatcatcaggtggcagctttgagtgag

SEQ ID NO: 4499 - DNA, 171 bp, Homo sapiens
caatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaag

SEQ ID NO: 4500 - DNA, 216 bp, Homo sapiens; identical to SEQ ID NO: 4195

SEQ ID NO: 4501 - DNA, 249 bp, Homo sapiens
cctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatca

SEQ ID NO: 4502 - DNA, 291 bp, Homo sapiens; identical to SEQ ID NO: 3960

SEQ ID NO: 4503 - DNA, 36 bp, Homo sapiens; identical to SEQ ID NO: 4199

SEQ ID NO: 4504 - DNA, 291 bp, Homo sapiens
agccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaag

SEQ ID NO: 4505 - DNA, 98 bp, Homo sapiens
tccttgaaccgtaggatccagctggttgaagaagagctggaccgtgctcaggagcgcctggccactgccctgcaaaagctggaagaagctgaaaaagc

SEQ ID NO: 4506 - DNA, 413 bp, Homo sapiens; identical to SEQ ID NO: 3732

SEQ ID NO: 4507 - DNA, 36 bp, Homo sapiens
tcgtgtggctgatcaaagaaagaaggcatacgcaga

SEQ ID NO: 4508 - DNA, 113 bp, Homo sapiens
ggtgagtgagataaccaatgccaaactttttgaagtctaatttttgaggggtgagctcatttcattctctagtgtctaaaacctggtatgggtttggccagcgtcatggaaag

SEQ ID NO: 4509 - DNA, 500 bp, Homo sapiens; identical to SEQ ID NO: 4266

SEQ ID NO: 4510 - DNA, 500 bp, Homo sapiens
cctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccacc

SEQ ID NO: 4511 - DNA, 36 bp, Homo sapiens
atcattgagattttgcagtttatcctgagtgtcaga

SEQ ID NO: 4512 - DNA, 219 bp, Homo sapiens; identical to SEQ ID NO: 4453

SEQ ID NO: 4513 - DNA, 45 bp, Homo sapiens
gtggcacccacagtcagtggaacaagccgagtaagccaaaaacca

SEQ ID NO: 4514 - DNA, 501 bp, Homo sapiens
ccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccataatggtgggtcgccccggatcccgttcagcaccttccagtttctctacacgtatattgccaaagtggatggggagatctctgcatcacatgtcagcaggatgctaaactacatggaacaggaagtaattggccctgatggtataatcacagtgaatgactttacccaaaaccccagggttcagctgga

SEQ ID NO: 4515 - DNA, 213 bp, Homo sapiens
gagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaaga

SEQ ID NO: 4516 - DNA, 36 bp, Homo sapiens; identical to SEQ ID NO: 4012

SEQ ID NO: 4517 - DNA, 145 bp, Homo sapiens
cctcttcattcccgtccatgccgagcccccgactgcagcattcaaagcccccacggaggttgagccgggcacagaaacacagcagcgggagcagcaacaccagcactgccaacagatctacacacaatgagctggaaaagaatcg

SEQ ID NO: 4518 - DNA, 36 bp, Homo sapiens; identical to SEQ ID NO: 4493

SEQ ID NO: 4519 - DNA, 500 bp, Homo sapiens; identical to SEQ ID NO: 4153

SEQ ID NO: 4520 - DNA, 369 bp, Homo sapiens
cagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaag

SEQ ID NO: 4521 - DNA, 36 bp, Homo sapiens
ctaccaaaatagcctgcaatctccacaaccagaccc

SEQ ID NO: 4522 - DNA, 36 bp, Homo sapiens; identical to SEQ ID NO: 4004

SEQ ID NO: 4523 - DNA, 500 bp, Homo sapiens
acctatagagcttcagctattataattcagagatggtatcgaggtattaaaattacaaaccatcagcataaggagtatcttaatttgaagaagacagcaattaaaatccaatctgtttatagaggtattagagttagaagacatattcaacacatgcacagggcagccacttttattaaagccatgtttaaaatgcatcagtcaagaataagttaccatacaatgagaaaagcagctattgttattcaagtaagatgtagagcatattatcaaggtaaaatgcagcgtgaaaagtacctgacaattttgaaagctgttaaagtccttcaggcaagttttagaggagtaagagttagacggactcttagaaagatgcagactgcagcaacactcattcagtcaaactacagaagatacagacagcaaacatactttaataagttaaagaaaataacaaaaacagtacagcaaagatactgggcaatgaaagaaagaaacat

SEQ ID NO: 4524 - DNA, 85 bp, Homo sapiens
gcagagacccgtgctgagtttgctgagagatcggtagccaagctggaaaagacaattgatgacctggaagataaactgaaatgca

SEQ ID NO: 4525 - DNA, 25 bp, Homo sapiens
atgcccctttcccacagtcttttat

SEQ ID NO: 4526 - DNA, 115 bp, Homo sapiens; identical to SEQ ID NO: 4298

SEQ ID NO: 4527 - DNA, 101 bp, Homo sapiens
agtgtaaaagaggccacatctgtaaggcagaccaacagggaaaacctcactgtgtctgccaggatccagtgacttgtcctccaacaaaaccccttgatcaa

SEQ ID NO: 4528 - DNA, 320 bp, Homo sapiens
atggaagcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgaca

SEQ ID NO: 4529 - DNA, 500 bp, Homo sapiens
attgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagtt

SEQ ID NO: 4530 - DNA, 328 bp, Homo sapiens
cagattgtcttgttattttctggattttggggactcgccatgggagcctttccgagcagcgtgcaaataggtggtctcttcatccgaaacacagatcaggaatacactgcttttcgattagcaatttttcttcataacaccgcccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatct

SEQ ID NO: 4531 - DNA, 211 bp, Homo sapiens
ccgttgaggttggagagggaaaataaagaagctgccacctaacaggagtcacccaggaaagcaccgcacaggctggcgcgggacagactcctaacctggggcctctgcagtggcaggcgaggctgcaggaggcccacagataagctggcaagaggaaggatcccaggcacatggttcatcacgagcatgagggaacagcaaggggcacggt

SEQ ID NO: 4532 - DNA, 358 bp, Homo sapiens
cctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaag

SEQ ID NO: 4533 - DNA, 500 bp, Homo sapiens; identical to SEQ ID NO: 4422

SEQ ID NO: 4534 - DNA, 245 bp, Homo sapiens
acttcattaaatctagaggcagttgagcatgggagccgtctgtatgttgaattagggctcgcactcttgcgcaacacgtcaccagtcggaaactgggggtttgcttctgtgatttatttcattattgtgctgctgatgaagagactagcagctcgctgctttgctggcttgttaattttatccccactaactgtgatttctgatagccggcctgctgatagtggtaagtgctgctggctctggtt

SEQ ID NO: 4535 - DNA, 115 bp, Homo sapiens
cctcttcattcccgtccatgccgagcccccgactgcagcattcaaagcccccacggaggttgagccgggcacagaaacacagcagcgggagcagcaacaccagcactgccaacag

SEQ ID NO: 4536 - DNA, 36 bp, Homo sapiens
caccagccccctccacaggatatagaagacttagat

SEQ ID NO: 4537 - DNA, 500 bp, Homo sapiens
aatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagc

SEQ ID NO: 4538 - DNA, 160 bp, Homo sapiens
gtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaaca

SEQ ID NO: 4539 - DNA, 192 bp, Homo sapiens
gctggaatttactgggttcatctgattgaccacttctgtgctggatggggcattttaattgcagctatactggagctagttggaatcatctggatttatggagggaacagattcattgaggatacagaaatgatgattggagcaaagaggtggatattctggctatggtggagagcttgctggtttgtaatt

SEQ ID NO: 4540 - DNA, 445 bp, Homo sapiens
tctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagagtggagcagaaagaggcagaagtcggagagctgcaga

SEQ ID NO: 4541 - DNA, 285 bp, Homo sapiens
tcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttg

SEQ ID NO: 4542 - DNA, 36 bp, Homo sapiens; identical to SEQ ID NO: 4199

SEQ ID NO: 4543 - DNA, 501 bp, Homo sapiens
tgcctgggtggtctttaccagcttagactctaccatgggcccccatgaagctccattctcaatactgaataattattacttcccttgttgagtttctttttctgtcatgccctgggggcttctgctcttctcaccagaaagaacatttgaatctggattcttgtacacctgggttagaccctgttcagaggtgtggccaatttatcccgatctcctggaaggctgttgtgatttccatctaagaaatgagggtcttgagaatcaaccagtcccaagattagcctgttatcctgttatctactgagaccccaaatttctcaccaatgttttgggagatcctggaaaagatcccttcagtttagggtgtcaccaagacttctacacaacccaggactaccattgacctcagagctgtaccccacatcttgaagtaaattgatcccaccaggtcccacgtttgttatctctgcctaaatgttagcttctccatcctcaccacat

SEQ ID NO: 4544 - DNA, 36 bp, Homo sapiens
ttgctggtgggttagtggtcctcaggatgtgataga

SEQ ID NO: 4545 - DNA, 500 bp, Homo sapiens; identical to SEQ ID NO: 4422

SEQ ID NO: 4546 - DNA, 500 bp, Homo sapiens
atgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaag

SEQ ID NO: 4547 - DNA, 36 bp, Homo sapiens
ctgaggagccgcccgaagccctccaaggccagtcca

SEQ ID NO: 4548 - DNA, 249 bp, Homo sapiens; identical to SEQ ID NO: 4085

SEQ ID NO: 4549 - DNA, 267 bp, Homo sapiens
ctgccgcctgcaccggacccggagccgccatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaacca

SEQ ID NO: 4550 - DNA, 36 bp, Homo sapiens
aagaaaatgttcaaacagacatggatggataatatg

SEQ ID NO: 4551 - DNA, 500 bp, Homo sapiens
gtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaatt

SEQ ID NO: 4552 - DNA, 410 bp, Homo sapiens
ggcggtggccggtgcggcgtgttcggtggctctggccgctcaggccgtgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcgg

SEQ ID NO: 4553 - DNA, 501 bp, Homo sapiens
agaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacacttaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaat

SEQ ID NO: 4554 - DNA, 36 bp, Homo sapiens
aagatcctgcattctcaggttgctggcagactgatc

SEQ ID NO: 4555 - DNA, 90 bp, Homo sapiens
atgtgtggcctgtgtgggaactacaacggcgaccccaaggatgacttccagaagcccaatggctcacaggcaggcaacgccaatgagttc

SEQ ID NO: 4556 - DNA, 151 bp, Homo sapiens
ggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgat

SEQ ID NO: 4557 - DNA, 36 bp, Homo sapiens; identical to SEQ ID NO: 4493

SEQ ID NO: 4558 - DNA, 36 bp, Homo sapiens; identical to SEQ ID NO: 3600

SEQ ID NO: 4559 - DNA, 305 bp, Homo sapiens
acctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggctggaaagagctcttccagacaccagtatgcactgacaagcccacgactcacgagaaaactaccaaaatagcctgca

SEQ ID NO: 4560 - DNA, 45 bp, Homo sapiens
tgattgatgaattgaataaattgaagaacgaaggacctcagagga

SEQ ID NO: 4561 - DNA, 36 bp, Homo sapiens; identical to SEQ ID NO: 4031

SEQ ID NO: 4562 - DNA, 313 bp, Homo sapiens
aatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaag

SEQ ID NO: 4563 - DNA, 500 bp, Homo sapiens; identical to SEQ ID NO: 3332

SEQ ID NO: 4564 - DNA, 36 bp, Homo sapiens
agaagagccgacaggagctggagaagctgaaacgga

SEQ ID NO: 4565 - DNA, 36 bp, Homo sapiens
tttcctggaacagcagtggtcgcgcctgcaggcccg

SEQ ID NO: 4566 - DNA, 496 bp, Homo sapiens
tataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaa

SEQ ID NO: 4567 - DNA, 417 bp, Homo sapiens
gcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgat

SEQ ID NO: 4568 - DNA, 248 bp, Homo sapiens
attgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagct

SEQ ID NO: 4569 - DNA, 376 bp, Homo sapiens
cggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaa

SEQ ID NO: 4570 - DNA, 132 bp, Homo sapiens
ctgtcttctaactgggcttacttaaaggatgcgagcaaaatgcaggcttaccaggatatcaaagcaaaggaagaacaggaactgcaagatatccagtctcggtcaaaagaacaactcaattcttacacataa

SEQ ID NO: 4571 - DNA, 31 bp, Homo sapiens
gtgagaaccctgacccctaatcccactgcat

SEQ ID NO: 4572 - DNA, 203 bp, Homo sapiens
gctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaag

SEQ ID NO: 4573 - DNA, 25 bp, Homo sapiens
actcctaaggaaaaggcccaggctc

SEQ ID NO: 4574 - DNA, 500 bp, Homo sapiens
aaaattccaaccaaaacagggagctgatggcagtacacttaaaaaccctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatc

SEQ ID NO: 4575 - DNA, 500 bp, Homo sapiens
cacaggcgcccgccaccacgcccggctaattttttgtatttttagtagagacagggtttcaccatgttagccaggatggtctcgatctcctgacctcatgatctgcctgcctcagtctcccaaagtgctgagattacaggcgtgagccaccgtgcctggcctgctgcagagtttttaacgggctctaataagttacttccacgtgaaattccaagaaggagtggtagcacttcccaaacgttttaaaccatggaatcttctttcataagcgttttgtgggacaatcatttcataaaaaacatttcggtgacaacaaatatagactagcccctgagacctaaacttttaatatttaatttatgccatctatctgattactaactctcaaagggtctgtggttccagatgagttctatgaccatgttctttgccacccacccacccttactctcccaagatcatatcagccacaggtcccagtagaagatatgaaaaaggtc

SEQ ID NO: 4576 - DNA, 383 bp, Homo sapiens
aacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaat

SEQ ID NO: 4577 - DNA, 25 bp, Homo sapiens
atgagtttgcaattgctgagtacaa

SEQ ID NO: 4578 - DNA, 204 bp, Homo sapiens
atgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacaccta

SEQ ID NO: 4579 - DNA, 822 bp, Homo sapiens
gctgaggcgagggattttaggtgatgggaagatcagaaagtcagatggatattactgatatcaatgctccaaagccgaagaagaaacagcgatggactccactggagatcagcctttctgtgctcgtcttgctcctgactatcatagctgtgacaatgattgctctctatgcaacctatgatgatggtatttgcaaatcatcagactgcataaaatcagtcttccccgccggcattttgcagcccccattctttagtgctcggcagtccaactcattgaactatgggggcatcggcatggtcatcggacatgaaatcacacatggctttgatgacaatggcagaaattttaacaaagatggagacctcgttgactggtggactcagcagtctgcaaataatttcaaagaccaatcccagtgtatggtgtaccagtatggaaactttacatgggacctagcaggtggacagcatctcaatggaattaacacactaggagaaaatattgctgataatggagggattggccaagcatacagagcctatcagaattatgttaaaaagaatggtgaagaaaaattactccctggacttgacctcaatcacaaacaactattcttcttgaactttgcccaggtgtggtgtggaacctaccggccagagtatgcagtcaattccattaaaacagatgtacacagtcctggcaatttcaggatcattgggactttgcagaactctgctgagtttgcggatgcctttcattgccgcaagaactcatacatgaatccagaaaggaaatgtcgggtttggtgatcttcacagg

SEQ ID NO: 4580 - DNA, 431 bp, Homo sapiens
  misc_feature (75)..(75): n is a, c, g, or t
gagcagcccagcgtgcccattccagcgcccgcgtccccgcagcatgccgagcccccgcctgctggcgcgctgtgngcgctgctctgcgccccagcctcctcgtcgccctggtgggatttctgcatttcagccagagggacctgtctgcagctaccagatgctccccaccctgggagagctcagcgccatgtctgcacatgggccttttcagccttcttcatcccgcaattggaactgactttcccactcccatctcacacttgagaatctctgtttcttgtttcttgttttttattttatttttattttttctcccccctggtggacaatggtgaggagggtgaaggaaggttaaaagccactgctctacgggatgaaaaactaaacttgtcattcttcagatccctcccagtctgggccccagcctaccc

SEQ ID NO: 4581 - DNA, 356 bp, Homo sapiens
gtcgagcccaaaaagatgaagaaaaaatggaaattcaggagatccaactgaagaggcaaagcacattgctgaagatgccgaccgcaaatatgaagaggtggcccgtaagctggtcatcattgagagcgacctcgaacgtgcagaggagcgggctgagctctcagagggcaaatgtgccgagcttgaggaggaattgaaaactgtgacgacaacttgaggtcactggaggctcaggctgagaggtactcgcagaggaggcagttataggagggatcaaggtctttccacaagcttaaggaggcttagacttggcttagtttcgggaggtcagtactaattgggaaacattatgacta

SEQ ID NO: 4582 - DNA, 218 bp, Homo sapiens
gctggcttgaggtaggggctcttaaggtacagaactccacaaaccttccaaatctggaggagggcccccatacattacaattcctcccaccttagttggttacagggtgagtgagataaccaatgccaaactttttgaagtctaatttttgaggggtgagctcatttcattctctagtgtctaaaacctggtatgggtttggccagcgtcatggaaag

SEQ ID NO: 4583 - DNA, 269 bp, Homo sapiens
cttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctgggagccctgctatcatcgattcggacccagtggatgaggaagtgctgatgtcgctggtggtggaactggggttggaccgagccaa

SEQ ID NO: 4584 - DNA, 329 bp, Homo sapiens
cacagatcagcaccatgaagcttctcacgggcctggttttctgctccttggtcctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagagaagatgactgaggaatacaaccacaactggatggactttttcaaaagatgacacctgcttatttgcctcattcaaatttcaag

SEQ ID NO: 4585 - DNA, 284 bp, Homo sapiens
  misc_feature (141)..(141): n is a, c, g, or t
  misc_feature (202)..(202): n is a, c, g, or t
atcacttgtgccctccacctacaaatttcaactctgattctacagcagtgattctggggcctagctgcacatccaaatagatcttggagctttaaaaacatcctgatgcccagacttcacgccagaccaatcacatcagantttacttgattggaagctggcatttgctattcctacttgtacggactttgaagtgattcantttcctctacggatgagagactggctcaagaatatcctcatgcagctttatgaagccaactctgaacacgctggttatctaa

SEQ ID NO: 4586 - DNA, 455 bp, Homo sapiens
ctccacacctccctgcaagctaaggaagccggctccggcttggcagcccagaaaggggtcccacagtgcagcggcgggctgaagggctcctcaagcgcggccagagtgggcgcaaggcggaggaggcgctgacatcgagcgggggctgtgagggctgccagcatgctgtcacctctcagtcccactagatcccaagaggcagcagaggcagcttctgaaaaataaaataaattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacgagataaatgcagagggaacaccagagacgtttttc

SEQ ID NO: 4587 - DNA, 366 bp, Homo sapiens
ggtcgacgcttgagaatggtgactgatcgaccagattgcttgggccatcggaatacctcatgtttccctttgaagaagttctcctgttatgttctggttgaaatcacctgtgtgtcttaatttctcaattcctttttggcaagaatatcaagcaagatagggtctcactctatcatcgcccaggctggagtacagtggcgcaatctcggctcactggaacctctacctcccaacctatcctctcgcctcagcctcccaagtagctgggactacaggtgcacaccaccacacccagctaattttttgtatgtttagtagagacaggtttttccatgttgcccaggctggtgttgaactcctgggctc

SEQ ID NO: 4588 - DNA, 2816 bp, Homo sapiens
tcgttgatatcaaagacagttgaaggaaatgaattttgaaacttcacggtgtgccaccctacagtactgccctgacccttacatccagcgtttcgtagaaacccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacatctcctttcagcctgcttcaggaatgagcttgtggagccccggagagaaactccaaaacaatctgacgtcttctttagacattccaagcccccaaaccgatcagtgtacccatagagccctatctctatattttaagtgtgtgtgttgtatttccatgtgtatatgtgagtgtgtgtgtgtgtatgtgtgtgcgtgtgtatctagccctcataaacaggacttgaagacactttggctcagagacccaactgctcaaaggcacaaagccactagtgagagaatcttttgaagggactcaaacctttacaagaaaggatgttttctgcagattttgtatccttagaccggccattggtgggtgaggaaccactgtgtttgtctgtgagctttctgttgtttcctgggagggaggggtcaggtggggaaaggggcattaagatgtttattggaacccttttctgtcttcttctgttgtttttctaaaattcacagggaagcttttgagcaggtctcaaacttaagatgtctttttaagaaaaggagaaaaaagttgttattgtctgtgcataagtaagttgtaggtgactgagagactcagtcagacccttttaatgctggtcatgtaataatattgcaagtagtaagaaacgaaggtgtcaagtgtactgctgggcagcgaggtgatcattaccaaaagtaatcaactttgtgggtggagagttctttgtgagaacttgcattatttgtgtcctcccctcatgtgtaggtagaacatttcttaatgctgtgtacctgcctctgccactgtatgttggcatctgttatgctaaagtttttcttgtacatgaaaccctggaagacctactacaaaaaaactgttgtttggcccccatagcaggtgaactcattttgtgcttttaatagaaagacaaatccaccccagtaatattgcccttacgtagttgtttaccattattcaaagctcaaaatagaatttgaagccctctcacaaaatctgtgattaatttgcttaattagagcttctatccctcaagcctacctaccataaaaccagccatattactgatactgttcagtgcatttagccaggagacttacgttttgagtaagtgagatccaagcagacgtgttaaaatcagcactcctggactggaaattaaagattgaaagggtagactacttttcttttttttactcaaaagtttagagaatctctgtttctttccattttaaaaacatattttaagataatagcataaagactttaaaaatgttcctcccctccatcttcccacacccagtcaccagcactgtattttctgtcaccaagacaatgatttcttgttattgaggctgttgcttttgtggatgtgtgattttaattttcaataaacttttgcatcttggtttaaaagaaa

SEQ ID NO: 4589 - DNA, 3050 bp, Homo sapiens
taaaggggggtgccagaccaggtgcgtctgccgctggattgtgataggaagcagagtgttcgtgtgaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgtcacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgccgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaccaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggcttta

SEQ ID NO: 4590 - DNA, 1506 bp, Homo sapiens
atgttgtacctggaaaacaatgcccagactcaatttagtgagtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgagttcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtga

SEQ ID NO: 4591 - DNA, 5248 bp, Homo sapiens
gaggaagagagctagagactggacaggggagacagagcagcgtcggagccgcgcaggggacgggagtgagagcgggagtgagagcaggaacgacgcagagcggccgtcgccttgcccgggtctcagggcgcctggctgaagtgagcatggcttcagtggcctgggccgtcctcaaggtgctgctgcttctccccactcagacttggagccccgtaggagcaggaaatccacctgactgtgatgctccactggcttctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggaggctgcctggacaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccgtctgggctttactatattgatgcagatggaagtggccccctgggaccatttcttgtgtactgcaatatgacagcagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgagatggaaccccactgagctggtgggttggaagaaccaatgaaacacacacctactggggagtttctctgcctgatgctcaaaagtgtacttgtggattagaggggaactgcattgattctcagtattactgcaactgtgatgctggccggaatgaatggactagtgacacaatagtcctttcccaaaaggagcacctgccagtcactcagattgtgatgacagacgcaggccgaccacattccgaagcagcttatacactggggccactgctctgccgcggagatcagtcattctggaattcagcttccttcaacactgagacttcataccttcatttccctgctttccacggagaactcactgctgacgtgtgcttcttttttaagaccacagtttcctccggggtgtttatggagaacctggggatcacagatttcatcaggattgagctgcatgctcccacagaagtgaccttttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatgggccgttctgctccaatgagatttccgcatattttgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagctgtggtcatggtagaggtaatcccacaaatgcagaagtcaaactaactaatattattattttaagaacaaataatctaatgaaaaaatttgataataaatattaatagaagagcaacccattcagtgctgctcttccataagtcaagaagaagccaaatatggccaggatctgggagagaggaggtggttgtttattctgtattgctttgttttgtttgtttagcaatgcaattctgtcaaaggtattattaatattttactatttaaaatatcaaaatatctttatttgttttactttactcaataggggaatgttctctagtttatcatagtgactgctggtggaatctattcattgatattgcagtgggaacttgtcttattctgattataaaagaacaaatactttagcaacttaaaaacacggtttaaaagcacacaacatagttattaaaatgggaataagtaagaaaatagacctgagtcaccacagaggaagtaaattacacattgtcatcggcattggaaggaaaatatactgtatagagaacaacaatgcttggttttatgtttcagattttctccacagaatgagtacatatttaagtttaaaacaaccaattccatctttttcatggattctgccaattatagatccttccattatgaagaagagtaaagccagcaagtgggtacatcgtggatagagtggtagctgatggcatcataggaattgcttataaaatagcttctctttctaaatgattaattatttgaaggtggcttcttgagcttttgtaatggtacttaaaagtgatttattttcatctttcctttcctcatcttcctttgcttccttatcattaaaattgtactttctgttgatgtttgcttctcatgggacatctaataggttaaccagagcgcaaagaaacaagtcatcttgtcctcagggacagaattcaacgctgtcaaatctctcatattgggaaaggttttaggtaagtaggagaaagagctttttcccaaaaaatctaagtgtcatgtcacaaactctggaagcattcatcatgctgaaagaagctccttgtcttacttgaataataatttcacagtgagtgacaatcaaggtgcaaactgtactcttgcctgagtgtacatataatcatgagtaagtgctacctgtgagatgtgcaagggcgttcctggaaaaatacctccacacttaacctctcacttggcaatcatgcataatgaatcacggtatttttctaacccttcttgaaaagtgaaatgttgtcaaagctgacacgaagttcacagattatgtatgtattaatcaacatcaactccggagaccatcattcaatgataaaactacgtttgagttgaacacaagagaaaaaactggtaatcttattacagcagatgaatacagttttatttctctctcaagccctgctttgcctgttgtttccatcctttttgactttagtatctaacaggaatggggaggcatattcataaatatctattatgcaaggtagaaagttacagtaattgtctatcatattgtctatcataacctgttgtaaaagcacagttagctttacatttaataaaggaactgaggaaagtaatctttttttaaaacccatcttatgtaactcaattaagaaaatgaactataatattaggatcaaaaagttgaataatatttattatatacatctttgtttccttccaaataaaggagaacatgg

SEQ ID NO: 4592 - DNA, 642 bp, Homo sapiens
gcctcaagccgacgcagcggcctactctcgcactgcagacggggaaactgaggcctgaggcggccggggtggggcagacctcccggcgagcccgagcccccgcccccggctagccccgccctggcccgtaagaagcacccggggcgcgaggcgaaggcgcacagcgcggggccaggctgggtccagcagcgcgatggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatgggactcctgaagtcatgtgggaaacctgtcgaggacttcatccaggagctgctggcaaagcttcaaggcctccacaggcagcccggcctccgccagccaagcccctcccacgacggcagcctcagccccctccaggaccgggcccggactgctcacccctgaccctcttgcactctccctgccccccggacgccgcccagcttgcttgtgtataagttgtatttaatggttctgtaacaataaaaaaa

SEQ ID NO: 4593 - DNA, 6801 bp, Homo sapiens
caaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccgggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccaagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttacaaaaaag

SEQ ID NO: 4594 - DNA, 3298 bp, Homo sapiens
ctggcatcactggcagggagaggggtggctgggccaggagcccacctcatccccagtgctcagagaactgggtcctcagaagtggtcccgcccccactttacacataaggaaacagacgcaaggaggagagggatgcccaatgacgggcacttcgatgagtccgtgtgaactctgttccgtgtgagctgctgcgcgctcagggaatgattgtgagaagcgggtggaggctggagtgggcagcaaagaactgacattttgaggtcagtttttcactccttggtcaagggcaggctctctccctggtcattaccaggagcctggctccgggcagcaaagaactgacatttcgaggagctctgctaagggccaggcagtatgtgagggagttcacagacaccgtcccattttcacagccctctgaggttggtaacataacccccacttcacagatgaggaactccagcccagaaagcctgtcagccctgagaaaggaagggcagggcatcgggctgggcagctggcctgggaccagtggggtgtgatagtgttggctctgcttcccgcgggtggggtgccagtggggaggggtctcaccagagagggagccgggggagtgcgctcctgcgtccatcctcagaccagcgtgtccctcccaacctctgacccctctgaggccaggggatgggttcggcttcctttggtacctcttttggaagtctcttcagacaaacactggagagaaggcacagcaccctagggtgacatcagtggacaggtcagtttcctgttcctgttcccagccacccctgtctgtctgcccagggacctacctgcctggcccactcctgctgccacccctctccatgagtgggactcctgagcagtgccaggcccaggccctcagggtggcagttgctggatggggccaggcttcccattccctggcaggcagactcttggctctggaagatccctgggggactctgacttcttggttactaaggctactccgtaagggtagccttacgagagcgtaagggcatgaggggaagtcgatgggtagaccaggtgtctctgatttctctgaggaaatgcagcttctttgccaagaactcttgggctttggtggcttcgtcgcccttgcctggggtgggcgagttttagtctcttcagctgcagaccagaagctgagctgacctgaaaagagctggagttctggagttcgggcttccaggccagggcctgcttctgggtgagagtgggaggtaatggttgcttgaggcagaggcagtaaaccctcacacccgcagctggacaaaggcaccagctggctgtattctgtgggggcaatgtggcttctggaaggtctctccagtggctctgtagctggtcttggcaaagaatgttctagaccaagggttgtcaaactacagctcatgggccaaatccagcctgctgtctgcttttgtaagtaaagttttattggaacaaagccatgttcatttgttacatattgtctatggctgctttcacactgcaacagcagagaccatgtgtcctgcaaagcctaaaatatgttctgtcttatcctttacaaaaacagtttactgacccctgctctagacctccaaagacctggtatcctctttcctggtgttcaagttcagagaggtgtctggagtaggggctgagcctggcctggatgggcagtgctgtgacaagtgtctaggatggccgggtatcctgcacagagctagaaggctgcctggcacgggtgaaagcagagctgctccctgaccctctgcccctccctcctccaccctggcctgctttagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtggtgagtggcaccctgggctagggcgctggggggctggggtgtgccaccctgtgagtcctgggccaatccctgagctgactgctaagctgcgtcctatgccctatgcctggtagattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagtatgtggcccccagggagcttgggtctccgcatggggtgggaggtggcttgttctaaggagcttgcgggaaggattaggggaagcagatagccaagaaaggataaagtgagggtctgggatggggaataatgggtccttaatactccttgacccctccctttccaccctcctgcgctcagtctccctagcctatgaggcaagctagattagggaaaaaaagtgcaacaggaaggcaatgggattgggctaggacgtaacagagggatcagaaaacgggtggaaaacacacagttctaccaagtctttatcctggttcctcctcttctaggaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttgtcctggaatatttttggggttggaactc

SEQ ID NO: 4595 - DNA, 782 bp, Homo sapiens
gtaaaatggtcccctcggctggacagctcgccctgttcgctctgggtattgtgttggctgcgtgccaggccttggagaacagcacgtccccgctgagtgcagacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacaggatgccggctttattaacaaaaactctaacaagtcacctccactatgtgggtcttcctttcccctcaagagaaggagcaattgttcccctgacatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagct

SEQ ID NO: 4596 - DNA, 3451 bp, Homo sapiens
gaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaagacagggtcttgctccgtcacccaggctggagtgcagtggcgtgatcatggctcacttcagtgtccaactcctgggctcaagcaatcctcctgccttagccttccaaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttcttt

SEQ ID NO: 4597 - DNA, 5119 bp, Homo sapiens
ggcacgaggccgcgcaggggacgggagtgagagcgggagtgagagcaggaacgacgcagagcggccgtcgccgtgcccgggtctcagggcgcctggctgaagtgagcatggcttcagtggcctgggccgtcctcaaggtgctgctgcttctccccactcagacttggagacccgtaggagcaggaaatccacctgactgtgattccccactggcctctgccttgcctaggtcatccttcagcagctcctcagagctgtccagcagccacggcccggggttttcaaggcttaatcgaagagatggagctggtggctggaccccacttgtgtcaaataaataccaatggctgcaaattgaccttggagagagaatagaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggaggctgcctggacaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccgtctgggctttactatattgatgcagatggaagtggccccctgggaccatttcttgtgtactgcaatatgacagcagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgagatggaaccccactgagctggtgggttggaagaaccaatgaaacacacacttactggggaggttctctgcctgatgctcaaaagtgtacttgtggattagaggggaactgcattgattctcagtattactgcaactgtgatgctggccggaatgaatggactagtgacacaatagtcctttcccaaaaggagcacctgccagtcactcagattgtgatgacagacacaggccaaccacattccgaagcagattatacactggggccactgctctgccgcggagatcagtcattttggaattcagcttccttcaacactgagacttcataccttcatttccctgctttccacggagaactcactgctgacgtgtgcttcttttttaagaccacagtttcctctggggtgtttatggagaacctggggatcacagatttcatcaggattgagctgcgtgctcccacagaagtgaccttttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatgggccgttctgctccaatgagatttccgcatattttgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagctgtggtcatggtagaggttaaccagagcacaaagaaacaagtcatcttgtcctcagggacagaattcaacgccgtcaaatctctcatattgggaaaggttttagaggctgccggcgcggacccggacacaaggcgggcggcgactagtggcttcactggctgcctctcggcggtgcgcttcggccgcgctgctcccctgaaggcggcgctgcgccccagcggcccctcccgggtcaccgtccgcggccacgtggcccctatggcccgctgcgcagcgggggcggcgtccggctccccggcgcgggaactggctccccgactcgcggggggcgcaggtcgttctggaccagcggatgagggagagcccttggttaatgcagacagaagagactctgctgtcatcggaggtgtgatagcagtggtgatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagcgagtcttctgattggcagctgtggctgtctctatcatcgtgactgtggacttccctgctgttgccatcagggtgcacacaagcaggtgcagtgctgtcacctggctgaagacctgcagcctcggagcctctgggaggtccctttctccctcggtgaaacacagtcctccacatcaatttccaaacaatgaattaggtatggccattcatcactgttcagtagtttccccgtccaaaggctctcttccaaaactgcagtttgatctgtgttaataattgtggggttttagatgagaaaatggctataaagctgtggccctactttattttttaaaaatgacagaacttttgttcagatgtaaaagacaaaattgcactttaatgttttttgttacttgaaaacatatctgggatccctttttttggtcctctgctgatatttataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattatgtttttaactaaatttaccaccagatacaaacaatacttcttacacagagttatcctttatttatatcattaagacgtgaatgaaacatcatcctaacttacttccccaagatattgagaggtcatatctgtttttctttatcattcatttctttttctaaaagttgttactgatatgcttttgatttcctatgactctattatgttgtacagaacatcttttcaatttattaaaaaaatagcttaactgaaaaaaaaaaaaaaaaaaaaaaaa

SEQ ID NO: 4598 - DNA, 1215 bp, Homo sapiens
gagaaggtttaaggccggaaagggaaatgaaggggcccggcgctaaccctctaaggacctgttttgcttctgtttaaaccaaatgggcagtctgtcattacacacaccctgggtcttcatatgtggccgccaggtaggagcatcacagtcaagctacgggagaaaacagtttccaggaaactggaaatgaacggcccgagtgctttccaggggctcatctgtgggaagtataatggaatgtgcttacaagggccagcaggagtgcctggtcgagacgggagccctggggccaatggcattccgggtacacctgggatcccaggtcgggatggattcaaaggagaaaagggggaatgtctgagggaaagctttgaggagtcctggacacccaactacaagcagtgttcatggagttcattgaattatggcatagatcttgggaaaattgcggagtgtacatttacaaagatgcgttcaaatagtgctctaagagttttgttcagtggctcacttcggctaaaatgcagaaatgcatgctgtcagcgttggtatttcacattcaatggagctgaatgttcaggacctcttcccattgaagctataatttatttggaccaaggaagccctgaaatgaattcaacaattaatattcatcgcacttcttctgtggaaggactttgtgaaggaattggtgctggattagtggatgttgctatctgggttggcacttgttcagattacccaaaaggagatgcttctactggatggaattcagtttctcgcatcattattgaagaactaccaatatatatgctttaattttcatttgctacctctttttttattatgccttggaatggttcacttaaatgacattttaaataagtttatgtatacatctgaatgaaaagcaaagctaaatatgtttacagaccaaagtgtgatttcacactgtttttaaatctagcattattcattttgcttcaatcaaaagtggtttcaatattttttttagttggttagaatactttcttcatagtcacattctctcaacctataatttggaatattgttgtggtcttttgttttttctcttagtatagcatttttaaaaaaatataaaagctaccaatctttgtacaatttgtaaatgttaagaattttttttatatctgttaaataaaaattatttccaacaaaaaaaaaaaaaaaaaa

SEQ ID NO: 4599 - DNA, 785 bp, Homo sapiens
  misc_feature (66)..(66): n is a, c, g, or t
  misc_feature (95)..(95): n is a, c, g, or t
  misc_feature (255)..(255): n is a, c, g, or t
  misc_feature (426)..(426): n is a, c, g, or t
  misc_feature (471)..(471): n is a, c, g, or t
  misc_feature (480)..(480): n is a, c, g, or t
  misc_feature (553)..(553): n is a, c, g, or t
  misc_feature (556)..(556): n is a, c, g, or t
  misc_feature (582)..(582): n is a, c, g, or t
  misc_feature (609)..(609): n is a, c, g, or t
  misc_feature (612)..(612): n is a, c, g, or t
  misc_feature (614)..(614): n is a, c, g, or t
  misc_feature (619)..(619): n is a, c, g, or t
  misc_feature (634)..(634): n is a, c, g, or t
  misc_feature (638)..(638): n is a, c, g, or t
  misc_feature (649)..(649): n is a, c, g, or t
  misc_feature (654)..(655): n is a, c, g, or t
  misc_feature (665)..(665): n is a, c, g, or t
  misc_feature (675)..(675): n is a, c, g, or t
  misc_feature (695)..(695): n is a, c, g, or t
  misc_feature (729)..(731): n is a, c, g, or t
  misc_feature (741)..(741): n is a, c, g, or t
  misc_feature (746)..(746): n is a, c, g, or t
  misc_feature (753)..(753): n is a, c, g, or t
  misc_feature (771)..(771): n is a, c, g, or t
  misc_feature (774)..(774): n is a, c, g, or t
  misc_feature (779)..(782): n is a, c, g, or t
  misc_feature (785)..(785): n is a, c, g, or t
ggtaccggtccggaattcccgggtcgacccacgcgtccggccatcgccatgatctgtggaaatgtntgcctctggaaaggagctccaaccacttnccttattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcangtgggaaaacaggtgggcctgatggtgcacgagaggtttgatatacatgcacagaggaaagattggaagacactatcaaaattggagaagtctgttggaacttggaggaaacaatgccattattgcctttgaagatgcagacctaagtttagttggttccattaagttctnttagttgctgtggaaacagcttggccagaggtgtacccactggcnaaggcgacntgtttatacttgaaaagcttccttgatgagggtggtaaacagacttaaaaagggcctatgcaaaaaatcccanttnggaaacccatgggaccctaatgtttnttttttgggcccctccaaaccaaaccnggncnggaanattttttttttgganccantgggaaaaaancaaannaaaggaaggngggcccaatnggtttttttggggggcaaanggtttttggaatcccccccttggaaaattttttnnnaaaaaccccnaaaanttttggnaacagggttttttgggcncanaattnnnnttn

SEQ ID NO: 4600 - DNA, 451 bp, Homo sapiens
tttttttttttaactccagaaaggaaaagctggcaatgcagctttattgaaattagcttgacatagttgctctggagctcacagacttctctcttcttccccctgaaggtatggagaggttcaaaggccaatatttccatagccgccaatacaagcatccagatggatttgagggaaaacgcatcctggtgattggaatgggaaacttgggctcagatattgctgttgagctgagtaagaatgctgctcaggtgtgatgctctctgcttaccatgtacctgggtcatgagccgtatctctgaagatggctatccttgggactcagtgttccacacccggtttcgttctatgctccgcaatgtactgccacgaacagcttaaggcctccaacaaatatacaccaggagtctggaggagcccttcttagtaaaaagatgtgaatacgagactc

SEQ ID NO: 4601 - DNA, 309 bp, Homo sapiens
  misc_feature (282)..(282): n is a, c, g, or t
attctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtgggagatcaactttggggcactaagaatttgattcctggtggaatgtaactcaaaactggaccccacccagaactcgttcctcaagatggctgactcnggggaggtcagccccagctgactcagc

SEQ ID NO: 4602 - DNA, 504 bp, Homo sapiens
atttggacaaccagcggcaactggtgtccaacctggaaaagaagcagaggaaatttgatcagttgttagccgaggagaaaaacatctcttccaaatacgcggatgagagggacagagctgaggcagaagccagggagaatgaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgttcatgagctggagaagtgcaagcgggccctggagacccagatggaggagatgaaaaacgagcttggagaacttgaggaagaactgaaaagcccttgaggcgcccaaactggggtgggagtaacaagcaggcgcctttaaggcgctttttgaagggggttctccacgcccgggacgagcataatgagggaaagaggaggcacctgagagaccgcttcccgatttgaga

SEQ ID NO: 4603 - DNA, 468 bp, Homo sapiens
  misc_feature (59)..(59): n is a, c, g, or t
  misc_feature (118)..(118): n is a, c, g, or t
  misc_feature (153)..(153): n is a, c, g, or t
  misc_feature (237)..(237): n is a, c, g, or t
  misc_feature (322)..(322): n is a, c, g, or t
  misc_feature (364)..(364): n is a, c, g, or t
  misc_feature (368)..(368): n is a, c, g, or t
  misc_feature (370)..(371): n is a, c, g, or t
  misc_feature (373)..(373): n is a, c, g, or t
  misc_feature (385)..(385): n is a, c, g, or t
  misc_feature (388)..(388): n is a, c, g, or t
  misc_feature (391)..(393): n is a, c, g, or t
  misc_feature (398)..(398): n is a, c, g, or t
  misc_feature (403)..(403): n is a, c, g, or t
  misc_feature (409)..(409): n is a, c, g, or t
  misc_feature (418)..(418): n is a, c, g, or t
  misc_feature (421)..(421): n is a, c, g, or t
  misc_feature (424)..(424): n is a, c, g, or t
  misc_feature (434)..(434): n is a, c, g, or t
  misc_feature (437)..(437): n is a, c, g, or t
  misc_feature (439)..(439): n is a, c, g, or t
  misc_feature (441)..(441): n is a, c, g, or t
  misc_feature (445)..(445): n is a, c, g, or t
  misc_feature (447)..(449): n is a, c, g, or t
  misc_feature (453)..(454): n is a, c, g, or t
  misc_feature (456)..(456): n is a, c, g, or t
  misc_feature (460)..(461): n is a, c, g, or t
  misc_feature (468)..(468): n is a, c, g, or t
gaattcggcacgagggaatggataaaaacattggcgagcaactcaataaagcgtatgangccttccggcaggcatgcatggatagagattctgcagtaaaagatttacagcaaaagantgtttttaattcattggagataccatactgatttntcgtgaagaaacacctgattcctaggttacaacgaactagaaaaatgactgagagatctggcttcggtgataccagagcttttnttcataaacatgtgctacatgctctgtgtcttagtccatttgcactctataacaaattaccttatacaagcactgcaataccatngcaaatttatgggttaccattttaggggactggctttaggcnccangnncnctttttctcttnttnttnnncttgnggggngttctnctggggccntgngcngggttcgggnccncngnccgntnnntttnncngccnnttggggn

SEQ ID NO: 4604 - DNA, 890 bp, Homo sapiens
  misc_feature (538)..(538): n is a, c, g, or t
  misc_feature (573)..(573): n is a, c, g, or t
  misc_feature (589)..(589): n is a, c, g, or t
  misc_feature (591)..(591): n is a, c, g, or t
  misc_feature (623)..(623): n is a, c, g, or t
  misc_feature (627)..(627): n is a, c, g, or t
  misc_feature (645)..(645): n is a, c, g, or t
  misc_feature (647)..(647): n is a, c, g, or t
  misc_feature (657)..(657): n is a, c, g, or t
  misc_feature (705)..(705): n is a, c, g, or t
  misc_feature (735)..(735): n is a, c, g, or t
  misc_feature (760)..(760): n is a, c, g, or t
  misc_feature (773)..(773): n is a, c, g, or t
  misc_feature (785)..(790): n is a, c, g, or t
  misc_feature (800)..(801): n is a, c, g, or t
  misc_feature (832)..(832): n is a, c, g, or t
  misc_feature (836)..(836): n is a, c, g, or t
  misc_feature (839)..(839): n is a, c, g, or t
  misc_feature (841)..(841): n is a, c, g, or t
  misc_feature (856)..(857): n is a, c, g, or t
  misc_feature (859)..(859): n is a, c, g, or t
  misc_feature (866)..(869): n is a, c, g, or t
  misc_feature (871)..(873): n is a, c, g, or t
  misc_feature (884)..(885): n is a, c, g, or t
  misc_feature (887)..(888): n is a, c, g, or t
ttcttccaaagcctcctagtcactggatgggaagcactgttgaaaattccaaccaaaacagggagctgatggcagtacacttaaaaacgctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaggtgaagatctaaagtgaacagttactaatgcactactgaagttaaacngtgggcacaatcaatgtagcctgggggttgttccncctaattgatttgtancnggaatactggaccactcccatcccattttgcnaacncaattccgggtttgggananacccatcccncctaatgcccccaaatttaatgcccacccaaattgggtggaacccaantttaaaataataataaattggccccccccntttaaaaaaaaaaaaaaaaaaaaanggggggcggcccnagggggcccagnnnnnngccggggggnngggggggcaaagcccccccaagggggccccnaaanccnanccccggggggggggnnanaaggggnnnngnnnggttccccccnncnncc

SEQ ID NO: 4605 - DNA, 1793 bp, Homo sapiens
tcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccaggacatcctcaatttcgtcgatgaccagcttggtgaataagtattactgtaccaactgggcctcctctagcaggcccctgaaggcagtggaataaaatgaaatcttcgccctttaagaactcctgaccttaatgtggtagtagtatcttgtccttgaggggatttccttcccctcacccctaagactttcacaacctggtgactggaaagaaccaccacaaatcttcatttcctccagaaactgctacatctacagccgatttcaggcagtaaagggagagggatagaggagattgggtggaaaatggagaggatcaagaaggagctgagaccatttcaaagaaaaaaaatgctttatagagttttaagtatgacttagatgggtccaggcaaataaactaaaaagaagtgaaggcaacatgtatcgtctggcagaactaaatcttggagtggggtgagggatgaaagactacatattgggtacagtgtacactgctcgggtgatgggtgcgctaaagtcgcagaaatcactaaagaactcatccatgtaaccaaacaccacctgtaccccaaaaacgaaataaaaaaacaaaaccttggggcccattccccctaggaatggactactgtaaaaa

SEQ ID NO: 4606 - DNA, 3152 bp, Homo sapiens
  misc_feature (2979)..(2979): n is a, c, g, or t
  misc_feature (3105)..(3105): n is a, c, g, or t
cgggagccaacttcaggctgctcagaggaagcccgtgcagtcagtcacctgggtgcaagagcgttgctgcctcgggctctcccgctgcagggagagcggcactcgctggcctggatgtggttggatttaggggggctccgcagcaggggtttcgtggcggtggcaagcgctgcaacaggtagacggcgagagacggaccccggccgaggcagcgatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggagagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggnagaagttttaactatgccgtgtagtttctggtatcgttcgcttgttttaaaagggttcaaggactaacgaacgttttaaaacttacccttgggtttgcacataaaacgtatagtcaatatgggggnattaatattcttttgttattaaaaaaacacacaaaaaaaaaaaaaaa

SEQ ID NO: 4607 - DNA, 338 bp, Homo sapiens
atgtgctggaagaaatgattgcatcattgataagattcgacgaaagaattgtcctgcttgcagacttcagaaatgtcttcaagctggaatgaatttaggaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaag

SEQ ID NO: 4608 - DNA, 1042 bp, Homo sapiens
tatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagttcagggttcctggaacttctaccagtgcgactctgacaggcctcaccagaggtgccacctacaacatcatagtggaggcactgaaagaccagcagaggcataaggttcgggaagaggttgttaccgtgggcaactctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcaga

SEQ ID NO: 4609 - DNA, 1068 bp, Homo sapiens
tatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaacccttacagtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcaga

SEQ ID NO: 4610 - DNA, 3960 bp, Homo sapiens
agtctgcgggcctccggggctgcggcgaggccggagcgtcgcggcggagaggacgagaccgggacaagaccagggcaggagggagccggccagccgcgagaaccccgcacgcccggcaagatgctgtccttgcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctgggtgcgcagcagcgcgagctgcaggaggcgctgggcgcgcgcgccgccctcgaggcgctgctgggccgactgcaggccgagcgccgaggcctcgacgcggcccacgaacgcgacgtgagggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggggacggtgcagctgtacgaggacgaggtgcgcgagctggaggaggcgctgcggcgcggccaggagagcagactccaggcggaggaagagacgcggctgtgcgcgcaggaggcagaggcgctgcggcgcgagacgctcgggttggagcagctgcgcgcgcggctggaggacgcgctgctgcggatgcgcgaggagtacgggatacaggccgaggagcggcagagagcgattggctgcctggaggatgagaaggcaaccctcaccttggccatggctgactggctgcgggactatcaggacctcctgcaggtgaagaccggcctcagtttggaggtggcgacctaccgggccttattggaaggaggaagtaatccacagatagtgatctgggctgagcacgttgaaaacatgccgtcagatggatgtgagtaacgtagaggcgatccgcagccggacacaggaagcgggagctcttggtgtgtctgaccgtggttcctggagagacgcggacagtaggaatgaccaggcagttggtgtgagctttaaggcctctgttggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcgcataatgctgtctcagctgtatttccagtaacacagcatcatcacactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatggcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgagg

SEQ ID NO: 4611 - DNA, 531 bp, Homo sapiens
cgctcgtaccggggtggaaaactggccaagagacctgagccagaagaataggcctttgtctcacagacaaaccacagagccacgcattggagtcatacatgcagcagatgccaggcttgcacccatccttgcgactggtcccctgggtgatctgtcttcttctctgtccctgtaaataaagtttgggtctgatcaccatgagccttatatgcgcttggagaaggacaggttctctgtcaacctggatgtgaagcacttctccccagaggaactcaaagttaacgtgttgggagatgtgattgaggtgcatggaaaacatgaagagcgccaggatgaacatggtttcatctccagggagttccacaggacataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaa

SEQ ID NO: 4612 - DNA, 1512 bp, Homo sapiens
tgaataaattttgcttctaagagaagttactattcctaattatatggggagtaaagtctctttgaagaggaatctctactttactttttacacttgtgctttgataattttttacttggaaacctcatcttttggcgttttttttttttgagctatttctctagtgttgctatttgatttaatttctgaccttcatttttgtttcccaaccttttttttttgtttgatatgaggggttccgtgactgaggttctgagctgctgttgatgtgctatacctccttcaattctcagctatcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagaggataagggcttctgatttcccatgacttaggaaacagaattaagactgtttcattcattgaagatcagaatgccctgcgtacagtctggaaaagtaacatgtgccgcctgaagagacaagagtttgtgataagcagagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttgtaaaacacggacattagtgtgaacacaggacagcttcgctctttctcttcctgccctagctcttggttggtttatatataaggaatatatttgtgtatttatatatcagacatttggatgtacctttcagttatttaggatttagaaaattc

SEQ ID NO: 4613 - DNA, 2089 bp, Homo sapiens
atagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaactgacctcagttcctaaagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcatattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttttaattattacctgatttaaaaatctctgtaaaaacgtgtagtgtttcataaaatctgtaactcgcattttaatgatcagctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaaat

SEQ ID NO: 4614 - DNA, 2946 bp, Homo sapiens
attcttcttccccagagagccactccatctgagggtggctgcgtgtccacatatgaggggacagggctgaggatgaggagaaccctggggacccagaagaccgtgccttgcccggaagtcctgcctgtaggcctgaaggacttgccctaacagagcctcaacaactacctggtgattcctacttcagccccttggtgtgagcagcttctcaacatgaactacagcctccacctggccttcgtgtgtctgagtctcttcactgaaaggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggggacaacaaaggaagtagaagaagtcagtattactaatatcatcaacagctccatctccagctttaaacggaagatcagctttgccagcattgaaatttccagcgacaacgttgactacagtgacttgacaatgaaaaccagcgacaagttaaagtttgtcttccgagaaaagatgggcaggattgttgattatttcacaattcaaaaccccagtaatgttgatcactattccaaactactgtttcctttgatttttatgctagccaatgtattttactgggcatactacatgtatttttgagtcaatgttaaatttcttgcatgccataggtcttcaacaggacaagataatgatgtaaatggtattttaggccaagtgtgcacccacatccaatggtgctacaagtgactgaaataatatttgagtctttctgctcaaagaatgaagctccaaccattgttctaagctgtgtagaagtcctagcattataggatcttgtaatagaaacatcagtccattcctctttcatcttaatcaaggacattcccatggagcccaagattacaaatgtactcagggctgtttattcggtggctccctggtttgcatttacctcatataaagaatgggaaggagaccattgggtaaccctcaagtgtcagaagttgtttctaaagtaactatacatgttttttactaaatctctgcagtgcttataaaatacattgttgcctatttagggagtaacattttctagtttttgtttctggttaaaatgaaatatgggcttatgtcaattcattggaagtcaatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttttaacttgttctagaagtcttaatatgggctgttgccatgaaggcttgcagaattgagtccattttctagctgcctttattcacatagtgacggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctctgagtggcttatcccgcatgagcaggagcgtgctggccctgagtactgaactttctgagtaacaatgagatacgttacagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacaggaatgggtgggagtgctggtgaaaagaggtgaaatgtggttgtatgagccaatcatatttgtgattttttaaaaaaagtttaaaaggaaatatctgttctgaaaccccacttaagcattgtttttatataaaaacaatgataaagatgtgaaactgtgaaataaatataccatattagctacccacc

SEQ ID NO: 4615 - DNA, 1727 bp, Homo sapiens
atgcttttccttcccagctggagaaggcctcagctgtgtcagactgggactgctggtgatttttctgtagttagagggaaacacaaaacgaagagcggcccactcccagcttacaccgatggtgagcccacctctcctgatcattagcgttgctggcacaattgaatgcaagccagatcatctcttatggagacccggcagtacctcacctcagtctgtgagttttctccatgggaaggttgtgatggagtctctgggtcgtcccattccacctacatcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggccccagcaagcctccagcagtggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagcaatgcatctgctcggactcaattggcaactccagcctgcagatgggcacacctttaacaatgggataaggaccggcttaccaggaaacgatgatgtggcaacaatgccatctggaggcaaagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctagattcagtgcaggactgtccacgtaactgccatgggaatggtgaatgtgtgtccggggtgtgtcactgtttcccaggatttctaggagcagactgtgctaaagctgcctgccctgtcctgtgcagtgggaatggacaatgacaatcatagtatgttttattttcctgagggggaataacttataatgctgtttagttttgtactattggtgtgttggtgaatttttaaactgtgtgctaactgcaataaattatatgaactg

SEQ ID NO: 4616 - DNA, 2817 bp, Homo sapiens
gttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcagcaacaactccaggcccagcatttatcacatggacatggtctccccgtacctctgactccacacccttcagggctccagccccctgccattccacccatcggtagcagtgccgggcctctggccctctccagtgctctaggaggtcagtcccatcttccaattaaagatgagaagaagcaccatgacaatgatcaccaaagagacagagactccatcaagcaaaactacttgctgctcataatggatgaaattggagaccaaagaggaagaaccttctgggttcctgtcagtctaaatcctgattttaaaagacattcacctgccatgctagtgttgtgtgcttctactgagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgatacc

SEQ ID NO: 4617 - DNA, 2312 bp, Homo sapiens
aagtaacgctttcttgttaccagatgacagagagtcaggctgtcagagttcacgactttaggtgcacagtttcaccctgtctggtccttgggagacggagaaggggtcaggagaaaacgtgggtgaagaggcagcaaagccgcaggagatatgaactaattgctcaacgtgggtgtagcacggattaggccttttacagcaagcgctgccagcagggaactggtggatgtactcttgaccacgctcggctggactctggggagcccaagacgggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgaggtgatgtggaaacagctgtaaaatttgcaactcagcttattgacctcggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtatctatggctttttcaaccaggctttcttggtgttttttatcttggtttgtttgtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaagtgagtattaagaagatttagaaaaacacctttcaagatgaacatgatgggattctgtgaagaaagaaaagtggagtgctgtatcttttgcattgcttggtagagttttaacacgtaggagaaaaggtgtgataagtgtattgagaagcgttcttcctccctcctttgcaagcgcaattaaaaatgtcaccagtgactaaaactagtgcactgcatatattttatcttcatagaggtcagaactgttaataaaagttaaaggaattt

SEQ ID NO: 4618 - DNA, 1802 bp, Homo sapiens
aaaagggcccgcggctcgggcgtaggaggcggtgcctctgcagcaagcgtggggcgcgggaacccgagcaggactctccagtcctcagtcaccttggacaaagaagtgtggatcctcagattccatcttttccaactccaaggagggggctccctgcctgagagcctgcggcgggtccaggagctgacaggccgctctgtggagtttgaggagatggacattttggaccagggagccctacagcgtctcttcaaaaaggtgggtgcaggctgggcacggtggctcacgcctgtaattccagcactttggaaggccgaggtgaggagatcacttgagcccaggtgttcaagaccagcctgctcaacacagtgaaaccccatctctacagaaaaatacaaaaattagctgggcatggtagcccatacctgtggtcccagctactcgggaggctggcatgggaggatggcttgagcctgggaggtggaggttgcggtgagctgagatggcaccactgtactccagcctggacaacagagcgagactgtcaaaaaaaaaaaaaaaggtgagtgcaggcaggcaggctgagggcattgccaaggactaaaaccagtagagcaacctctggccatgtcacccctgcagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatctcgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactggg

SEQ ID NO: 4619 - DNA, 2392 bp, Homo sapiens
gcacagctggtaaatgggaaaagaggggtttaaagcattcaggcacatagagccttctgcagcggcccctctccagccagcacttgacaggacagatgggggctaatctggccctgctaagcagcgacatgcctctcctggagaaggcaggggcttcctggaacttgccccagccttatcagcggaggtttgccccaacacatcccagaaacgagcaaaggttcagcgccgtgcagttggcaggtgtcgggatcatcagtcatccccttgtcagtcccaagcctgctgggcttttgtgagggtgccaggaacacaggctggaggatggcaggaggggagtagaggtgggaggaggggagtccatctgcagcaccaggtaaggggatggatgctggctcctctggtcacctcagctggaacactactcaaggtccctggctcctgtcctccacctgcccccaggggccctgcattcccatccccagggcctccactctccctgagccctgcagtctctcactcactcactcactcactcactcactcattcactcactcaaggtgtgcaggcagctgtgtttgtcaggaaggcagaaggagttggctttgctttaggggaggagacgaggtcccacaacaccctctgaagggtatataaggagccccagcgtgcagcctggcctggtacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaggatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaggaattacttttccttttgcaaat

SEQ ID NO: 4620 - DNA, 2148 bp, Homo sapiens
agctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaagacacgcgcggcacagccatgaacaccaacgatgccaaggagtatctggcccggagggaaatccctcagctttttgagagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacccccactaaatggaggacagtcacggagatcctttctaagaaatgaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaaagaagatccacagtaccagcagcaataggaaatggagtcttattgccaagataattacaactggagaattggccccacaggaaacaacaattacagagataaaacaaaaattgatgcaaatacctgatgaagagggcattgttattgatggatttccaagagatgttgcccaggctctatcttttgaggaccaatacagcctacgccctcagacaaagatgcctgtgcagtcagatcctctcccttacgctgctccctgcggggtatgtccagtccgtcaagattctccctaaagacacagcctgtaagaaagcagaagtctttgcctctgcctgccacatatcttccttgaggcaatgaagtacagagctggctatttgcttgatggacaaaggggaagagggggagaaataataaaataattgtagtcatagtaatgacaatattgaacatatattgagaatttgctatgtgccattgttctgaacccatatatgttaatatattgatgttaatcctcaaaacaatcttatgatatgaattgaagagttgttctaattttatatgtgaggagatggaggctacgttttcaaggaggctggagaatctgctccaagtcacatgtatcaagaggcagaggtggtatttgaaccaggctaagcaggtcctgaggcttcagtcttaaccaccacctacttttttagaaacatagattaatatgccggaatattctctagctacaattgttgggcttttataacctaaaatcaactcatactaaatgaatcaaacaaacgacaaccaaaaaaataaaaaaaaaaagaccaggagaatggaccaagaaatacagatgatataaacacaatacatttaaagatattattttttgtactttttaatgtagcttaattttttaattgatacacaatcatatatttatggagtacagaatgatgtttcaatacatatagtgtatggtgatcagatcagggtgattagcatatccatcatctcaaacatttatcatttctttatgttgggaacattcaatatcctccatcctccttttagctatttgaaactatatatttattgttaagtatagtcatcctacagtggcatagaacactagaacttatttattcaatctagctataattttgtaaaggtactgtttaattctagcaggagaataaagtgaatgggagagaggcgaacacctgtaaggtccatagtattccagattatgaaatgacacagatatctcaggagaagatgagagcttttcacataatcattccaagaagtttcatttaacaacagatatttattgagatgctatcatgttctaggctattgtactttgtcctggaaacacaaagatgaatgaataatgtacccttacggtaaaatacgtgtacatataatcatgcataatagagtataaatacatacaatg

SEQ ID NO: 4621 - DNA, 2880 bp, Homo sapiens
gtcttgaggaatgcggtcgcccccttgggaaagtacatatctgggagaagcaggcggctccgcgctcgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcaggtctgcgcctccccggccctgcgcccgcgcccagagcgccgggactcgagcctggcacccccggctggatccccaccccgaggactcggggagccaccaccctacccccaccaccacccagggcggccagggcgcgcgtctggaaagaaggaagggaaacgcaagagccaggcttagtctaacttagtctggtctgaggacgcttatttcccttctctggttcccatggcccgcgaaatcaagtcctagaggcgctttattctcaggactgggaatcagtttgggggagggaggaggacacccggttcctggggacgtttgaaggaagggcgagggatggagaaagggggtcgagtaactcaagtgttagaagttcgttgacttttgactggggagaaaggaaccttaaacttggggaggagaagggagtcctggagttgttacctaagaacaaagatggggcggaatggaggctacagcccgaaagccaggccagcagtggcgttcttctgtgtccccaagtagtggacttgagcccgctgagacctcggcaggagtctcgtcccagggcaggtgggtgtgcggggtgagccgcggagcggttccagctcgggtaaagaggaagttacctcgggtcctttgcactccaactcggcggcgccccgagcccgaggggccccagccaacccgacgcccgtgtgttgtgtgtgtctaacacccggtccgtgccggccgcccgcgcccgcccgccgctgcccccagctcgaggaggacatcgcggccaaggagaagttgctgcgggtgtcggaggacgagcgggaccgggtgctggaggagctgcacaaggcggaggacagcctcctggccgccgaagaggccgccgccaaggctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataaggtactgatggctcgtgtggtttttaggtttaactgcaacccagacatctttcagcttccaatgcctcctggttcgtttggtataacgactgcaccttcacttcaccctctgctatttatatcttgccttaagtgctttcccttggtcctttatgctcctttgttttcccttcataaatgctctttgggcagccaaaaaaggagccaaattatcgcacttcaaagttgttggatttggtcaccctgccttctgctgttgcgaggttggggggcagtgttcctggaaaaactaaacattttaatacctgatgatttggctactttaaggcagcccttcgtctctaggactcagttttcattttttcccatccctctcctttttctctcctccttcctttggcttgtctcccaccctttctgcctctgatcgaaaacattagcaaatgtgccgagcttgaagaagaattgaaaactgtgacgaacaacttgaagtcactggaggctcaggctgagaaggtaggccaggaggatggtgtgggggaaaggcatcttttaagagctgctcaaaagaggccctgccagaaagcaacacttacagtagacattttagtaaaatggcaatattgtgaggtgatttttggagagttactagataacaaattcttttttttaactagagaatttattttatgttagggatatgaggcatcaatttaatttaaaccaagtgccaagtggataagttatcttgttgttatcccatgtaaaacaataggcaagaaagcagagaatgtattgcagtgtgccatttgatatcagaggttccattacctcctaagagatccttaacatctgttggctgagctggcgagttctttgcatgagaagccatgagtagattgagctgcagcctgacatctggaatgctctttctaattacagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgttttgtttttaaacacctgcttaccccttaaatgcaatttatttacttttaccactgtcacagaaacatccacaagataccagctaggtcagggggtggggaaaacacattgtaggacattttct

SEQ ID NO: 4622 - DNA, 2689 bp, Homo sapiens
gtaacatacattcaaagtggatgaggatattttacctgattagtaaattccatctcccacttccatgcacagtatttaaacagccaccagtgcaagtgtgtataatggaccatcatagtcttataagtgttctgaggctcatagcaacaatttcttatgacaggaaaaaaatcattgcctctcaaagaaaccaacattttatttcagtgacagataccaagtaaaaacagtacttgtattatttttctttttaggagtttgatacttttcttgtattaaccttgacttcaaagaaaaatcataggcttacatcaaaaacacttgggaaatttgtcttggctctgttccaatgaggccagttattctaaaaggggttactggattgtgttgggccttcatgtggtgtgtattttagaaccactgaattttaaactatttaagttcccttgtaaggatcctatgataaagtagcttgaaggaaagagttgagtgaaactcttgagtccgatttctggctgtactgctattgtcttacatggctgagcctgggtaagtcttgtctcagttcacacttcaggcccccagtgagtgaggtggccgtgatgacgctcttgtttaacaggcaagtaaagccagggtgttgaactctacggaagtgggcctggcgcggtggctcacgcctgtaatcccagcactttgagaggccaaggcaggtggataaggaggtcaggagattgagaccatcctggctaacacggtgaaaccccgtctctactaaaaatacaaaaaaattagccgggcgttgtggcgggcgcctgtagtcccaactactcgggaggctgaggcaggagaatggcgtgaatccaggaggcggagtttgcagtgagctgagatcgtgccactgcaccccagcctgggtgatagagcgagaccctgtctcaaaaacaaaacaaaacaaaaaaatctacggaagaaaggaaccatgtgaaagagcgtttgctaatgatctgtctgtctgatgagaattgtgtgtatagatttgtgtatacacaaatatgggtgttcactgtataaatcaatgtgtaaatgtgtccgagaactccagagttgatgagggcttgtaatgcacttaaaggtagctcaccacaagacagtcttcctatctgaaatcagcattgcagtcccagccatttcctgaagctaccaccctcactttctccccaactctgaaatgcttttcactctctacctaggccgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagcaaatgtgccgagcttgaagaagaattgaaaactgtgacgaacaacttgaagtcactggaggctcaggctgagaagtactcgcagaagaaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcattttgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcaggagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttctgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttct

SEQ ID NO: 4623 - DNA, 3107 bp, Homo sapiens
atgatacagtccaagcacctggatgatgagtatgagagcagcgaggaggagagagagactcccgcggtcccacccacctggagagcatcacagccctcattgacggtgcgggctcagttggcccctcggcccccgatggccccgaggtcccagataccctcaaggcacgtactgtgcctgcccccccgcaacgtgacccttctgcaggagagggcaaataagttggtgaaatacctgatgattaaggactacaagaagatccccatcaagcgcgcagacatgctgaaggatgtcatcagagaatatgatgaacatttccctgagatcattgaacgagcaacgtacaccctggaaaaggtgggtgcaggatgggagcagctctgtgggggaagagcgggcatgggggtgcggtgaccctgcagcccctcaaggcccagtctctggagccatctctcacctctccgactctgagcttccactgcactggcagtttgactcgtgcttcctgccctcggcttctgtctctcatgctctctgagtgtctcgccgtctggccaggtgggtctcatcgcctctgccagcgtcagctcccacagcgaaggtcttccgtgtgctgtcttcttctgccctcgctcacgagtttggattccttgctgaggagcagttctaacccggaatcactgtctgccggcaggatgcccagcatggggtttggatctcacactctgttttctcccccacgtagaagtttgggatccacctgaaggagatcgacaaggaagaacacctgtatattcttgtctgcacacgggactcctcagctcgcctccttggaaaaaccaaggacactcccaggctgagtctcctcttggtgattctgggcgtcatcttcatgaatggcaaccgtgccagcgaggctgtcctctgggaggcactacgcaagatgggactgcgccctgggtatgattggcctctccagctcctcccctcggtgctatcctctggccaaagaggtcctgggattgcaatagcctggtggtctggcgcaagggcgtggggtgccctgggctcggtagagagcaaaggatctcaccagggcggatggggaagcggtgctggacgctgctcagccctctctctgctctgtggccccagatgacatctaagagagacagtcagagtcagggattccatcaaatccctacctggggcgcccctgaccaacagtcctctggcctctgctgcatgcccaggcctccacagcgactccccgggggctgggaagtcatagtcatgctagggagggcccctgccaccgtctctgctcatggattcctttccttgccctcagggtgaggcacccattcctcggcgatctgaggaagctcatcacagatgactttgtgaagcagaagtaagtatcacctgagctaactgcggctctcactcgagcatcctttgtgtgctggtctggctgagaaagcagttccctatcccaaatcttcaactggagggatgggtgcctctgacctgggagtgagtggcagtggggggtatgcgagtgtgtggggagccgaaggccagggcggtcttgggaaaagggagctcacgtcacctgagaacacggtgtggggtgtgaaaacggccgccatcaccttgagcacctgccctgtagactgacacaagagttccccctggtttacacctaaggaacccggagctcagagaggagacgcctctgagcatggctcccagctggtaagggcctcagcccaactctcctgattttcaggccaggggccaccctctccccgtccctggaggacttgccaacgcacaggcgcgcatgcacaccaacaaagggtcaggacttgaggaggatgcctggagcacgcttctcctggctgactgtttcttcctctccagtcgtttcctctggtgggcctctccagggctccgccggggtgtggccaagaccctcgaggtggggtgtgctcagagcagggggcctgaagaatggctcctctgtttacaacacacccaacaggaagctggggtcatcgtgatgaggggcacaaacttgtggcctccctacagacaaatgccctacatgtggaccccctgcacctccgcatggcttccggggaggaccaatggcaaaaggctttgaaggcctcacttttgcaggcagaagtcctgggagtgggtttgggaatgagtgaagggctggaggggcaggacagtcctcttccaggagctgagctgcggcatcgggttgaggaggggccccctggaacccatccgttcagcaacaggtctgcttggctagcagcaaagtttactttcctctcatgccaaggtacctggaatacaagaagatccccaacagcaacccacctgagtatgaattcctctggggcctgcgagcccgccatgagaccagcaagatgagggtcctgagattcatcgcccagaatcagaaccgagacccccgggaatggaaggctcatttcttggaggctgtggatgatgctttcaagacaatggatgtggatatggccgaggaacatgccagggcccagatgagggcccagatgaatatcggggatgaagcgctgattggacggtggagctgggatgacatacaagtcgagctcctgacctgggatgaggacggagattttggcgatgcctgggccaggatcccctttgctttctgggccagataccatcagtacattctgaatagcaaccgtgccaacaggagggccagcttcttctcctggatccagtaagagtttcggcaccgttgacgaactgcagcgatcttactggccaagccagagcgcctcctctcagattccttctcgacacagcaccctaggcggcttcttcctgtcagtcggaggtggcatgcaagatgaagctctctttgctcttcccgctttcattttgtgcttttccttgtgttttcatgttttgggtatcagtgttacattaaagttgcaaaattaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaag

SEQ ID NO: 4624 - DNA, 1619 bp, Homo sapiens
agatcgcgttccgggacacacaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatcagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgct

SEQ ID NO: 4625 - DNA, 3137 bp, Homo sapiens
attcatgcactcttccatctttttgccattgtgccagctcaatttaaatgtatctgctctgtatctgttcaagtggagataatccatgcaaatcaggagccgtggctctcaatgcctggttcacagagaggactcagcttgaggaggtcactcgttcacagccgctcctcccattatatttttccccttattgcagaactgctgtatgtatacagtgactgaaaggactcaatttactgcaactgctgcctggctttacttacaacttttttttttttataaaggaacttacctccatctgtcttttcaaggttacagaccacttactctaaacttcacaaatggttctgaagagtatggagcctacgtagattcataagttacaagatcactgtttggcaatacgaggggatgtgtatctaaaatgacaaactgatcctggcacttgctacttattacagagcccaatgtttccaaaggacattaattttgatttctccaatgaaggcttgtggctgtccttatgctttacaaaacattaccaaatcagagccgaaaagaaaactggtatttatggcacaatgaaaaatttcatctttcccagaatgatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacagacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaaggacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagt

SEQ ID NO: 4626 - DNA, 3724 bp, Homo sapiens
ttaacaatgactttattaccgggaaggacgagtcaaaaaataggaaggcctgggaaccctcaggctcgccactctaggttttagagacctgaaacatcacagaagcttctgagtggttctgaagattcaagaggtttgcaggttgctatgttaatgttgtttgtctttggagtcttacttcatgaagtctcactgagtggtcagaatgaagctcctcctaatactcacagcattccaggcgaacctctgtataactatgccagcatccgcttgccagaggagcacattcccttctttttgcacaacaataggcatattgccactgtctgtaggaaagactctctttgtccatataagaaacacctagagaagctaaagtactgctggggttatgagaaatcctgcaaaccagagttcaggtttggttacccagtttgcagctatgtcgacatgggatggacggacactcttgagtcagctgaggacatattttggaaacaagctgactttggatatgccagagagaggctggaggagatgcatgtgctctgtcagcctaaggaaacgagtgactcaagtctggtgtgttcccgttatcttcagtactgcagggcaaccaatctctatcttgatttaagaaacatcaagagaaatcatgacagatttaaggaggactttttccagagtggtgaaattggagggcactgtaaacttgacatccgtacattgacgtctgaaggtcggcgcaaaagccctctgcagtcatggtgttaacatgtatcaccacttctgtgatttcatcaatctttatattactcagcacgttaataactcattcagtactgacgtgtacatcgtgatgtgggacacctgtctttcacctcccgccatggttctgaggcctccccagccatgtggaactagttcttacggatatggtgacctattctccgacacatggaatgcatttactgattatgacgttatacatttgaaaacttatgattccaaaagggtatgttttaaagaagctgttttttcattactcccccgcatgaggtatgggctgttctataatactcctctgatatctggctgtcaaaatactggactattcagggcatttgcccagcatgtactacacagactaaacatcacacaagaaggacctaaggatggaaaaattcgagtcaccattcttgcacggagcacccgaagttcaccaactactctttcgatgtagaagaatttatgtatcttgtccttcaggctgcagaccacgtattgcaacacccaaagtggccatttaagaagaaacatgatgagctataaatatgctgagtctgtttgcaaaaagagagtgtttaaacactccaacacccagacttagaattaaatcagtaaagcaatctgttatttcctatccccgaattaccttttctatgccaaaacataccttcaggatattgttatgtgttgtatagatgttaagtgtttcatgtggtttttgtgtcattgctatttatcaatagcaataattttgcactgaaaactttttatagttcaaaaattaagcatggactccccagtatactttaactttctttctttcttttttttttttttggagacagagtctcactgtcacccaggctggagtgcagtggcatgatctcagtttatgcaacttctgcctccccaggttcaagcgattcttttgcctcagccacctgactagctgggattgcagcctgcaccaccacacctggctaaatttttgttgttgtcgttgagatacagtttcactctgtcacccaggctggagtgcagtggcatgatctcagctcactgcaacctctgccttctggattcaagtgattcttgtgccttagcctcccaagtagctgggattacaggcgtgcaccaccacgcccagttgatttttgtatttttgatagagacggagtttcaccgtgttggccaggctggtctcgaactctgggttcaagaaatcctcccaccttgcctcccaaagtgctgggattacaggtgtgagccaccacgcatggccctgaactttctctttttaggaataccaaagttttcaactttttcagctttagaatttgtaaatatttttgtagaatatcatatgactgtaattccagagtgttccaacttgtttatgatatatttgggtaaatttacaactgttcttttatttgccataatctggttataacactgtttgtggtaggaaaggaaaacatgcaaaacatacacacacacacacacacacacacacacacgcagagttgtgattctcagtaccaagctataggaccatgttatagatcagcgtttagtcacctccaggttatatgcatcgagaacctgaataaatcatgccactatattaatttatattacatgtttcatatttaaatcatgttttcctaaaatgtagcaactacatgtgataaaagcaaattagaacattctgtaggactgtcttgcataccttctgtctggtttccactgattccttcttagccatggagagcatttgtgattaattaatttatatatgaaataatggtttccattttatgcgagtatttgtaactgcatataccagtgcgtgtgcgtctacctctgtcagcatgaaagtattccagtctttaatttcaaaaacttcaaattagcctcatgaagagaatttttccctgtgaaaagtaagaccaagaaaaaacaaactaaagacatgtgacttattcaatgaaagtgaaaaagaagctctaaaacagtgtcattgattaaaaagaatatctggaatgtagccccactctttgagtgggattcatttcttactgcttatgaactttcaatttagtagtcagaaaccatggatttattttactgcacaatgtgaagtttacattttattaacacttgagtagtctgatttagagactagttacttctattttttaaaataatggagtaacaaattacagaatagctaaataattttttaaaaatattttacagttgtaaaaaatatccatcagaaaaatgacacacaaaacaaaatatctggacctttacagaagacgtttgctgacccccactttaaaggattggaacagtcttctagaattgaggaatatttattaaaatacctgtaaagaaaatagtgaatcactgtagcaatggctttgattcagaccttaaaatcacataagaagaattacaacatgttatggatttttaagtggcaggtattgtaactgttttttgtgtgcaaaatactgagtaaccactgggaaaatatttcagatgaaagggatgacaaaagcatgttgcgctttgcatcagcaaggcattgacttctgaaaaaatgatctgaaaaaagtttcaccgtttgtcttcttacctcattttaagaagcatgtgaaaatgggatactatagactactgagaatttcagaaattgagaacaatttcataataaaacggctatatttgaagagagaatacattttatataaacaggaaaatacatttgacactttatggaattttatgagactttttgtgggaacagaaggtcttcaaattgtaaaatgtaaagattgctctttttattaagtctttaacagggatgtatttcattgtatgttttgggtatggctttggaataaatcattttatattttatttg

SEQ ID NO: 4627 - DNA, 926 bp, Homo sapiens
gcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagctctcagaaggcaaatgtgccgagcttgaagaagaattgaaaactgtgacgaacaacttgaagtcactggaggctcaggctgagaagtactcgcagaaggaagacagatatgaggaagagatcaaggtcctttccgacaagctgaaggaggctgagactcgggctgagtttgcggagaggtcagtaactaaattggagaaaagcattgatgacttagaagacgagctgtacgctcagaaactgaagtacaaagccatcagcgaggagctggaccacgctctcaacgatatgacttccatataagtttctttgcttcacttctcccaagactccctcgtcgagctggatgtcccacctctctgagctctgcatttgtctattctccagctgaccctggttctctctcttagcatcctgccttagagccaggcacacactgtgctttctattgtacagaagctcttcgtttcagtgtcaaataaacactgtgtaagct

SEQ ID NO: 4628 - DNA, 2142 bp, Homo sapiens
tattgggcagtacaggtctagatgatcaaatgcctacactgaatgacttcatagaatatcactgttgagctgacaccgatctaaaagattcacatgtcggagcaagactgttagtggagtaaactcctcgagtgtacaggacccctttgttcttgttctattttgtttttaacagcttgctctgctccataaagatccatcagtcaccctcaaactcttcggaccttctgcctgttcattcctatgaagctgcgtttgctaaggtactcggtgacctggagcaaacattctaaaacagcgcaaatggcagaagcagagcctacaggcttcttgtcgggaatccgttcggagtatggaaagaatcccagtgtctgtggacttctgggttgtctgctgtgcagttctgaaatgtaaccctgggattcctaaaagaatgtcaactctgtgctttggattttctgatgaatttcacccattcatcgaggcacttcttccacatgtccgtgcaattgcctatacttggttcaacctgcaggctggaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacagtgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccagtgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagcta

SEQ ID NO: 4629 - DNA, 2836 bp, Homo sapiens
agtttcagtaatcattgtgaatgagactgtgagaaacttggcttgttcagaagatactgtgcataagacatgagataacaagagtaatccacagacttaaaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggttcttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaactcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgttgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagatgctgagcaggaattactctcagatgacgcttcatctgtttcacaaattcagtctcaaactcagtcaccgcaaaatgtccctgaaaaattagaagaaaaccatgagctgttttccaagagcttcatctccatggaagtgcctgtcatggtagtaaatggcaaggatgatatgcatgatggtgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaaaaaa

SEQ ID NO: 4630 - DNA, 1481 bp, Homo sapiens
aaggggacagcactgagctctgccgcctggctctagccgcctgcctggcccccgccgggactcttgcccaccctcagccatggctccgatatctctgtcgtggctgctccgcttggccaccttctgccatctgactgtcctgctggctggacagcaccacggtgtgacgaaatgcaacatcacgtgcagcaagatgacatcaaagatacctgtagctttgctcatccactatcaacagaaccaggcatcatgcggcaaacgcgtaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccaccgcacgttcgtggggaacctggcgctaaaccattcgtagacgacccttgccgtctacctgaggggcctcttatgggctgggttctacccagtcaccccggccacctgcggtgctatctcccccagccccatcctctgtacagagcccacgcccccactggtgacatgtcttttcttgcatgaggctagtgtggtgtttcctggcactgcttccagtgaggctctgcccttggttaggcattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacccgtccccctgacaacactcattgacctgaggcccttctctccagcccctggatgcagcctcacagtccttaccagcagagcaagacgctgtgctgccctgcccacctggcctctgcactcccctgctgggtgtggcgcagcatattcaggaagctcagggcctggctcaggtggggtcactctggcagctcagagagggtgggagtgggtccaatgcactttgttctggctcttccaggctgggagagcctttcaggggtgggacaccctgtgatggggccctgcctcctttgtgaggaagccgctggggccagttggtcccccttccatggactttgttagtttctccaagcaggacatggacaaggatgatctaggaagactttggaaagagtaggaagactttggaaagacttttccaaccctcatcaccaacgtctgtgccattttgtattttactaataaaatttaaaagtcttgtgaaaaaaaaaaaaaaaaaaaa

SEQ ID NO: 4631 - DNA, 414 bp, Homo sapiens
ccggtgtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatcattgctgaagaggaaagcctgaaggaaagactcatcaaaagcatatccgtctgtcagaaagagctgaacactctgtgcagcgagttacatgttgagccatttcaggaattcacttggaatcttataacagtggtacgttgtcttattcaggaagaaggagagacaacca

SEQ ID NO: 4632 - DNA, 897 bp, Homo sapiens
ccggagcggacctttggcttggcttgtcagggcttgtccaggagttccgctcctctctccaaccggggtccccctccagcgaccctaaagcttcccagacttccgcttcaattcctgtccgccccccacgcccacctcaacgtggagcgcagtggtctccgaggagcgccggagctgccccgcctgcccagcgggatcagcacttcgcatcaaggcccaagaaaagcaagtcctccagcgttctgagcacccgggcctgagggaaggtcctaamagcccccgggagccagtytccaacgcctcccgcagcagcccgccgctcccaggtgcccgcgtgcgccgctgccgccgcaatcccgcacgcgtcccggcccgccccactttgcctatccccgggactaagacgggaatcytgtgaagcagctccagctatgtgtgaagaagaggacagcactgccttggtgtgtgacaatggctctgggctctgtaaggccggctttgctggggaagatgctcccagggctgttttcccatccattgtgggacgtcccagacatcagggggtgatggtgggaatgggacaaaaagacagctacgtgggtgaagaagaacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggsatcgtgctgg

SEQ ID NO: 4633 - DNA, 899 bp, Homo sapiens
  misc_feature (362)..(362): n is a, c, g, or t
  misc_feature (672)..(672): n is a, c, g, or t
  misc_feature (898)..(898): n is a, c, g, or t
ggatgcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgtttgccccctgaagagcancccacccctgcccacggrcggcacccccttaaaccccaaaggccaaaccgggagaaaattgactcaaaattattgtttgaagactttacaatgttcccaggccatgtaatgtgmgctcatcccaggcggstgctgytctctyttatkccctytkgtacgcactaacatggcaayrgtgcstggactcctggagaatggtgtcacccacaaatgtccccatctattgagggctatgcctgtgcccccatgsccatrcatgcgtctgggatctgggctgmgccgagkatctcaactgtacttacctcmatgnaagatcctgyactgtagcgtgggctattccccttcgtttactactgtctgagcgctgagaattgtccggggacaatcaaggagaaaactgtgttwatgttagctctgggactttgaaaaatgagatggccactgccgcatcctcaatcctccctttgagaagagttacgagttgcctgatgggcaagtgatcaccatcggraattgaacgtttccgytgcccagana

SEQ ID NO: 4634 - DNA, 1029 bp, Homo sapiens
cgccgagcggaggaggcaggaaccggagcgcgagcagtagstgggtgggsacgcatggstgggatsaccaccatcgagggggtgaagcgsaagatccaggttctgcagcagcaggcagatgatgcagaggagcgagctgagcgcgctccagcgagaagttgagggagaaaggcgggcccgggaacgaggctgaggctgaggtggcctccttgaaccgtaggatccagctggttgaagaagagctggaccgtgctcaggagcgcctggccactgccctgcaaaagctggaagaagctgaaaaagctgctgatgagagtgagakaggtatgaaggtatattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctkakctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgcctgargaaarcmtgcgggaagctgacctttaactgagggstgatctttaamtgggaggctgctttctcctttcaccacccctccttccctgtgtctttttcgccaactgtctctgcytcttccggagaatcarctgggstagaggtgagmmctttggaaacacawtwaagggaa

SEQ ID NO: 4635 - DNA, 963 bp, Homo sapiens
catcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgagaagagggatatggggaaattgagtgaamacgtcttagcgaagatgaacaatgcacattggggttacagagatggttttgtcgcctgtggtttatgaatgaaaaatctactactcccgtctcaaagtccaatacccctactccacgaactgatgcgccacccaggcagtaactctactcccggattgaggctgtactggraaacamcaggagtgacctttggctcagctaag

SEQ ID NO: 4636 - DNA, 995 bp, Homo sapiens
gaggcactgaaagahcagcagaggcataaggttcgggaagaggttgttaccgtgggcaacwctgtcaacgaaggcttgaaccaacctamggatgamtcgtgcatttgacccctaaamaagtttcccataaagcagttggagatgagtgggaacgaatgtctgaatcaggmattaaamtgtwgtgccagtgcttaggctttggaagwggtmatttcaaawgtgattcatywaratggtgccawgacaatggtgtgaactacaagattggagaraagtgggacmgtcagggagaaaatrgccagatgaaragmtgmacatgtmtwgrgaaaggaaaadgagaawwmaagagtgacmctcatgaggcaaagwgwwaagatratgggaagamaaaccacgtagagaraacagwggmagaaggaatatctcggtgccatttgctcmtgcacaagctttgagaagccagcgggagmwggcgctgtgacaactgccgcagacctkggggtgaacccagtcccgaagcactactggccagtcctacaaccagtattctcagagataccatcagagaacaaacactaatgttaattgcccaattgagtgcttcatgcctttagatgtacaggctgacagagaagattcccgagagtwaatyatctttccaatccagaggaacaagcatgtctctctgccaagatccatctaaactggagtgatgttagcagacccagcttagagttyttctttytttcttaagccctttgctctggaggaagttctccagcttcagctyaactyacwttttttccwattatcaccctkggagtttcctgagggktttctcataaatgagggsygcacattgsctgttctgcttcgartattcaawaccgctcartawtttaaatgaartgatttwaaatttkgtttgggatmawagggaaasmtawgcgccaccagaagcaawgtttgaaagrwatgacmaattttartaggaa

SEQ ID NO: 4637 - DNA, 1008 bp, Homo sapiens
  misc_feature (378)..(378): n is a, c, g, or t
  misc_feature (382)..(383): n is a, c, g, or t
  misc_feature (388)..(389): n is a, c, g, or t
  misc_feature (397)..(397): n is a, c, g, or t
  misc_feature (596)..(599): n is a, c, g, or t
  misc_feature (601)..(601): n is a, c, g, or t
  misc_feature (616)..(618): n is a, c, g, or t
  misc_feature (622)..(624): n is a, c, g, or t
  misc_feature (628)..(628): n is a, c, g, or t
  misc_feature (648)..(648): n is a, c, g, or t
  misc_feature (651)..(651): n is a, c, g, or t
atgtgaggctcgcggcacagcgttctctgggctccccagaagccagcctttcgctcccggcacccggcagcccgagcaggcagccgctgggaccgggcgccacmcccyctgcggcgtgtcatgggcccgcsccgccgcgcmsccgamagcccgasgccccgaggaggcgccccgascccgcccccgccccccggcccctcccggcgggcgcccctccttaggcscytccycccmtcmmcacagtcggcggmsmcaasgttggctamaggmgmtccgamagcttcagmagascacmcacctcttsataaggaasctgcccttcmsccgcctggcaagagaaatatgtgtymaattcactcstggtgtggmcttcaattngccnnccccnncccccttngccccccaagaggcagcagaagcatttctagttcatctctttgaggmcgcctatctcctcaccttacatgcmggccgcmgttactctcttcccaaaggatgtgcaactggcccgcgmggatccggggccttgaggagggactcggctgagctcctgcacccagtgtttctgtcagtctttcctgctcagccaggggggnnnntnccggggcctctcccnnnccannnctcnctccaatggcttctcccctnctntctggcctttgctgtctctgmacagctatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggttatgtacttattatttttagctctttctgtaatatttacatttttttaccatatgtacatttgtacttttattttacacataaggggaaaaawaagaccactttg

SEQ ID NO: 4638 - DNA, 920 bp, Homo sapiens
ctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagagagcacctctatcgccaccacggagcactggttcactcctgacaccctggcac

SEQ ID NO: 4639 - DNA, 886 bp, Homo sapiens
gcgttamaagccctttggcgcctgcgwattcgtgaaatgtgaaaaaagcrcgcctctgttgggacrrraaatcaacctttctattggtcagggttagaaaccccgcctttgaggcattttcaaccaatggaagcgcggmattcttcaattaaactgtctataaatttctgcctagtcaaagttaagaaatggcgccagggatttgaaccgcrctgacgaagtttggtgatccawcttccrarwaacgccagggatttmgaatcrcgawgawcatcccctctctagaggagctggactccctcaaaaaaaagaaaaaaaaaaaaaaaaaaaaaaaaaataatagaaramwmmrrraaaaaaaaaaaaraaaamaaaaaaaaaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggraatggagtccattgatcaatatattgagagaaaaaraaacattttggagaacacaattcctgaatgaactgaag

SEQ ID NO: 4640 - DNA, 3119 bp, Homo sapiens
gtgaagtggtcggggcgagcagagggtgcgaaggtgcgggtgctggtgcctcgcagcaggagggagccccggctgcgccgcgcgactccctctttggccctcggagcgcagcacccggcggacaagcggcgggacgccaggacgcggcgagcaagatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccagttttggacttctgtaaagtgtttctcatatctggggtcactttagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaagatcatctctacaactaagatgctgtagttctatctttgcaatgtgtcataaattctcttctttttcccccttaagtagtatatatgttaggattaccctctggtaattgatacagatattggaaaaaagacaacattgatgttatttgtgctctttgtttggcctagaatgtttataaagtggtaacacaaccattctggaaatgtatcccatagaagctgatgtttaacatatgaaaaaaaaagtattgtctataaaatgtttcttcagtactttttaaatgctgtgtattgggtgtaaggtatttgtcatcttacattagtaaacccaataagccaagttgaaggtggattatagtaaatgtacaactgtgctcactaggcttcaagtaaaaagttttcctttcatctttgactgtaagatgtcaaagggaggcagcctgcttgaacaggaaacaatacacaaaaggttgccaactcgcatgagctacctccctcttttcataaagtatttttgacatatctgtcaacccacttgactgtgtgggtgcattgagaacacaaagtttcctagacacacaggagaagtagcttaaattcactaatattaatttaaaaagcagcatgaaccctctacttataaacaagggtttggtgtttttaaagtgtgtatacatacatacacatacacacatgcacatatgtcaaatataatttttttaaaaattgagtggcacatcaaagaaatgtgaaattaaaaagaattcttccaaaaagcagcttccattaaaatgggaattcagtatgcacatactgaatgcatatatgtagaaccatacagaatttaggtggataagggctagaaattttgagcaacaaaatttgtcacttgaccagattttatcttcaaaaactgtattctactccttctcctttgctgttgaggtaacttgcatattatatgtattctgtatactcagttcataaggttatttagcacaaagtatagcagcttcacctggagagctgcttttgctcagtaaattcaacttccatgttttatctttttttgttcaataaaaacatttaatgtc

SEQ ID NO: 4641 - DNA, 524 bp, Homo sapiens
  misc_feature (24)..(24): n is a, c, g, or t
  misc_feature (88)..(88): n is a, c, g, or t
  misc_feature (274)..(274): n is a, c, g, or t
  misc_feature (342)..(342): n is a, c, g, or t
  misc_feature (482)..(482): n is a, c, g, or t
  misc_feature (489)..(489): n is a, c, g, or t
agagaggctggcggcagtggtggntctcccggctgggttgtcagtcagtgagaggagggggaagatggctcaccgggacccgttctgntaggaagaaggggagcaggtggtgctgctactcgggaggaagcagagcagcctccgtcgctgtcgctgagagcctcacgagtcgaggtcctgcaggtggagctccggcagccgccctggttgaaggtttagaacagatgtggaaaaatgtttacttcagagaaaggggttgtggaggaatggttgncagagtttaagtattaggttactcttgatcaaatgacggaaatggaatgttgcctcgagatcttttgngtcatacttttgaaatattgaagaatgccttaatctcgtctttatgtaagcagttgcagtaaaacctttttttccccgtcgggagaattgtgaaaggtttccaaatagtccacatttgcttgcccttctgacattaccanaaacatntttaccaaattatgccacaaatttgaaagacaaga

SEQ ID NO: 4642 - DNA, 499 bp, Homo sapiens
  misc_feature (437)..(437): n is a, c, g, or t
atttgtagaggatcttcagggacaggctctgggcatttagtgaaagggacagcgattcctttgcctatactctggtggtttagaaaaggacctcagggaacatttgttttgttttgctttgttttccttttgattagggcatttggggtctagaaaagaagattcaagcaggatccatttaatttatttagtttgcctcacagacatgaagcttcagaatggtcgtcccattccacctacatcctcgcctagtctcctcccatctgcccagctgcctagctcccataatcctccaccagttagctgccagatgccattgctagacagcaacacctcccatcaaatcatggacaccaaccctgatgaggaattctcccccaattcatacctgctcagagcatgctcagggccccagcaagcctccagcagtggccctncgaaccaccacagccagtcgactctgaggccccctctcccaccccctcacaaccacacgctg

SEQ ID NO: 4643 - DNA, 582 bp, Homo sapiens
accaactctaagcttggggccctggagagaacagttgtggcctgcaggtcattagtgaggtgagcagaagggaatcctggacttcccagagaaagaggagaccatgccagcctcgtggaacacagctaccaggaaatacagaagcaggtctattccttgcgaactccgaagtccatgaaaaaacggacccacagtggggtggctaaaatgtcccagcgcaagctgccgctgctgctgatggaccatagctcaagggcaaggcttgtaaaggattttacaaaggattttaaagtatagccagaaaagatacggtgtttagaagttaaacgctgttgtctgaaggaagtttgccggaaagatgtaggcttcaagggctactggacaatgattggtctgaacttcaacttacgggaactgctgacaaaatttgaaaaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgac

SEQ ID NO: 4644 - DNA, 629 bp, Homo sapiens
  misc_feature (517)..(517): n is a, c, g, or t
gctgttctccttgccgaagtgtggtctttggagctaagtgaagaatgacttctgttaggtttcctctgctggtcttccttgcagcctcgaaaacctcaccagagtcgcctctgctggtctcttactgtgctgctctgtcagagatgggcaatagagacaggattcaccgtgtcggccaggatggtctccatctcctgacctcgtgattcgcccgtctcggcctcccaaagtgctgggactacaggcatgagccaccgcgcctgggcagaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacangtaatagccaggaacagaaacggctactgatggatttggatattccatgaggacggtggactgtccattcactgccaccttttatggcgcactgtttcgggagggtgatgtg

SEQ ID NO: 4645 - DNA, 3778 bp, Homo sapiens
agctctggatgatctgagtttgattatttttctttcggaggaaaagacaataccctcccacccatgagacaataccacactgtctgtgcccagcattggaggccaggctcactgcgaagatggatgagaaggaacccccccccagccttgctggctggcagttccccttgccagcccagctcagatgcaggaatttggggtctgcaggaaggactctttccctgtgccctgtttggttgagggtgtgaggacctgtttgagtcctggctttgccccttaccagtggtgccacctggcacaagttgcttcacctctccaagtttcaatttcattctttctgaatcttgggtgggggtcaccctctgttgtgaggatgagaggaggtgatggatgcaaaagtgctttgtaaatcacaaagtgcagggtagaagtaaaggattatgctattatagcaaaataagaacctaagaacaacctgcgttgccccataggagctggctatggaaggtcgatgccgttgagcctaagaacatgctcaggctcacagggcatgttctgatgcccaacgacaaagcccctcctggtgagggcactcaggcgcaggtgccggtcatgcaccctggcccctgcatgtctggcacctgggtggggatccaggagggggcaggatgggggctcttgggccacagggcttccctggaagtgagagttgagagcgccccttgccacagggaaacagagacttaaaaaggtaaatgtccacagtcttaccatggtaattggtagggtcaggatttgaacccaggcctcacagtcttaccatgataattgataaagccaggattcaaacccgggcctgagggactccagagccctgtccacttcaccatgctgcaacctgggctaggaatcctcctcctgagtttctgtaagccctggggccaggtccagagggctgagccacacctccaagtggcactgcccacaggtatcaggtgtccctggaaaggtgtccctgagctggtggcagagaaaagggctctcctgagtgttcaactccccgtctgtgtgaagcaatgccttggtcttcaagatctccggtgtcttccagcctgcctgccagtctcccttctcttcccttccacagcattcaggcacatagagccttctgcagcggcccctccccagccagcacttgacaggacagatgggggctaatctggccctgctaagcagcgacatgcctctcctggagaaggcaggggcttcctggaacttgccccagccttatcagcggaggtttgccccaacacatcccagaaacgagcaaaggttcagcgccgtgcagttggcaggtgtcgggatcatcagtcatccccttgtcagtcccaagcctgctgggcttttgtgagggtgccaggaacacaggctggaggatggcaggaggggagtagaggtgggaggaggggagtccatctgcagcaccaggtaaggggatggatgctggctcctctggtcacctcagctggaacactactcaaggtccctggctcctgtcctccacctgcccccaggggccctgcattcccatccccagggcctccactctccctgagccctgcagtctctcactcactcactcactcactcattcactcactcactcactcacagggtcttgagttggataacacagcataatgatcggccagtggactcccaaactaagaacacggagctgtcctcttggggagaggctcagggctcggggaagtgaagtccagctgagggcacagttggcctgagctgctctcagtacaggcagaggccttggtagctgtgctgtgatgagagttcgctccctgctgctctcttctggcatggagagatgaacctgtaatccaagtgttaaaaccgtgccctggggaaaaacactattaattctgaatcatctcttttgttgcattaaaaaaaaatagaagagaaaaacttcacatgacccactcaaggtgtgcaggcagctgtgtttgtcaggaaggcagaaggagttggctttgctttaggggaggagacgaggtcccacaacaccctctgaagggtatataaggagccccagcgtgcagcctggcctggtacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggagggtatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccaaccagcccagaatgcgactacagccaatacttcaagaccattgaagagctccgggacaaggtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccaatgcgagatggaggctcagaaccaggagtacaagatgctgcttgacataaagacacggctggagcaggagatcgctacttaccgcagcctgctcgagggccaggatgccaagatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctcaccaccttctttggagcaaggagatgcagctgtattgtgtaacaagctcatttgtacagtgtctgttcatgtaataaagaattacttttccttttgcaaatagaaaaaaaaaaaaaaaaaaa

SEQ ID NO: 4646 - DNA, 6325 bp, Homo sapiens
ctgggttgtcagtcagtgagaggagggggaagatggctcaccgggacccgttctgctaggaagaaggggagcaggtggtgctgctactcgggaggaagcagagcagcctccgtcgctgtcgctgagagcctcacgagtcgaggtcctgcaggtggagctccggcagccgccctgacattaccagaaacatctttaccaaattatgccacaaatttgaaagacaagagttctttagtttcatctctctataaagttatccaggagccacaaagtgagttgctagaacctgtctgtcaccagctctttgaattctatcgcagtggagaggggcagttgcttcaatttacgctgcaatttctcccagaactaatttggtgctaccttgcagtctcagccagcagaaatgtgcatagcagtggatgcattgaagctcttcttctaggggtttacaatttggaaatagttgacaaacagggacataccaaagtattgagttttacgattccatctttatccaaaccatctgtataccatgaaccttccagcattgggtccatggctctgactgagagtgcactatcccagcatggtttgtcaaaagtggtatacagtggacctcatcctcaaagggagatgctgacagcacagaatcggtttgaagtgttgacattccttttgttgtgttacaatgctgccttaacttacatgcccagtgtttctcttcagtcactgtgtcaaatttgttcaagaatctgtgtttgtggatatcctcgacaacatgtaagaaaatataaaggtataagtagcaggataccagtttcttcaggattcatggtgcaaatgttaacagggatttattttgccttttataatggagaatgggatctagctcaaaaagcactggatgatattatatacagagcccagctagaattatatccagagccattgctggttgctaatgcaataaaggcttcattgcctcatggtcccatgaaatctaataaggaaggtacaaggtgtattcaagttgaaatcacaccaacttcctctcgaatatcaagaaatgcagtaaccagcatgtcaataaggggtcataggtggaaaagacatgagcaacctgacaacaataatgatgctactgaattgggcatccttgtcattcctgagattagtgtcacaaatgtggccggagagagaaccgggaatggggaaaaaggcagaacactaggagagattgatgctcagcatatacagggtgtgcaggaaacagccacagatcctagaactgagagcaaaggcttgccagagatcaggaggcaaaaatctgtaagaaaaatgatggaggatggaataaactcacctggcagagtgcagttttagcagagcactttataactgcactccaaggaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatggagcatcaatcaggtcagcagagacctcctagtattagcattactctgtccacagattaattagtaacatatttttctcccataacctagtgaacctggaaatacaactttgcttctttatgaaagtaccctgggtctttcatccgtattcctgacaggagccctgatgtcttaaattctgaaggctcccctgactttatgaagggaagattgtctaggttgcagtaagttgaaatatggttttgttatttcttgattaagattttttccccttggtttgagtcttttttttccctcctcttatttgttattgttgccctaagattgtcagtgacaataaattttgacaggttgtctaatcaagttggttatgtctcatgtgaggttgtaaggtggtttttcttgttttggtttggtttggttttttaatagctcctattttgatggctgtgtgtttggccttcagagtcaaagggagtctgcatgtatgggaactgttttatagagaatggggcagaggcacaactccaggaattctctagctcctggtcaggaagccaatctgaaaacaggcatgtggaaacacaaaaatgatgtgtatgaaaagcacctgatgaaaatatttgtaagcagatcatctttatgattagaacaatttgctcaaagccctggaaaatgcctggtaacccagtgcctagaatattatatgattccaggggatggctagaggcatttctgttgttatctctgaaacatttttatatcaaaaatcagattgctggtaggtgtgttgttttgaagtgttttatctggatttagcatgtgaagatccctttcaattattaaggtataataggctgtaaagctgatttaccctactgctggactttggaaatcctagttagtttggactcctataattcagagcatacgtcattggaagacttcctggaaatcagtgtaaatcttgcaacatagctctcaagataccactgtataatatgtaattgtttgtctgcaaatgcatttttcatctataaaatgtcatgaaagaaaataaaggtagtgaaatatggacaaaggacatttatatattaactaaagttgtttatgtttgtgttcttaaatttaaaacacgaagaaaaagaaatgtctttcttgttagtgaacaggcctgttttaaatatcttagtatgatatcaaaagaataatcaatttagttacctcccaactaaaaagtaaaaatgaaaaagacgacatggcagaagttgaaacaaacttgtatgtatctgtatgtgacctctagatggaaataaaagtttgatgtttgctagccgtggtccttttggctatggttgcggttcccctgtaaagcaaatgtacttaagtcatcattcagagtgagagagagaaagcacggctgaggctgagtcagttgaccgttgaggaagacctaaggagctgtccagttcttggctctttttcactgtgactgcacagcggtttccttcttcatagtcccttgctgtagtcaccaagagagcatgctagtgttttcctcttgttcctgcttatgcagagctcagatatatgaaaaatttgtatgctttgaaggctgccaaagcatttatactctggacatagttttaactgcaactgctttggctaccagtttaaaccgagttcttcaaaaagcatgaactcgttttcattcattagccctgtttacaatgtggattttgacataaatgaatttgattttcttttagctccagtaacagaatggaataagatctattgccataaattgtagttaagaactgtaaggcaatcgggcagtgaaacttgatattgtattaacttaataggaaccctgtgtacaatttaaaatatttgtaaaatatcactgtgaatttacagatgtctttttgtcattctttaacaatgaatttcccctgtgcatagttattaatagtattggtattattaaaaactaatttggcattttaagattggcattttaagcaagttgaggtgcttaggaaacattgtagaataagtttggggaaatgttagctgacagagctgagagatcagattttcatgttctatcactgtaatggaacctcatttagacctctctagacctttgctagctgtgtggtctgaggaccagtaagtaggattggcattatctggtatcttgttaaaaatgcagaatttcatgccactctaggtctactaaatcagaatttgcattcttaacaaggttcccaagtgatttttatgagaagaaagtatcagagtgcaaacaaattactcgtctaatatgtagaattcccagtggtctcacagccctagatcaaatgtgtcagacactagatcattataatcttcattggttttgacagctaattaattagtttaataatattgacatatggcttcttaagtatttgaattctagattgctaatgatccttatttttgcagtaaaaaagtaacactttatatttttcttgttaactataaatggaatcagagctgtaaatgcctgaaattttaagtgtgaaaaggggtgccacccttttatatactgcacaacaaatttgcatttgtatattctttttaaaaaatctctgaagacttgctcagtgaaatggttctgattttttgcttcaaatgatttgcactaattgattttctggagagcggagttacgttaacaacaaaattcttttatagttcctttgatactatttcaaataaggattacacattgaaagtttttatagaaattatgaaaattggataatcttaactatggtaaccattactattatccatactactttctccccactgaactttcaaatttgaaaattggggtagcttttgtaggtcactttcttataaagatgctgatggtcacagatctcctaagtatccagaataatatttttatcatgagaaggattccacacaaaattggggtcttgcaccccatatttcagaggatctgaacagaaattgtggcttcattgcacattttaaatctctatagattcttgaaatcacccaacctctcacatttgaaaacccaacggcctggagtattctggtggcactggagccagcactagctttttggaatccaagtggggagagaaacaaaaatagacttttcaagggactgtcccagactacccagggcaaatgtcttcccttcccttcctgaagccacaggaaagcaccctggagtcctttgtataccactatggaaatttttaaggcaagctctcaagacttgaagagttggaattctcggcatttaaatgatgcctgaagtttgttttgaaaaagcaatatttcattgctcttttcaattgtgaagcaactgctcagcaaatattactcatttttttaaaaagttgaattaaagggaaatatatttttaaaaccaaaatagatcaaaatgatcccagttttaagggattttgcctattttggaagaataaaactaaaatgttaaaactgttgaattacagagaacagatgtactctgagacataattttaaacaaatatttaaaataaggcaggttaacatttgcgtttaggcacaataaatctgtattaaagggaagcacatcaaggaaatatatacatgttgaataatgtaactgaaaaatattttttaaaaaccacttaaaaagaaaaataatttgatgggtactttaagcattgtagatagaaattaatgtataatagtgtcctcccagtctttgtatgaaaaattaaaactctctagtcctttaatgagcatgaatttatacttctacatttgttgcttagtaaaattatactcagtactttgagttattcagatttatgtttaatattgttaaattcttcatcagagagcataaatatattgtcttctatactttgtaacttgtgcatatctaaagaaactaacaacgaacattttgggagatgtttttgtgtttttttatagtagagttttagagtacatttgtcttaataggaagtttttaccataaacccaagattttatttcacgtattgttgctttctcttatatggaacttattgtgtacctcttacctttatttctaatcatttagtgatactaatcttttcatagtaaatatatttgtttctaattgtattcctagagtttacattcctaaagaataaacgacgactttggctatttttgtgtgttccctaccttcttaaggctatggaaataaactggagtttagttttttgaatttttgtatatttgtgtaaatgttctccatatgtagtactttatacaacaagtgttgcctcttgttttattgaaataaaaactaaaaaaaaaaaaaaaaaaaa

SEQ ID NO: 4647 - DNA, 2636 bp, Homo sapiens
ggtgggtttttttgtttttttgagatgaggtcttgcactgtcacccaggctgctggagtacagtggcacaatctgagctcactgcaacctctgactcccagactcaagtgatcctcttgcctcagccacccgagtagcacatgccaccatgcctggctaatttttttttatttttttgtagagatggggttttgccgtgttgcccagactgatcttgagcttctgagctccagcgatcagcctacctcaacctctcagagtgctgggattataggtgtgcgccaccacacctggccatgtgtgttttcttacatctcctttcttacataaaagataccagtttcattccaggacctgactgtgaacttcacccaagaggaatggcagcaactggaccctgctcagaggctcctgtacagggatgtgatgctggagaactacagcaacttggtctctgtggagtctctgatgtccaaagatcttggtccaagttctgtaatttcccattaacagggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaagtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataagttccaacaaagtaataaattccaacaaagcaacaaatcaaataacttacacaatgctaaactgtgagtatgtatagaggagtaaaatcttataaatgtaatgaatatggaaaatttttctgccataagtcaaccctcaatgtaacatcagagaaatcatgtaggaaagaaataatttgtttaataaatgtattattcattgtgaactatgaaaaaaaaaaaaaaaaa

SEQ ID NO: 4648 - DNA, 661 bp, Homo sapiens
  misc_feature (503)..(503): n is a, c, g, or t
  misc_feature (612)..(612): n is a, c, g, or t
  misc_feature (650)..(650): n is a, c, g, or t
  misc_feature (658)..(658): n is a, c, g, or t
agaagcggctcgaggctggaagaggatcttgggcgccgccagtctttagcaccagttggtgtaggagttgagacctacttcacagtagttctgtggacaatcacaatgggaatccaaggagggtctgtcctgttcgggctgctgctcgtcctggctgtcttctgccattcaggtcatagcctgcagtgctacaactgtcctaacccaactgctgactgcaaaacagccgtcaattgttcatctgattttgatgcgtgtctcattaccaaagctgggttacaagtgtataacaagtgttggaagtttgagcattgcaatttcaacgacgtcacaacccgcttgagggaaaatgagctagcgtactactgctgcaagaaggacctgtgtaactttaacgaacagcttgaaaatggtgggacatccttatcagagaaaacagttcttctgctggtgactccatttctggcagcagcctggagccttcatccctaagtcaacaccangagagcttctcccaaactccccgttcctgcgtagtccgctttctcttgctgccacattctaaaggcttgatattttccaaatgggtcctgttgggaaagaatacattancttgagcaaccaaggctccttggatgtatccagttagnatcattantta

SEQ ID NO: 4649 - DNA, 830 bp, Homo sapiens
  misc_feature (275)..(275): n is a, c, g, or t
  misc_feature (364)..(364): n is a, c, g, or t
  misc_feature (587)..(587): n is a, c, g, or t
  misc_feature (651)..(651): n is a, c, g, or t
  misc_feature (685)..(685): n is a, c, g, or t
  misc_feature (757)..(757): n is a, c, g, or t
  misc_feature (779)..(779): n is a, c, g, or t
  misc_feature (785)..(785): n is a, c, g, or t
aaggcttgcagcccacagtggagtatgtggttagtgtctatgctcagaatccaagcggagagagtcagcctctggttcagactgcagtaaccaacatcgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggnctcagaccgggttctgagtacacagtcagtgtggttgccttgcacgatgatatggagagccagcccctgattggaacccagtccacagntattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggaggcactgaaagaccagcagaggcataaggttcgngaagaggttgttaccgtgggcaactctgtcaacgaaggcttgaaccaacctacggatgactcgngctttgacccctacacagtttcccattatgccgntggagatgagtgggaacgaatgtctgaatcaggctttaaactgtgtgccagtgcttaggctttggaagtggncatttcacatgtgattcatctngatggngccatgacaatggtgtgaactacaagattggagagaagtgggacc

SEQ ID NO: 4650 - DNA, 814 bp, Homo sapiens
  misc_feature (729)..(729): n is a, c, g, or t
  misc_feature (786)..(786): n is a, c, g, or t
  misc_feature (812)..(812): n is a, c, g, or t
atgctcttaaggacactttgacaagcagaccagctcagggtgttgtcaccactcaggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggacaagaagctctctctcagacaaccatctcatgggccccattccaggacacttctgagtacatcatttcatgtcatcctgttggcactgatgaagaaccttacagttcaaggttcctggaacttctaccantgccactctgacaggcctcaccaagaggtgccacctacaacaatcatagtgggaggnactgaaaagaccagcagagggataangg

SEQ ID NO: 4651 - DNA, 773 bp, Homo sapiens
  misc_feature (537)..(537): n is a, c, g, or t
  misc_feature (603)..(603): n is a, c, g, or t
  misc_feature (710)..(710): n is a, c, g, or t
  misc_feature (714)..(714): n is a, c, g, or t
  misc_feature (763)..(763): n is a, c, g, or t
agtgtgaaatcttcagagaagaatttctctttagttctttgcaagaaggtagagataaagggaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcaggtacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggangttgttttagctctgctaaaaactccagcgcaatttgatgctgatgaacttcgtgctgccatgaanggccttggaactgatgaagatactctaattgagattttggcatcaagaactaacaaaggaaatcagagacattaacagggtccacagagaggaactgaagagagatntggncaaaggacataacctcagacacatctggagattttcggaacgctttgcnttcccctgcc

SEQ ID NO: 4652 - DNA, 729 bp, Homo sapiens
  misc_feature (514)..(514): n is a, c, g, or t
  misc_feature (655)..(655): n is a, c, g, or t
  misc_feature (661)..(662): n is a, c, g, or t
  misc_feature (681)..(681): n is a, c, g, or t
aaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatccctgacctccctcctccagacagatggctctggaaagctcaacctgcaggagttccaccacctctggaacaagattaaggcctggcagatgcgaaatgcagtcaacgacgcaggattccacctcaacaaccagctctatgacatcattaccatgcggtacgcagacaaacacatgaacatcgactntgacagtttcatctgctgcttcgttaggctggagggcatgttcagagcttttcatgcatttgacaaggatggagatggtatcatcaagctcaacgttctggagtggctgcagctcaccaatgtatgcctgaaccagctggnctcatnncaagccatgcagatcactncagaattcaagttcaccctctattccaaagcatttacctaaagaccca

SEQ ID NO: 4653 - DNA, 650 bp, Homo sapiens
  misc_feature (628)..(628): n is a, c, g, or t
cagtgacagaagcaacaataattgtgaaaaatacttcagcagttatggactcatctgtcattcaaaggaaaaaagtagctgtcattggtggcggcttgattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgcccctttgagaagtttgaaaaactcctacccaganatgatgtgggagatttctttcc

SEQ ID NO: 4654 - DNA, 382 bp, Homo sapiens
ggcacgagtgagaaagactatgagatgctgtgcctcgatggtaccagaagacctgtgtaggagtatgcgaactgccacctgtccagagcctcgaatcacgctgtggtcacacggaaagataaggaagcttgcgtccacaagatattacgtcaacagcagcacctatttgtaagcaacgtaactgactgctcgggcaacttatgtgtggtccggtcggaaaccaaggaccttctgttcagagatgacacagtatgtgtggccaaacttcatgacagaaacacatatgatacctcatcactcctgtgaagcctgcactttccgtataccttataatctcagaggtagggctgtcaccaaggtgaagatgggaacgcagatgatc

SEQ ID NO: 4655 - DNA, 730 bp, Homo sapiens
  misc_feature (245)..(245): n is a, c, g, or t
  misc_feature (252)..(252): n is a, c, g, or t
  misc_feature (288)..(288): n is a, c, g, or t
  misc_feature (299)..(299): n is a, c, g, or t
  misc_feature (632)..(632): n is a, c, g, or t
  misc_feature (674)..(674): n is a, c, g, or t
  misc_feature (682)..(682): n is a, c, g, or t
gtgacagcgtgtaacaaagcttatagaaacctccaggagactgctatcatggcagagaagcccaagctccactacttcaatgcacggggcagaatggagtccacccggtggctcctggctgcagctggagtagagtttgaagagaaatttataaaatctgcagatgatgtggacaagttaagaaatggattgatatgtatatagaaggtatagcagatttgggtgaaatgatcctccttctgccngtatgtncacctgaggaaaagatgccaagcttgccttgatcanagagaaaatanaaaatcgctacttccctgcctttgaaaaagtcttaaagagccatggacaagactaccttgttggcaacaagctgagccgggctgacattcatcctggtggaacttctctactacgtcgaggagcttgactccagtcttatctccagcttccctctgctgaaggccctgccagaatcagcaacctgcccacagtgaagaagtttctacagcctggcagcccaaggaagcctcccatggatgagaaatctttaggcataccaatggtctaaagtttgcacaataaagactttacctaagtgttgattgtgcctgttgtgaagctaatgaactctntcaattatatgctaattaaatatacaactcctattcgctganctaggttngatgtgtttcattaggatctgatgtgattcagatttctcttctctgcc

SEQ ID NO: 4656 - DNA, 693 bp, Homo sapiens
ggagtgtttataggtgtaaaggataatcatcttgctctgattaaagtagactcttctgagaatttgtgtactgaaaatatcttgtttaagctctctgaaacttagttgatggaaacctgtgagtcttgggttgagtacccaaatgctaccactggagaaggaatgagagataaagaaagagacaggtgacatctaagggaaatgaagagtgcttagcatgtgtggaatgttttccatattatgtataaaaatattttttctaatcctccagttattcttttatttccctctgtataactgcatcttcaatacaagtatcagtatattaaatagggtattggtaaagaaacggtcaacattctaaagagatacagtctgacctttacttttctctagcttcagtccagaaagaacttcatatttagagctaaggccactgaggaaagagccatagcttaagtctctctgtagacagggatccattttaaagagctacttagagaaatacatttccacagttccaaacgataggctcaaacactagagctgctagtaaaaagaagaccagatgcttcacagaattatcattttttcaactggaataaaacaccaggtttgtttgtagattttagataaagctttaatgccatattcttttgctaaacgtttttgtctttactgtactagggcaat

SEQ ID NO: 4657 - DNA, 720 bp, Homo sapiens
  misc_feature (617)..(617): n is a, c, g, or t
  misc_feature (649)..(649): n is a, c, g, or t
  misc_feature (654)..(654): n is a, c, g, or t
  misc_feature (712)..(712): n is a, c, g, or t
caagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttcaagtgattcttctgcctcagcctcccgagtagctgggactacaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggngaattctgctgctggaaagctaaaaccatggnggcantctaaagaaaaatattatctaaatcaacatgttcacagaattaacttctacaaggagncagaacga

SEQ ID NO: 4658 - DNA, 654 bp, Homo sapiens
  misc_feature (621)..(621): n is a, c, g, or t
  misc_feature (643)..(644): n is a, c, g, or t
cagagacattatggaacgtggagacctggtgccctcaggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattattttctgaaggcaaaaatgcatgtttgttagaaacttggaatactgtcattatggctaagagaacaaatctgataaattgtgtaacctagtctcttctctacatggtgatgcatttcagcaattataaattaatataaatgaccaaaagtaacttgcatgagatatttgctatttcattcattgggcacatatcaaattataattttgatnttaaatggtcacccatgtattnngtgccagcgt

SEQ ID NO: 4659 - DNA, 723 bp, Homo sapiens
  misc_feature (610)..(610): n is a, c, g, or t
  misc_feature (613)..(613): n is a, c, g, or t
cttagaagatattttggagtatttagaggtaaagtggcttgaatccaggtggtagatatatggatgttttcaatactgttatttcaaactgatttattttaaattttcatagtgaaaatttaggaagagagaaagtttgcctcccaaaggcagtctccctgacatttctataataccaaaattattgtgaccaagaaactatttaaatgtatttagaagcaaaattatgtaatgaaaattatctgttgtcttattctttcataggtacccatttgaacctcctcagatccgatttctcactccaatttatcatccaaacattgattctgctggaaggatttgtctggatgttctcaaattgccaccaaaagtgagttgtgggtaaatggttgactctacagcattctgttttcttcatctattaaacttgaattagaggatcacattctaatataaaagcaactgttcatctgtttgtatatagggtgcttggagaccatccctcaacatcgcaactgtgttgacctctattcagctgctcatgtcagaacccaaccctgatgacccgctcatggcttacatagttctccctgtgtgaggatagctgcancanctctaaccactgcaaatcattgtttcttcattaactctgttctttgaattcatcttaatccttaacactttaaatttaataagccaccctttcttaagaaatcccaaaca

SEQ ID NO: 4660 - DNA, 591 bp, Homo sapiens
  misc_feature (400)..(400): n is a, c, g, or t
  misc_feature (405)..(405): n is a, c, g, or t
  misc_feature (437)..(437): n is a, c, g, or t
  misc_feature (461)..(461): n is a, c, g, or t
  misc_feature (503)..(503): n is a, c, g, or t
aattcgcggccgcgtcgacacgcctgcgagaagacgacagaagggtacggctgcgagaagacgacagaaggggcgcgcagcgctggtaccccgttggtccgcgcgttgctgcgttgtgaggggtgtcagctcagtgcatcccaggccgctcttagtgtggagcagtgaactgtgtgtggttccttctacttggggatcatgcagagagcttcacgtctgaagagagagctgcacatgttagccacagagccacccccaggcatcacatgttggccaagataaagaccaaatggatgacctgccgagctccaaatattaggtggagccaacacaccttatgagaaaggtgtttttaagctagaattatcatcctgagagtacccattgaacctccttcagntccgntttctcactccaatttatcatccaaacattgnttctgctggaaaggattgtctggntgttctcaaattgccaccaaaatcctcagaatttaaatatantaagccagccttcctcaagaatgcccagacatgggacagagaagcctgcaagacagaaaccggctgatgagggagatgcttgatctcc

SEQ ID NO: 4661 - DNA, 680 bp, Homo sapiens
  misc_feature (504)..(504): n is a, c, g, or t
gcggccgcgctggccccggggcgcgctgcagccccctgtcgcggcctcgctgcgcggccaccgctgctgccggggtgctggccgcgccgccggcgctctcctcccgccgggcagtcgccgccgctgccgccgcggccccgggctccgcgctgctgcccgcccgcccgctgctgtcacttgggctgcttcagctgatcttgggctgctgcatggtggcgctcagcttcggggcgctgtcgctgagcagctccccgcaggtgaagaactcgtgcccgttctgggccggctcctcggtgatactctctggaatcataggattaacaacttggaaaaggcctatgatactcctggtaaacctctttgtgctgctctctgtggtttgtgtcctcttaaatctagctggatttatcctaggctgccaaggggcccagtttgtgtccagcgtgcccaggtgtgatctggtggacttaggtgaaggcaagatttgcttctgttgtgaagaanttcaaccagccaagtgcacagacaaagaaaatgccttgaaactctttccggttcagccctgtagtgctgatcaccttctacttaagaaagtgctctttgccctgtgtgccttgaatgccctgaccaccaccgtctgcttggtggccgctgccctccgctacctgcagatattcgca

SEQ ID NO: 4662 - DNA, 631 bp, Homo sapiens
cgaacccagacacaagtcttcactccttcctgcgagccctgaggaagccttctttccccagacatggccaacaagggtccttcctatggcatgagccgcgaagtgcagtccaaaatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagcccaacttcttacccgaaagcatcactgccttggcccctcctcccggctgcccccataactttactgtctccttcctggggctagcaagggaagaaccggcctgggggtaagcctggatgtgggcccaagt

SEQ ID NO: 4663 - DNA, 3638 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtgaatcccaactatacaggaagaatacgccttgatattcagggtactggccaacgactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaggctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaattttttccctccactccatccctccctcccgtccttcccctcttcttctttccttaccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggcatgagccactgagcctggcccagaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccaccaaaaaaaaaaaaaaagacgaaaagaaaaaggg

SEQ ID NO: 4664 - DNA, 5952 bp, Homo sapiens
atgctttggtgggaagaagtagaggactgttatgaaagagaagatgttcagaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacagggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtccccacctgaaatgatgcccacctctccccagagtccccgggatgctgagctcattgctgaggccaagctactgcgtcagcacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtag

SEQ ID NO: 4665 - DNA, 1743 bp, Homo sapiens
tgcttctctccctctctcctcgctgtctttccctcggtcattgttctctctctcctcctgcctttgatgcacatacgttgtcacaattcattgactctcctctcttctctgttcttacactcaagcctaacggtgctttcgccaggcagcagcagcctctcctgcgagttttaggcatgtatgcagctcagtttgatcgagcgttccttttctgccttttcactcttacaaaagattaaaaggtggcgtcacattgctcccctgttccttcccgcaggagggacttaaaagggacaacaaaaactaatcactttcaataagcattttcttgctggaaaaaaaaaagaaaagaaaaaaaaagaaagaaaaaaaaaggcggggggtggacttagcagtgtaatttgagaccggtggtaaggattggagcgagctagagatgctgcacgctgctaacaagggaaggaagccttcagctgaggcaggtcgtcccattccacctacatcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggccccagcaagcctccagcagtggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagtgccctggtcgttgaaaaacagcagcatagacagtggtgaagcagaagttggtcggcgggtaacacaagaagtcccaccaggggtgttttggaggtcacaaattcacatcagtcagccccagttcttaaagttcaacatctccctcgggaaggacgctctctttggtgtttacataagaagaggacttccaccatctcatgcccagtatgacttcatggaacgtctggacgggaaggagaagtggagtgtggttgagtctcccagggaacgccggagcatacagaccttggttcagaatgaagccgtgtttgtgcagtacctggatgtgggcctgtggcatctggccttctacaatgatggaaaagacaaagagatggtttccttcaatactgttgtcctagatgattcagtgcaggactgtccacgtaactgccatgggaatggtgaatgtgtgtccggggtgtgtcactgtttcccaggatttctaggagcagactgtgctaaagaccttcctgccttgactttctgcaagacaatcattaataaagctgctctgtaaatactaaaaaaaaaaca

SEQ ID NO: 4666 - DNA, 513 bp, Homo sapiens
atgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaaggtaccctagaacttaaagtaaaaaaaaaaaaaaaaaaaaaaaattctgaggagaccttttag

SEQ ID NO: 4667 - DNA, 2158 bp, Homo sapiens
  misc_feature (1558)..(1558): n is a, c, g, or t
ctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggacccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgaggcctccttgcctatgaaattgaattaatggcacctcncttccttcgggcttgctgcgagagaggaagggcatgagtgggtttacaagcgcctggagcagctttgtccatcgtccgggcggcaagcgttgtcagatggggtgtgaagaaggcgctctgtgttcgcaggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgagaa

SEQ ID NO: 4668 - DNA, 2254 bp, Homo sapiens
  misc_feature (44)..(44): n is a, c, g, or t
acggcgagcctcatcctccgggtgcggcgctgagcagcgagtcncgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcatttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacacactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcakkrraa

SEQ ID NO: 4669 - DNA, 2199 bp, Homo sapiens
  misc_feature (44)..(44): n is a, c, g, or t
acggcgagcctcatcctccgggtgcggcgctgagcagcgagtcncgactgtgctcgctgctcagcgccgcacccggaggatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttcakkrraa

SEQ ID NO: 4670 - DNA, 2127 bp, Homo sapiens
  misc_feature (1)..(11): n is a, c, g, or t
  misc_feature (90)..(90): n is a, c, g, or t
  misc_feature (94)..(94): n is a, c, g, or t
  misc_feature (106)..(106): n is a, c, g, or t
  misc_feature (113)..(113): n is a, c, g, or t
  misc_feature (125)..(125): n is a, c, g, or t
  misc_feature (140)..(140): n is a, c, g, or t
  misc_feature (142)..(142): n is a, c, g, or t
  misc_feature (162)..(162): n is a, c, g, or t
  misc_feature (179)..(179): n is a, c, g, or t
  misc_feature (197)..(197): n is a, c, g, or t
  misc_feature (211)..(211): n is a, c, g, or t
  misc_feature (334)..(334): n is a, c, g, or t
  misc_feature (365)..(442): n is a, c, g, or t
nnnnnnnnnnnagggaaagcctgcatgggaagtgggaagttacttcccccctgcccaagggggaccccggtccatgttggcgggggtaancccntcccaccacccngcccggnggtttaaatgcngccggttacaggggngnggtccccatttcgcccattncagggcttgcgccaacntgttttggaaaagggccnattcgggtgcgggncccttttttcggcttattttacgccaagctgggcgaaaaagggggaatgtgcctgccaagggcgatttaaggttggggtaaccgcccagggttttttaccagtcaaaaacgtttgtaaaacgnggccagtgaaattgtaatacgacgacctcannnnnnnnnnnnnnnnnnnnnnnnnnnnnnnnnnnnnnnnnnnnnnnnnnnnnnnnnnnnnnnnnnnnnnnnnnnnnnggaaagtggcccaggcccccacggactgttacagaggcgacgtcgccgaccgccaacatggcggcgcccagtggcgtccacctgctcgtccgcagaggttctcatagaattttctcttcaccactcaatcatatctacttacacaagcagtcaagcagtcaacaaagaagaaatttcttttttcggagacaaagagatatttcacacagtatagttttgccggctgcagtttcttcagctcatccggttcctaagcacataaagaagccagactatgtgacgacaggcattgtaccagactggggagacagcatagaagttaagaatgaagatcagattcaagggcttcatcaggcttgtcagctggcccgccacgtcctcctcttggctgggaagagtttaaaggttgacatgacaactgaagagatagatgctcttgttcatcgggaaatcatcagtcataatgcctatccctcacctctaggctatggaggttttccaaaatctgtttgtacctctgtaaacaacgtgctctgtcatggtattcctgacagtcgacctcttcaggatggagatattatcaacattgatgtcacagtctattacaatggctaccatggagacacctctgaaacatttttggtgggcaatgtggacgaatgtggtaaaaagttagtggaggttgccaggaggtgtagagatgaagcaattgcagcttgcagagcaggggctcccttctctgtaattggaaacacaatcagccacataactcatcagaatggttttcaagtctgtccacattttgtgggacatggaataggatcttactttcatggacatccagaaatttggcatcatgcaaacgacagtgatctacccatggaggagggcatggcattcactatagagccaatcatcacggagggatcccctgaatttaaagtcctggaggatgcatggactgtggtctccctagacaatcaaaggtgtcggcgcagttcgagcacacggttctgatcacgtcgaggggcgcgcagatcctgaccaactacccatgagctgaggagccgccgaagccctccaaggccagtccagaggtgaagtttgaggccctccccccacccaccccacacgcacgcacgcacgctagaccgtttgctgcactaggaattcgagcttgggccccactcgcccagactggcccttctcgcatcgggacccgcgcttgcacgctgcaggagccgcaaacgtcagctgttctggaaaccgagaggtcccagagagaggagatacgggcgcatttgagagcaagggcctacttggccgggactgaagcttgcgagactaagagccagctcatctttgtaacattcataatacgggaaactgaggaccaggtggctcggaaaagagatgagttccagcttttacctaacacagggttctctcgtcgtcccccaacccctccagctcggcttctttgtgtccagggttgtagatttttggatagaggtgtttctgattctactgaactggccgaaaacctcacccagagccactgggattccagccaagagtggctgcggctaacaccaccaggacctcctggtcctgaggtgactccagtaggctccatgaggaatcccggaccctcaggacaaatgggagagttttgttttctctca

SEQ ID NO: 4671 - DNA, 922 bp, Homo sapiens
atggcagagaagcccaagctccactactccaatgcacagggcagaatggagtccacctggtggctcctggctgcagccggagtagagtttgaagagaaatttctagaatctgcagaagatttggaaaagttaagaaatgatgggagttttatgttccaacaagtgccaatggttgagattgatgggatgaagctggttcagaccagagccattctcaactacgttgccagcaaatacaatctctatcggaaagacataaaggagagagtcctgattgatatgtacacagaaggtatagcagatttgggtgaaatgatccttcctctgcccatatgtcaacctgaggataaagacaccaagcttgccttgaaccaacagagaacaaaaaatcgctatttccctgcctttgaaaaagtcttaaagagcaatggacaagactaccttgttggcaacaagctgagctgggctgacattcacttggtggaacttctctactacatggaagagcttgactctagccttatcttcagcttccctctgctgaaggccctgaaaaccagaatcagcaacctgcccatggtgaagaaatttctacagcctggcagcccaaggaagtctctcatggatgagaaatctttagaagaagcaaggaagattttcaggttttaataacgcagtcatggaggccaagaacttgcaataccaatgttctaaagtttgcaacaataaagtactttacctaagtgttgattgtgcctgttgtgaagctaatgaactctttcaaattatatgctaattaaataatacaactcctattcgctgacttagttaaaattgattgttttcattaggatctgatgtgaattcagatttccaatcttctcctagccaaccattttcctggaattaaaaattcagtaaa

SEQ ID NO: 4672 - DNA, 1823 bp, Homo sapiens
aaaaaaaaacaaataaaaaatgcccagtgtgagcatctgtagtcccagctatttgggaagttgaagcagagaatcccttgtgcccaggagtttgaggttacagtgagctatgattgcaccactgcactccggcctgggcaacagagtgagatcctgtctcataaataaataaataggcaaaggcttgttctgatcaccttgtccctgttttccccaagtcaacctagagagcagtagattctagggcaagaacttaagtgagctgactgctcacaaagaaggaaaggagtagtgtgagctagcacttgttgggagcctctgatcaacaatacaaggacccgtgttatcaacttctgttcattagggaaagagagttacaagagttaccaaaggggcctatcttaacttttctatggaaacccttcttttcctggagagtgccattggtgccattgctggattgaagacattctaccccactctggttttctcttctctgcagctaataatgggcgtattgggtttgggcttcattgccacttaccttccggagtctgcaatgagtgcttacctggctgctgtggcacttcatatcatgctgtcccagctgactttcatctttgggattatgattagtttccatgccggtcccatctccttcttctatgacataattaattactgtgtagctctcccaaaagcgaattccaccagcattctagtatttctaactgttgttgttgctctgcgaatcaacaaatgtatcagaatttctttcaatcagtatcccattgagtttcccatggaattatttctgataattttacaagccttctccttatctttggtgagctcctttctgctcatatttctgggcaagaagattgccagtcttcacaattacagtgtcaattccaaccaggatttaatagccatcggcctttgcaatgtcgtcagttcatttttcagatcttgtgtgtttactggtgctattgctaggactattatccaggataaatctggaggaagcacaacagtttgcatctctggtaggcgcagagctaagattcttctcctgggtcaaatccctaacaccaacatttatagaagcatcaatgattatcgggagatcatcaccattcctggggtgaaaatcttccagtgctgcagctcaattacatttgtaaatgtttactacctaaagcataagctgttaaaagaggttgatatggtaaaggtgcctcttaaagaagaagaaattttcagcttgtttaattcaagtgacaccaatctacaaggaggaaagatttgcaggtgtttctgcaactgtgatgatctggagccgctgcccaggattctttacacagagcgatttgaaaataaactggatcccgaagcatcctccgttaacctgattcactgctcacattttgagagcatgaacacaagccaaactgcatccgaagaccaagtgccatacacagtatcgtccgtgtctcagaaaaatcaagggcaacagtatgaggaggtggaggaagtttggcttcctaataactcatcaagaaacagctcaccaggactgcctgatgtggcggaaagccaggggaggagatcactcatcccttactcagatgcgtctctactgcccagtgtccacaccatcatcctggatttctccatggtacactacgtggattcacgggggttagtcgtattaagacaggtaagtactgaggaggccttggcaggagctctgatccccctcctaccatcccaaccccaccctgatcctgattgaattctgttagtcactgatcagctgc

SEQ ID NO: 4673 - DNA, 4660 bp, Homo sapiens
aattctgaactctattcagaggccttggggtggggcttgtttgtacatagtggccacataaagcctggtaaactcagctggtctccagggcgaggctgagggcagagagttggacacaaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactgtgccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacaggtaaggtaagattccgtgttgtctccgtggatgaaaattttcgccctcgaaatgaactggtaagccttgtttcccttcagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggatgttataggtacacatatggagagcctgtccctggtctggtgacacttagtgtatgcagaagatattcactatgccgttccgactgccacaacacacattcacagcttaacagcaatggctgcatcacccaacaagtacacaccaaaatgctccagattacaaatacgggctttgaaatgaagcttagagtggaagccaggatcagagaagaggggacaggtgtggaagtcactgcaaacaggatcagtgaaatcacaaacattgtatccaaactcaaattcgtgaaagtggattcacactttagacaaggaatccccttttttgcacaggtaagactggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggtaagttacaaagagagtaacaattgttctgataactggtggcttgatgaatttcatacgcaaacatctcatactgcaaagcattttttttccccaagcaagagttatattcacctcaaacctattattggtactttgacctgtggacaaacccaggagattcaagcacactacattctgaataaacagattctcagggatgaaaaagaattaaccttctactatttggtaaaagcaagaggaaaaatctcccaatcaggaatccatgtgttatccattgaacaaggaaacagtaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtgtataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgagctcatcaggtgtggctgaggtaggagtaacagtccctgacaccatcaccgagtggaaggcaggggccttctgcctgtccgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggtagttgtgcagctggaggtctcttccgctttcctggctgttccaacagagaagaatgaagaatctcactgtgtctgtagaaatgggcggaaaaccgtgtcctgggttgtgactccgaagtcactgggtaatgtgaacttctcagtgagtgcagaggcaatgcagtccttagaactctgtggaaatgaggttgttgaggtccctgagattaaaagaaaagacacagtcatcaaaaccctgttggtggagcctgaaggaatagcaaaggaggaaactttcaacacgctgccctgtgcatcaggtgctaatgtgtctgagcagttgtccttgaagctcccatcaaatgtggtcaaagaatctgccagagcttctttctcagttctgggtggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagacaacctcgtccattgggagcgccctcagagacccaaggcaccagtggggcatctttaccaaacccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccaaacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgctaacccatcaaaccctgcatttttccttctttgtggaacaagacatccaaataaagaatttaaaaccagctacagtaaaagcctatgattattatgagacatcagatgaattcacctttgaagaatacaatgccccttgcagtgctggtaaagtataaatgattcaatctaatgccacttgaaagaaaataaataagcatctcagttaaacagtaaagtctaatcccaacttcaaaat

SEQ ID NO: 4674 - DNA, 1146 bp, Homo sapiens
atgggcatcgggcgcagcgaggggggccgccgcggggcagccctgggcgtgctgctggcgctgggcgcggcgcttctggccgtgggctcggccagcgagtacgactacgtgagcttccagtcggacatcggcccgtaccagagcgggcgcttctacaccaagccacctcagtgcgtggacatccccgcggacctgcggctgtgccacaacgtgggctacaagaagatggtgctgcccaacctgctggagcacgagaccatggcggaggtgaagcagcaggccagcagctgggtgcccctgctcaacaagaactgccacgccggcacccaggtcttcctctgctcgctcttcgcgcccgtctgcctggaccggcccatctacccgtgtcgctggctctgcgaggccgtgcgcgactcgtgcgagccggtcatgcagttcttcggcttctactggcccgagatgcttaagtgtgacaagttccccgagggggacgtctgcatcgccatgacgccgcccaatgccaccgaagcctccaagccccaaggcacaacggtgtgtcctccctgtgacaacgagttgaaatctgaggccatcattgaacatctctgtgccagcgagtttgggctgagtttaaagatgattgtgggtagctcccataactcatgctgcacgctgggtccttctcatcccaactcctcaaagcggcaggagcaggaactggggactcctgagagaaggcttggatatggccttttattacacttcatccaaggaaatctgcccccaccctgtgcccaggcccgatcacgcatgaggctaaagacggaggccactccgctggctctgggtagatctgcccctggactgtttgccgactgcccggagcgccctctgccggtctgcagcttcccacaccacacggaagaagtggggaaactgaggatacattctttcctcctccaggtaaagggattctcaatgaagggcttgtgtgcaccttccacacttagatacctctactacctgaaaaccagcatgcagcatgtacatcaagagtaccaggcacatagtgctcaagtctgggctaatatgccacctgcagagagatgtaaagatgaagaagacaaagccatgttttcaaagtga

SEQ ID NO: 4675 - DNA, 5701 bp, Homo sapiens
gctcccaaggctgagattactctgcttcatctggatcgcccatctctggggtctcatggctgagtttcagttccccaatcctacctgctcctcagggggccagcactggggctgcaggtaggccacctgttgagacctggtgaaagatcaggtataataatgttctgcagtgaaaagaaattgcgtgaagtggaacggatagtgaaagccaatgaccgtgaatataatgaaaagttccagtatgcggataatcgtatccacacatcgaaatataatattctcaccttcttgccaattaatttatttgaacagttccaaagagtggcaaatgcctattttctttgccttctgattttacagctaattccagaaatttcctccttgacctggtttaccaccattgtgcctttggtcctggtgataactatgacagctgtcaaagatgccacagatgactattttcgccacaagagtgataatcaagtgaataatcggcagtctgaagtgctcatcaacagcaaactgcagaatgaaaaatggatgaatgtcaaagtgggagacatcattaaattagaaaataaccaatttgttgctgctgatttacttctcctatcaagtagtgagccacatggtctctgttatgttgaaactgctgagcttgatggggaaacgaacctaaaagtccgccatgcactatcagttacttcagaacttggagcagatatcagcagacttgcagggtttgatgggattgttgtctgtgaggtgcctaacaacaagttagataaattcatgggaatcctttcttggaaagacagcaagcattccctcaacaatgagaagataatcccgagaggctgcatcctgagaaataccagctggtgttttggaatggttatttttgcaggtcctgacactaaactaatgcagaatagtggtaagacaaagtttaaaaggacaagcattgatagattgatgaatactctagtactatggatttttgggtttctgatatgcttgggaattattcttgcaataggaaattcaatctgggagagtcaaactggggaccaattcagaactttcctcttttggaatgaaggagagaagagctctgtgttctccggattcttaacattctggtcatatattattattctcaatacagttgtacccatttccttatatgtgagtgtggaagtaattcgtctaggacacagttattttataaactgggaccggaagatgtattattctcgaaaagcaatacctgcagtggctcgaacgaccacgctcaatgaggaactggggcagattgagtacattttctccgacaaaacgggtaccctcactcaaaacatcatgacctttaaaagatgttccattaatgggagaatctatggtgaagtacatgatgacctggatcagaagacagaaataactcaggaaaaagagcctgtggatttctcagtcaaatctcaagcggatagagaatttcagttctttgaccacaatctgatggaatccattaaaatgggtgatcccaaagttcatgaattccttaggttacttgctctctgccacactgtaatgtcagaagagaatagcgcaggagagctgatttaccaagttcagtcacctgatgaaggggctctagtgactgccgctagaaattttgggttcatttttaaatcccggaccccagagaccataacaatagaagaattgggaacactagttacttatcaattacttgcctttttggatttcaacaacaccagaaaaaggatgtctgtcatagttcgaaacccagaaggacagataaagctttattccaaaggagcagatactattctgtttgaaaaacttcatccttccaatgaagtccttttgtctttgacgtcagaccacctcagtgaatttgcaggggaaggccttcggaccttggccatcgcatacagagacctggatgacaagtactttaaagagtggcataagatgcttgaagatgcgaatgctgccacagaagagagggatgaacgaatagctgggctatatgaagaaattgaaagagatttgatgctactaggtgccactgctgtagaagataagttacaggagggtgttattgaaacagttacaagtttatcactagccaatattaagatctgggtcctaacaggagacaaacaagaaactgccatcaacatcggttatgcctgcaacatgctgactgacgacatgaatgatgtgtttgtgatagcagggaataatgctgtggaagtgagagaagaactcaggaaagcaaaacaaaatttgtttggacaaaacagaaatttttccaatggccatgtagtttgtgaaaaaaagcagcagctggagttggattctattgtagaagaaaccataacaggagattatgccttaatcataaatggccacagtttggctcatgccctagaaagtgatgtcaagaatgatctcctagaacttgcttgcatgtgtaagactgtaatttgctgcagggtcactccactccagaaagcccaagtggtagagctggtgaagaagtacagaaatgctgttactttggccattggtgatggagccaatgatgtcagcatgattaaaagtgctcacattggtgttggcatcagcggccaggaaggattgcaagcagtcttagccagcgactattcatttgcacagtttagatatctccaaaggcttctccttgttcatggaaggtggtcttatttccgaatgtgcaaattcttatgctatttcttctataagaattttgcatttacacttgtgcatttctggtttggtttcttctgtggtttctcagcccagactgtttatgaccagtggttcatcaccctttttaacattgtttacacatcactgcctgttttagccatggggatttttgaccaggatgtgagtgaccagaacagcgtggactgtccccagctctacaaaccaggacagctgaatctgctttttaacaagcgtaaatttttcatttgcgtgttgcatggaatctacacctcattagtccttttcttcatcccctatggggccttttacaacgtggctggagaagatgggcaacatattgctgactaccagtcctttgcagttaccatggccacatctttggtcattgtggtcagtgtgcagatagccttggataccagttactggactttcattaatcacgtcttcatctgggggagcattgccatttatttctccattttatttacaatgcacagtaatggcatctttggcatcttcccaaaccagtttccatttgttggtaatgcacgacattccctgacccagaagtgcatctggcttgtaattctcttaacaacagtggcttcagttatgccagtggtggcattcagatttttgaaggtggatttatacccaaccctgagtgatcagatccgccggtggcagaaggctcaaaagaaggcaaggcctccaagtagccgaaggcctcggacccgcaggtcaagctcaagaaggtctggatatgcttttgctcaccaagaaggctatggagagcttatcacatctggaaaaaatatgcgagctaaaaatccacccccaacatcagggctggaaaagacacattataatagcactagctggattgaaaatttatgtaagaaaaccacagacaccgtgagcagctttagccaggataaaacagtgaaactgtgagtcaatatgaatttaaaccacgtagttatcttttcacttcaggtggagctgaaattctgctggctccagagtttgagatttgaggcaagaggtggggcaggcagattgcctcacttaacttaaatctgcggcagacaactgccagtgcccatcaaacaggagtgtgcgctatggaaaaccaggccagagggtcactgtctggtttgtgatttggtggacaaaacactcgctgttacaagtacagattttttttttttttaaatcaacctagataccaattgacctgaactttagaatcttatttatggagaaaaacttgtaaagctgcatattcactgaatggatcctcaggcggataaaagggtgcattttaaaggtatatatccaagctgaaaagcatgcctattgacagataaacatgtatctgtaagatcagcctttcccaaggtatacttttaaaatttaaagcgtgtactgtgttgctttcagactgagttgcatgtcactctttagtcttgatatctacctgtctgttcagccaggacaacaaatggcttccaagcctgaagaatacaaaagtgtgcttgtgtttctcatttttataccagtctagggacaaaggagactgaacatctttgcagcaggataggctggtaatttgatcaaatttattcaaaaagctctcagtctgtgtcatgtaaggacatgcttatgaaatgtgagagaggctcgccactaagtattctaaatacttttcaatggcttttctaacaacctcagtagtaatttgctgagcatcatccagaccattaatagaatcagcaaagcactggaatttcacactttaatgataatattccacatagtctatgggcaaatattttcaacatttccaatttttaaagcttcagaattgaagccaaacaaattaataaataattgttttaattactatttaaaaactcaggtttagattgtttaaaattagttgcttttgatactcagctgtcatgtttataattcaaacatgtagtaaacatatgtaggtaaggttgtttttttggagatgttgcagctcaaatttcagtccacatatgaatcatcagtgtattttccataaagtgattcgggcatatttgtgtgaaaacctcagttctgtcacttcttacctctataaacttggacgataatgtgccttctctgagactcagtttcttcctctgtaaaatgaggacatactacctacctcatgtggttggttgatgattgtctgtcaaagcacaaactctgaaattattaaaaacataattatttcataaacagatgagttaagttccagttaactcaacatcagtataacagagcaattggaagagaatatgaaaaaactggaatctaaatagtcagtgaggaaggctttgataaaatgaaattgccagaaagatataaaactggttagggtcctacagggaaataaaattataaccgtggaggtacatttctctaccagaaagcaaaaataaagcatcatgtcttaatggttttctacaaatcaacttctaattctacagagtccttaatctggtccctattaaattcttggtcagacaaagttacatttcccaagagagtcaggtgacacttgagtgagtttgatggataatgagctaatgtgatatctataggtcacaattttttaaaaccaaaattttcaagtctgggataatctttcctaaatgggatcaaatgaaataatatgtgtaaaagagtcaaatgcagtcctttaccatagtaactgcctatggacgttgtctttcccttacatgcctgcctacacttaaccagatgttggttttcaatgtctaatttgtcattagtttcaccacatttgctcactttttgtaacatttttgcaagatttgaaaactttcagtaaatgttttggcactattggtaaaaaaaa

SEQ ID NO: 4676 - DNA, 1663 bp, Homo sapiens
gcacccggcagcggtctcaggccaagccccctgccagcatggccagcgagttcaagaagaagctcttctggagggcagtggtggccgagttcctggccacgaccctctttgtcttcatcagcatcggttctgccctgggcttcaaatacccggtggggaacaaccagacggcggtccaggacaacgtgaaggtgtcgctggccttcgggctgagcatcgccacgctggcgcagagtgtgggccacatcagcggcgcccacctcaacccggctgtcacactggggctgctgctcagctgccagatcagcatcttccgtgccctcatgtacatcatcgcccagtgcgtgggggccatcgtcgccaccgccatcctctcaggcatcacctcctccctgactgggaactcgcttggccgcaatgacctggctgatggtgtgaactcgggccagggcctgggcatcgagatcatcgggaccctccagctggtgctatgcgtgctggctactaccgaccggaggcgccgtgaccttggtggctcagccccccttgccatcggcctctctgtagcccttggacacctcctggctattgactacactggctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccagggtggagatgaagcccaaatagaaggggtctggcccgggcatccacgtagggggcaggggcaggggcgggcggagggaggggaggggtgaaatccatactgtagacactctgacaagctggccaaagtcacttccccaagatctgccagacctgcatggtcaagcctcttatgggggtgtttctatctctttctttctctttctgtttcctggcctcagagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggtgcttggagggggaagagatcccaggaggtgcagtggagggggcaagctttgctccttcagttctgcttgctcccaagcccctgacccgctcggacttactgcctgaccttggaatcgtccctatatcagggcctgagtgacctccttctgcaaagtggcagggaccggcagagctctacaggcctgcagcccctaagtgcaaacacagcatgggtccagaagacgtggtctagaccagggctgctctttccacttgccctgtgttctttccccaggggcatgactgtcgccacacgcctctgtatatatgtctctttggagttggaatttcattatatgttaagaaaataaaggaaaatgacttgtaaggtc

SEQ ID NO: 4677 - DNA, 2756 bp, Homo sapiens
tgaccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacatgcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgaccgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccacatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtaaagggcgaat

SEQ ID NO: 4678 - DNA, 2020 bp, Homo sapiens
gcagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaagatttgtgttcttctacaggaacgtggtgcccaggacaggcggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaaggtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggacaatattgttatattatctaaacaagtagaagatctaaatgtgaaatgtcagctgcttgaaacagaaaaagaagaccatgtcaacaggaatagagaacacaacgaaaatctaaatgcagagatgcaaaacttagaacagaagtttattcttgaacaacgggaacatgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgt

SEQ ID NO: 4679 - DNA, 8684 bp, Homo sapiens
gagctgccacttttcaccgttagaagtagagctttttccagacctcctaccttttagtctactttgaaaggtgaaagaaagaacatcgtttcaggaataaaaatgcacagtagtagttatagttaccgtagcagtgattctgtgtttagtaacactaccagcactcgaaccagtcttgattcaaatgaaaatcttctcttggttcattgtggtccaacactgatcaactcttgcattagcttcggtagtgaatcctttgatggacacaggttagaaatgttgcaacagattgccaacagagttcagagggacagtgtcatctgtgaagacaaactgattcttgctggaaatgctcttcagtctgattctaaaagattagaatcaggagtgcagtttcagaatgaagcagaaattgctgggtatatacttgaatgtgagaaccttttacgccagcatgtaattgatgtacagattcttattgatggaaaatactaccaggcagatcaattggtacagagggttgcaaaactgcgtgacgaaattatggccttaaggaacgaatgttcttctgtgtacagcaaaggacgcatactgacaacagaacagacaaagctcatgatatcaggaatcactcaaagtttaaactcaggatttgcacagaccttacaccctagtctgacctcagggctgacccagagtttaacaccttccctaacctcttctagtatgacttctggcctgtcatcagggatgacttcccgcctgactccatctgtcactccagcttatacacctggtttcccatcaggattagttccaaatttcagttcaggagtagagccaaattcattgcaaactttgaagttgatgcagatccgaaaaccccttctaaagtcttctttgctggatcaaaatttaacagaagaagaaatcaatatgaaatttgttcaggatcttttgaattgggttgatgagatgcaggtacaactggaccgcactgagtggggctcagatttgccaagtgttgaaagccatttagaaaatcataaaaatgttcatagagctattgaagaatttgaatctagtctcaaagaagctaaaatcagtgagattcaaatgacagcacctcttaaactgacttatgcagaaaagttgcacagattagagagtcagtatgcaaaactcttgaatacatccaggaatcaagaacggcaccttgatacactccataattttgtaagtcgtgcgactaatgaacttatttggttgaatgaaaaagaagaggaggaagttgcttatgactggagtgagagaaacaccaacatagctaggaaaaaagattatcatgctgaattaatgagagaacttgatcaaaaggaagaaaatattaaatcagttcaggagatagcagagcagctacttctagaaaatcatccagcccggttaactattgaggcctacagagcggcaatgcagacgcagtggagctggatcttacagctctgccagtgtgtggagcagcacataaaggagaacacagcgtatttcgagtttttcaatgatgccaaagaagctactgattacttaaggaatctaaaagatgccattcagcggaagtacagctgtgatagatcaagcagcattcacaagctagaagaccttgttcaggaatcaatggaagagaaagaagaacttctgcagtacaaaagcactatagcaaacctaatgggaaaagcaaaaacaataattcaactgaagccaaggaattctgactgtccactcaaaacttctattccgatcaaagctatctgtgactacagacaaattgagataaccatttacaaagacgatgaatgtgttttggcgaataactctcatcgtgctaaatggaaggtcattagtcctactgggaatgaggctatggtcccatctgtgtgcttcaccgttcctccaccaaacaaagaagcggtggaccttgccaacagaattgagcaacagtatcagaatgtcctgactctttggcatgagtctcacataaacatgaagagtgtagtatcctggcattatctcatcaatgaaattgatagaattcgagctagcaatgtggcttcaataaagacaatgctacctggtgaacatcagcaagttctaagtaatctacaatctcgttttgaagattttctggaagatagccaggaatcccaagtcttttcaggctcagatataacacaactggaaaaggaggttaatgtatgtaagcagtattatcaagaacttcttaaatctgcagaaagagaggagcaagaggaatcagtttataatctctacatctctgaagttcgaaacattagacttcggttagagaactgtgaagatcggctgattagacagattcgaactcccctggaaagagatgatttgcatgaaagtgtgttcagaatcacagaacaggagaaactaaagaaagagctggaacgacttaaagatgatttgggaacaatcacaaataagtgtgaggagtttttcagtcaagcagcagcctcttcatcagtccctaccctacgatcagagcttaatgtggtccttcagaacatgaaccaagtctattctatgtcttccacttacatagataagttgaaaactgttaacttggtgttaaaaaacactcaagctgcagaagccctcgtaaaactctatgaaactaaactgtgtgaagaagaagcagttatagctgacaagaataatattgagaatctaataagtactttaaagcaatggagatctgaagtagatgaaaagagacaggtattccatgccttagaggatgagttgcagaaagctaaagccatcagtgatgaaatgtttaaaacgtataaagaacgggaccttgattttgactggcacaaagaaaaagcagatcaattagttgaaaggtggcaaaatgttcatgtgcagattgacaacaggttacgggacttagagggcattggcaaatcactgaagtactacagagacacttaccatcctttagatgattggatccagcaggttgaaactactcagagaaagattcaggaaaatcagcctgaaaatagtaaaaccctagccacacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagattaaaaggtgtaaggagacttctgaacatggggcatattcagatctgcttcagcgtcagaaggcaacagtgcttgagaatagcaaacttacaggaaagataagtgagttggaaagaatggtagctgaactaaagaaacaaaagtcccgagtagaggaagaacttccgaaggtcagggaggctgcagaaaatgaattgagaaagcagcagagaaatgtagaagatatctctctgcagaagataagggctgaaagtgaagccaagcagtaccgcagggaacttgaaaccattgtgagagagaaggaagccgctgaaagagaactggagcgggtgaggcagctcaccatagaggccgaggctaaaagagctgccgtggaagagaacctcctgaattttcgcaatcagttggaggaaaacacctttaccagacgaacactggaagatcatcttaaaagaaaagatttaagtctcaatgatttggagcaacaaaaaaataaattaatggaagaattaagaagaaagagagacaatgaggaagaactcttgaagctgataaagcagatggaaaaagaccttgcatttcagaaacaggtagcagagaaacagttgaaagaaaagcagaaaattgaattggaagcaagaagaaaaataactgaaattcagtatacatgtagagaaaatgcattgccagtgtgtccgatcacacaggctacatcatgcagggcagtaacgggtctccagcaagaacatgacaagcagaaagcagaagaactcaaacagcaggtagatgaactaacagctgccaatagaaaggctgaacaagacatgagagagctgacatatgaacttaatgccctccagcttgaaaaaacgtcatctgaggaaaaggctcgtttgctaaaagataaactagatgaaacaaataatacactcagatgccttaagttggagctggaaaggaaggatcaggcggagaaagggtattctcaacaactcagagagcttggtaggcaattgaatcaaaccacaggtaaagctgaagaagccatgcaagaagctagtgatctcaagaaaataaagcgcaattatcagttagaattagaatctcttaatcatgaaaaagggaaactacaaagagaagtagacagaatcacaagggcacatgctgtagctgagaagaatattcagcatttaaattcacaaattcattcttttcgagatgagaaagaattagaaagactacaaatctgccagagaaaatcagatcatctaaaagaacaatttgagaaaagccatgagcagttgcttcaaaatatcaaagctgaaaaagaaaataatgataaaatccaaaggctcaatgaagaattggagaaaagtaatgagtgtgcagagatgctaaaacaaaaagtagaggagcttactaggcagaataatgaaaccaaattaatgatgcagagaattcaggcagaatcagagaatatagttttagagaaacaaactatccagcaaagatgtgaagcactgaaaattcaggcagatggttttaaagatcagctacgcagcacaaatgaacacttgcataaacagacaaaaacagagcaggattttcaaagaaaaattaaatgcctagaagaagacctggcgaaaagtcaaaatttggtaagtgaatttaagcaaaagtgtgaccaacagaacattatcatccagaataccaagaaagaagttagaaatctgaatgcggaactgaatgcttccaaagaagagaagcgacgcggggagcagaaagttcagctacaacaagctcaggtgcaagagttaaataacaggttgaaaaaagtacaagacgaattacacttaaagaccatagaggagcagatgacccacagaaagatggttctgtttcaggaagaatctggtaaattcaaacaatcagcagaggagtttcggaagaagatggaaaaattaatggagtccaaagtcatcactgaaaatgatatttcaggcattaggcttgactttgtgtctcttcaacaagaaaactctagagcccaagaaaatgctaagctttgtgaaacaaacattaaagaacttgaaagacagcttcaacagtatcgtgaacaaatgcagcaagggcagcacatggaagcaaatcattaccaaaaatgtcagaaacttgaggatgagctgatagcccagaagcgtgaggttgaaaacctgaagcaaaaaatggaccaacagatcaaagagcatgaacatcaattagttttgctccagtgtgaaattcaaaaaaagagcacagccaaagactgtaccttcaaaccagattttgagatgacagtgaaggagtgccagcactctggagagctgtcctctagaaacactggacaccttcacccaacacccagatcccctctgttgagatggactcaagaaccacagccattggaagagaagtggcagcatcgggttgttgaacagatacccaaagaagtccaattccagccaccaggggctccactcgagaaagagaaaagccagcagtgttactctgagtacttttctcagacaagcaccgagttacagataacttttgatgagacaaaccccattacaagactgtctgaaattgagaagataagagaccaagccctgaacaattctagaccacctgttaggtatcaagataacgcatgtgaaatggaactggtgaaggttttgacacccttagagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattccaagggcttaggcacactgtgactgccaggcagttggtggaagctaagcttctggacatgagaacaattgagcagctgcgactcggtcttaagactgttgaagaagttcagaaaactcttaacaagtttctgacgaaagccacctcaattgcagggctttacctagaatctacaaaagaaaagatttcatttgcctcagcggccgagagaatcataatagacaaaatggtggctttggcatttttagaagctcaggctgcaacaggttttataattgatcccatttcaggtcagacatattctgttgaagatgcagttcttaaaggagttgttgaccccgaattcagaattaggcttcttgaggcagagaaggcagctgtgggatattcttattcttctaagacattgtcagtgtttcaagctatggaaaatagaatgcttgacagacaaaaaggtaaacatatcttggaagcccagattgccagtgggggtgtcattgaccctgtgagaggcattcgtgttcctccagaaattgctctgcagcaggggttgttgaataatgccatcttacagtttttacatgagccatccagcaacacaagagttttccctaatcccaataacaagcaagctctgtattactcagaattactgcgaatgtgtgtatttgatgtagagtcccaatgctttctgtttccatttggggagaggaacatttccaatctcaatgtcaagaaaacacatagaatttctgtagtagatactaaaacaggatcagaattgaccgtgtatgaggctttccagagaaacctgattgagaaaagtatatatcttgaactttcagggcagcaatatcagtggaaggaagctatgttttttgaatcctatgggcattcttctcatatgctgactgatactaaaacaggattacacttcaatattaatgaggctatagagcagggaacaattgacaaagccttggtcaaaaagtatcaggaaggcctcatcacacttacagaacttgctgattctttgctgagccggttagtccccaagaaagatttgcacagtcctgttgcagggtattggctgactgctagtggggaaaggatctctgtactaaaagcctcccgtagaaatttggttgatcggattactgccctccgatgccttgaagcccaagtcagtacagggggcataattgatcctcttactggcaaaaagtaccgggtggccgaagctttgcatagaggcctggttgatgaggggtttgcccagcagctgcgacagtgtgaattagtaatcacagggattggccatcccatcactaacaaaatgatgtcagtggtggaagctgtgaatgcaaatattataaataaggaaatgggaatccgatgtttggaatttcagtacttgacaggagggttgatagagccacaggttcactctcggttatcaatagaagaggctctccaagtaggtattatagatgtcctcattgccacaaaactcaaagatcaaaagtcatatgtcagaaatataatatgccctcagacaaaaagaaagttgacatataaagaagccttagaaaaagctgattttgatttccacacaggacttaaactgttagaagtatctgagcccctgatgacaggaatttctagcctctactattcttcctaatgggacatgtttaaataactgtgcaaggggtgatgcaggctggttcatgccactttttcagagtatgatgatatcggctacatatgcagtctgtgaattatgtaacatactctatttcttgagggctgcaaattgctaagtgctcaaaatagagtaagttttaaattgaaaattacataagatttaatgcccttcaaatggtttcatttagccttgagaatggttttttgaaacttggccacactaaaatgtttttttttttttacgtagaatgtgggataaacttgatgaactccaagttcacagtgtcatttcttcagaactccccttcattgaatagtgatcatttattaaatgataaattgcactcgctgaaagagcacgtcatgaagcaccatggaatcaaagagaaagatataaattcgttcccacagccttcaagctgcagtgttttagattgcttcaaaaaatgaaaaagttttgcctttttcgatatagtgaccttctttgcatattaaaatgtttaccacaatgtcccatttctagttaagtcttcgcacttgaaagctaacattatgaatattatgtgttggaggaggggaaggattttcttcattctgtgtattttccgg

SEQ ID NO: 4680 - DNA, 1994 bp, Homo sapiens
tctaggcgctgcgtgggttccactcaccgcctggccgtttcggggccgcagtgcctccctggccggcagggggaggcacacgctcgccttgtcctggcgcttttcccagtggcccggctctgccgacgaggctcttttctccctagggggaaattttaaaatctcacccccccagtgctggggggaaagcggaggatcctcgcgtgccgggagcgggctgcgaatggggcagggcgagcgcacgtggggcgtgtttacaaacagcagccgcgccgccttgcggaggcggtccaggtgtcggagcccagagtcagcgcgcgtggaaagtgctagcccgagcgaggatcatgaggcacgcaaagtaaagcagcggttcggctgaaagaagacatgaaaaagatagtggcagtgccattaaatgaacagaaggattttacctatcagaagttatttggagtcagtctccaagaacttgaacggcaggggctcaccgagaatggcattccagcagtagtgtggaatatagtggaatatttgacgcagcatggacttacccaagaaggtctttttagggtgaatggtaacgtgaaggtggtggaacaacttcgactgaagttcgagagtggagtgcccgtggagctcgggaaggacggtgatgtctgctcagcagccagtctgttgaagctgtttctgagggagctgcctgacagtctgatcacctcagcgttgcagcctcgattcattcaactctttcaggaaaggggaaagatcctgatgtgacatcttgacagttgatcctttaataaacctaatggaagttaacaaaggaagattatttgggggccgtgacgaggagttcattttaaatggatgagtaaaatgaagatggcagaaatgatgttcaggagagtagcttaagagacttaataaaagagctgccagacacccactactgcctcctcaagtacctttgccagttcttgacaaaagtagccaagcatcatgtgcagaatcgcatgaatgttcacaatctcgccactgtatttgggccaaattgctttcatgtgccacctgggcttgaaggcatgaaggaacaggacctgtgcaacaagataatggctaaaattctagaaaattacaataccctgtttgaagtagagtatacagaaaatgatcatctgagatgtgaaaacctggctaggcttatcatagtaaaagaggtctattataagaactccctgcccatccttttaacaagaggcttagaaagagacatgccaaaaccacctccaaaaaccaagatcccaaaatccaggagtgagggatctattcaggcccacagagtaccgcaaccagagctatctgatggcattcctcagctcagcttgcggctaagttatagaaaagcctgcttggaagacatgaattcagcagagggtgctattagtgccaagttggtacccagttcacaggaagatgaaagacctctgtcacctttctatttgagtgctcatgtaccccaagtcagcaatgtgtttgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaagg

SEQ ID NO: 4681 - DNA, 2088 bp, Homo sapiens
gtgtagtgcgagtggggcggacgcgcgcagcccgcccgcccggcgaccagcaagacggagtctcactctgtcgcccaggctggagtgcagcggcgtgatcttggctcactgcaaagtctgcttccctggttcaagcgattgtcctgcctcagcctcccgagtagctgggattacaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgtaagcttgctggactcccctcctcacggcttttctgaatgtctcctcccagcagtcacattccctttctcactgaagcactgagctctgaggacagcactggctgccgctgtgcctgtgtgatgactggagccgtgtcccctgtcgctagcgtgcatgcttcccgtgtgtcttccctgggtctctcggggctgttccccatctctgcagtgcctcatctgctctgtcctgttgggaatgcacatctttctccctcagaagacaacatctgtggcctttatgttgactggccatgcttttcacaggccaggtcgggggtcgtgtggtgagctgaggaaagctaagaattatgggggaaagcaacggcaggcgtggtgggtgctacttaccagggagcggggagatctcggggaggaagcgattctctgattctttttcattctcccagcagccccatgaagtaactcttcattttatcaatgaggaatatgaggttcagagagattaagtaatatatgcaagattacacagtaagtagcagaaccaggattcaaacctaggtgtttggggctccattaacacaggcttttactcaacgctgctatactgccctgcagattcctttccccttcctgactctgtgttcttgcttgtccccttcttgtccagaggctctctggtatctgactgcaggcattcagcttcccctgagtcagtcctgcctcagtctgctaagccagtacctcccagatggtgcctggaaatatatagttagggacccagcacggtggctcatgcctgtaatttcagcactttgggaggccgaggtgggcagatcacctgaggtcaagagttcgagaccagcctggccaacatagtgaaaccctgtctttactaaaaatacaaaaaaaaaaattagccagtgggcgtgatggcaggcgcctgtaatcccagctacttgggaggctgaggcaagagaatcacttgaatctgggatgcagaggttgcagtgagccgagatcgcaccactgcactccaccatgggcaacagagtgagtctctgtctc

SEQ ID NO: 4682 - DNA, 465 bp, Homo sapiens
acattaacgcacacatcagttccaggccccattccattctctgaacatcttctgacacactgacagtgctgagcagagcaagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcgg

SEQ ID NO: 4683 - DNA, 497 bp, Homo sapiens
gcgtgtgggaggggcgggtgcggggaggggcgcgcgtgcgtggggaggtgtgtgtgctgagatcagtgtgaacatggttacgcctcttcattcccgtccatgccgagcccccgactgcagcattcaaagcccccacggaggtggaggcgkgtgtgagaggtcgcgsagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaa

SEQ ID NO: 4684 - DNA, 399 bp, Homo sapiens
  misc_feature (356)..(357): n is a, c, g, or t
agaagctctaggacccagcagcggttgtcgggtttggggctggaggtgaagccctgtgtgaatggggttgattgtccggcrccacttccccgcgctgcccggcagccgtcttccccagccgagggactgaactagccatgatcgcctcatgtggagggcaaagttgcgccggggaacttgtgagcctgcggtgaaagttgaagatcctctttgtaacttccactccccaaacttcctgaggatctcagaggtggaaatgagaggttccgaggatgcggcagctggaacagtattgcagcggctgatccaggaacaactgcggtatggcaccccaaccgagaacatgaacttgctgnnsattcagcaccaggcacagggagtgcaggccagccatcctac

SEQ ID NO: 4685 - DNA, 942 bp, Homo sapiens
atatccagggattccctgaggatttccttggagagagaagctctagggaggatggagaccccctcttctggaaggaggtgatttctgaatttgtggtcctgtcctcttgggctcagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactaggctgaagcttattaatgctaagggcagg

SEQ ID NO: 4686 - DNA, 244 bp, Homo sapiens
acgagaaggggagggggcccagccctgctttgggcaatccttgctctgaccactcagacaccgtgtcctcttgcctgggagaggggaagcagatctgaggacatctctgtgccaggccagaaaccgcccacctgcaggaatcccagccattcccgggatccgaggacccaaagggcagaagggagaacccggcttacccggccatcctgggaaaaatggccccatgggaccccctgggatgcca

SEQ ID NO: 4687 - DNA, 390 bp, Homo sapiens
agatttggacgctccggcctgggaggggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggactgacgtgcctcaacgaagcctccgtgctacacaacctgagggagcggtacttctcagggctaatatatacgt

SEQ ID NO: 4688 - DNA, 927 bp, Homo sapiens
gaggcaccaaacggcctgggtggatagaagggggacaaggaggcacacccaggccggcaaagagcaggtatcagcactgcaagcaccaagtgtgtcttgagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactaggctgaagcttattaatgctaagggcagg

SEQ ID NO: 4689 - DNA, 893 bp, Homo sapiens
gaggcaccaaacggcctgggtggatagaagggggacaaggaggcacacccaggccggcaaagagcagctcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactaggctgaagcttattaatgctaagggcagg

SEQ ID NO: 4690 - DNA, 575 bp, Homo sapiens
aagacagggacccgcagctcagctacagcacagatcagttatcctggggcatacagccataccattctgaaggtgtcttatctcctctgatctagagagcaccatgaagcttctcacgggcctggtttctgctccttggcctgrgtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggctgatcaggctgccaatgaatggggcaggagtggcaaagaccccaatcacttcygacctgctggcctgcctgagaaatactgagcttcctcttcactctgctctcaggagatctggctgtgaggccctcagggcagggatacaaagcggggagagggtacacaatgggtatctaataaatacttaaga

SEQ ID NO: 4691 - DNA, 558 bp, Homo sapiens
agagacgccggcgttactataagagcgcgcgtggcgcttccgcgctctttctcagtgaccgggtggtttgcttaggcgcagacggggaagcggascaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaagccgcccgggaactgctgacgcttgatgagaaggacccacggcgtctgttcgaagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcag

SEQ ID NO: 4692 - DNA, 531 bp, Homo sapiens
gttagtctccggcgagttgttgcctgggctggacgtggttttgtctgctgcgcccgctcttcgcgctctcgtttcattttctgcagcgcgccasaggatggcccacaagcagatctactactcggacaagtacttcgacgaacactacgagtaccgttgcttctatggtcctagattcctgctcwggctccctgatcatattaatgtgcattcaacaagaaggagaaaaagagttcagcatgttctttccctttgagaacacttttcataataagttacacattttcttatatcttgttggcttatgatttggaggctggtaaccatatgttcaacttatattttggggttctcttcctgaagaagattaaggcaactggcatgttatgttacccagagaactttccaaacaagtacctaaaactcatctgatgtctgaagaggagtggaggagacttggtgtccaacagagtctaggctgggttcattacatgattcatgagccaggtaagctatgctatgttatagtaa

SEQ ID NO: 4693 - DNA, 484 bp, Homo sapiens
  misc_feature (480)..(480): n is a, c, g, or t
aacagatatggtcgttctagagtggttcttcatcttgggttgctattaatgggcatctctgcaggccctctgatcaaggcagaaccttagagaagaagagtggaagatgacggagatgcattttgaagcacccctggtactcagcacacacatgcttacctaatgcatcactgtgacaaaagccacacgcattatcagtaactttgcttgccacggaaaaggtgtttttgaaagatgtggctataatgagaattgcatgattgctttaaaccaaatcaggtggtggattttttttttcttattctatttgcctgcagttgcctcactcacctggaaataccgtcacctgttacaggtgtactttcttaatgactgaaagataagtgggtagcaccgtcagagagaaaatgttggatctgccctaggttatagtagatgccggaattgcgtaaacccacttctctttaagctgcctggwtngcac

SEQ ID NO: 4694 - DNA, 623 bp, Homo sapiens
acaccagagatggaagtacatgtgatacaggtgtatccctttctgcctgtttttctccctctcataaagcagaggtttgccctgcatctgagaaagaattagaacagaactttcctccatttcattccccacctcactacacttgggccaggcagcgttcgccagtcatggcacttcctactaagtctgaatgctgtctcagaaacttgctcaacacagccgtatggaccatcacccccaactgactagaattagcctacaagaagaagttttctttcaccttagtgagataatttattatggccataagtaactgaaatgtagcatttggggatgaaaagcacagttaccagccaaagactccctgggggatggcggggggaatatgggcctgtgcgtcagaaagccccaggcacactttcatcaacttcgataaatgcagagggaacaccagaggacgtttttcttcaactctgcacagctattgactctattattttctgaaggcaaaaatgcatgtttgttagaatggaaacagaaaaacattaaaaagttaatyccttaacacaaaaaaaaaaaaaaaaaaaaaaaaaaaaaaaaagaaaaaaaaaaaaaaatgcgaa

SEQ ID NO: 4695 - DNA, 472 bp, Homo sapiens
ctgtgggattaaccctgctcggtcctttggctccgcggtgatcacacacaacttcagcaaccactggattttctgggtggggccattcatcgggggagccctggctgtactcatctacgacttcatcctggccccacgcagcagtgacctcacagaccgcgtgaaggtgtggaccagcggccaggtggaggagtatgacctggatgccgacgacatcaactccaggagcttcctggggaccaagatttaccaattcacccactcccttgaagttgtggaggaggtgaaagaaagggacccacctgctagtcgcccctcagagcatgatgggaggtgtgccagaaagtcccccctcgccccaaagttgctcaccgactcacctgcgcaagtgcctgggattctaccgtaattgctttgtgcctttgggcacggccctccttcttttcctaacatgcaccttgctcccaatggt

SEQ ID NO: 4696 - DNA, 3449 bp, Homo sapiens
acttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccacatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagatgaaaaaacgtgcacaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgacgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcag

SEQ ID NO: 4697 - DNA, 6886 bp, Homo sapiens
gcctgggaggtgcgtcagatccgagctcgccatccagtttcctctccactagtccccccagttggagatctgggaccaacaaggcaccatggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagatcgggaggaccagtccattctatgcacaggcgagtctggagccgggaaaaccgaaaacaccaagaaggtcattcagtacctggccgtggtggcctcctcccacaagggcaagaaagacacaagtatcacgcaaggcccatcttttgcctacggagagctggaaaagcagcttctacaagcaaacccgattctggaggctttcggcaacgccaaaacagtgaagaacgacaactcctcacgattcggcaaattcatccgcatcaacttcgacgtcacgggttacatcgtgggagccaacattgagacctatctgctagaaaaatcacgggcaattcgccaagccagagacgagaggacattccacatcttttactacatgattgctggagccaaggagaagatgagaagtgacttgcttttggagggcttcaacaactacaccttcctctccaatggctttgtgcccatcccagcagcccaggatgatgagatgttccaggaaaccgtggaggccatggcaatcatgggtttcagcgaggaggagcagctatccatattgaaggtggtatcatcggtcctgcagcttggaaatatcgtcttcaagaaggaaagaaacacagaccaggcgtccatgccagataacacagctgctcagaaagtttgccacctcatgggaattaatgtgacagatttcaccagatccatcctcactcctcgtatcaaggttgggcgagatgtggtacagaaagctcagacaaaagaacaggctgactttgctgtagaggctttggccaaggcaacatatgagcgccttttccgctggatactcacccgcgtgaacaaagccctggacaagacccatcggcaaggggcttccttcctggggatcctggatatagctggatttgagatctttgaggtgaactccttcgagcagctgtgcatcaactacaccaacgagaagctgcagcagctcttcaaccacaccatgttcatcctggagcaggaggagtaccagcgcgagggcatcgagtggaacttcatcgactttgggctggacctacagccctgcatcgagctcatcgagcgaccgaacaaccctccaggtgtgctggccctgctggacgaggaatgctggttccccaaagccacggacaagtctttcgtggagaagctgtgcacggagcagggcagccaccccaagttccagaagcccaagcagctcaaggacaagactgagttctccatcatccattatgctgggaaggtggactataatgcgagtgcctggctgaccaagaatatggacccgctgaatgacaacgtgacttccctgctcaatgcctcctccgacaagtttgtggccgacctgtggaaggacgtggaccgcatcgtgggcctggaccagatggccaagatgacggagagctcgctgcccagcgcctccaagaccaagaagggcatgttccgcacagtggggcagctgtacaaggagcagctgggcaagctgatgaccacgctacgcaacaccacgcccaacttcgtgcgctgcatcatccccaaccacgagaagaggtccggcaagctggatgcgttcctggtgctggagcagctgcggtgcaatggggtgctggaaggcattcgcatctgccggcagggcttccccaaccggatcgtcttccaggagttccgccaacgctacgagatcctggcggcgaatgccatccccaaaggcttcatggacgggaagcaggcctgcattctcatgatcaaagccctggaacttgaccccaacttatacaggatagggcagagcaaaatcttcttccgaactggcgtcctggcccacctagaggaggagcgagatttgaagatcaccgatgtcatcatggccttccaggcgatgtgtcgtggctacttggccagaaaggcttttgccaagaggcagcagcagctgaccgccatgaaggtgattcagaggaactgcgctgcctacctcaagctgcggaactggcagtggtggaggcttttcaccaaagtgaagccactgctgcaggtgacacggcaggaggaggagatgcaggccaaggaggatgaactgcagaagaccaaggagcggcagcagaaggcagagaatgagcttaaggagctggaacagaagcactcgcagctgaccgaggagaagaacctgctacaggaacagctgcaggcagagacagagctgtatgcagaggctgaggagatgcgggtgcggctggcggccaagaagcaggagctggaggagatactgcatgagatggaggcccgcctggaggaggaggaagacaggggccagcagctacaggctgaaaggaagaagatggcccagcagatgctggaccttgaagaacagctggaggaggaggaagctgccaggcagaagctgcaacttgagaaggtcacggctgaggccaagatcaagaaactggaggatgagatcctggtcatggatgatcagaacaataaactatcaaaagaacgaaaactccttgaggagaggattagtgacttaacgacaaatcttgcagaagaggaagaaaaggccaagaatcttaccaagctgaaaaacaagcatgaatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacgcagacctggccggggagctgcgggtcctgggccaggccaagcaggaggtggaacataagaagaagaagctggaggcgcaggtgcaggagctgcagtccaagtgcagcgatggggagcgggcccgggcggagctcaatgacaaagtccacaagctgcagaatgaagttgagagcgtcacagggatgcttaacgaggccgaggggaaggccattaagctggccaaggacgtggcgtccctcagttcccagctccaggacacccaggagctgcttcaagaagaaacccggcagaagctcaacgtgtctacgaagctgcgccagctggaggaggagcggaacagcctgcaagaccagctggacgaggagatggaggccaagcagaacctggagcgccacatctccactctcaacatccagctctccgactcgaagaagaagctgcaggactttgccagcaccgtggaagctctggaagaggggaagaagaggttccagaaggagatcgagaacctcacccagcagtacgaggagaaggcggccgcttatgataaactggaaaagaccaagaacaggcttcagcaggagctggacgacctggttgttgatttggacaaccagcggcaactcgtgtccaacctggaaaagaagcagaggaaatttgatcagttgttagccgaggagaaaaacatctcttccaaatacgcggatgagagggacagagctgaggcagaagccagggagaaggaaaccaaggccctgtccctggctcgggcccttgaagaggccttggaagccaaagaggaactcgagcggaccaacaaaatgctcaaagccgaaatggaagacctggtcagctccaaggatgacgtgggcaagaacgtccatgagctggagaagtccaagcgggccctggagacccagatggaggagatgaagacgcagctggaagagctggaggacgagctgcaagccacggaggacgccaaactgcggctggaagtcaacatgcaggcgctcaagggccagttcgaaagggatctccaagcccgggacgagcagaatgaggagaagaggaggcaactgcagagacagcttcacgagtatgagacggaactggaagacgagcgaaagcaacgtgccctggcagctgcagcaaagaagaagctggaaggggacctgaaagacctggagcttcaggccgactctgccatcaaggggagggaggaagccatcaagcagctacgcaaactgcaggctcagatgaaggactttcaaagagagctggaagatgcccgtgcctccagagatgagatctttgccacagccaaagagaatgagaagaaagccaagagcttggaagcagacctcatgcagctacaagaggacctcgccgccgctgagagggctcgcaaacaagcggacctcgagaaggaggaactggcagaggagctggccagtagcctgtcgggaaggaacgcactccaggacgagaagcgccgcctggaggcccggatcgcccagctggaggaggagctggaggaggagcagggcaacatggaggccatgagcgaccgggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaagtccaccatcgcggcgctggaggccaagattgcacagctggaggagcaggtcgagcaggaggccagagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaacgaggccatgggccgcgaggtgaacgcactcaagagcaagctcagagggccccccccacaggaaacttcgcagtgatgcaccaggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggtggtacacacctgtggtcccagctactagggaggctgagccaggaagaacgctccagcccaggacttcgaggctgcaatgagctataattgcatcattgcactccagcctgggcaacagagaccctgtctcaaccaccaccaccaccaccacccctactacccctgtattcaaggtaaaaattgaagtttgtatgatgtaagagatgagaaaaacccaacaggaaacacagacacatcctccagttctatcaatggattgtgcagacactgagtttttagaaaaacatatccacggtaaccggtccctggcaattctgtttacatgaaatggggagaaagtcaccgaaatgggtgccgccggcccccactcccaattcattccctaacctgcaaacctttccaacttctcacgtcaggcctttgagaattctttccccctctcctggtttccacacctcagacacgcacagttcaccaagtgccttctgtagtcacatgaattgaaaaggagacgctgctcccacggaggggagcaggaatgctgcactgtttacaccctgactgtgctt

SEQ ID NO: 4698 - DNA, 571 bp, Homo sapiens
agcctgaaagcatggaagacttctgttgtttagcaaagctgagagaagacattgtcttaactatctacactagttgttaaattaactaatcagttgatttactacattggatttcagaagggttgtccgcaaaacttagagagtaacctcaccaaccttattaagaggaacacagaactggagacccttttggctaaactcatccaaacctgtcaacatgttgaaatcagattagctttgctcttcactgtccttttgtcaaagcccctattgtacagctctccagtgtccttcctgcctgcccttctactgccattgtaacttttaccagccccactaccatttcagaagaaaactccaggaaagcaactactaacactgttgcaaagatctctggaaaccggaaactttggtcacctatactttaaatggagagagaagtaaaacttgctgctgagaagcaaggactgcatagaaggtttagtttgctggtagaatcaaaataagcactgaatgaagatgtgtgtggttcccagttttataaataggttttgcaagaaaaaaaaaaaaa

SEQ ID NO: 4699 - DNA, 330 bp, Homo sapiens
ttaatctccagttgcccaaggtggtcttgactgtaaaggatcagaaagtcattggcagagagaagcggcagtatcaccctaggaataggagaaagtgggtcagcaactccctacaggcaagactgatggggagaagatgcatttcaagacgcgaaagaaaactgactctagatgtagagaaggtcaatgcatcacgtcaagaagccaaattgacagaggagtgtgatcttctcattgagatcattcagcaaagacgacagattattggaaccaagatcaaagaagggaagagtctccatggcaactgcatcctcccaggttctaattcct

SEQ ID NO: 4700 - DNA, 505 bp, Homo sapiens
ttgcactcacaggtcctatctccctggcctgggaactttttctgcccctcccaggaccaactaattccaaagggaagttaatgcctaccttcccccaacagctttcaaccagctcctgatgggagatgttacataaatactctgcttcttccctattagctggaatgttctgtactgtttcccagagttgcccaatggggttaatctccagttgcccaaggtggtcttggtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgca

SEQ ID NO: 4701 - DNA, 538 bp, Homo sapiens
gacgcgaaagaaaactgactctagatgtagagaaggggccaaggaggagactgatggcacaaaagtggaaagaagagtttgaacttgttttctgcatccttagattggccctcctcagagcacttccatcagccacaatgatttctgaatcaaaagatgtgaatcagaaatgaaagcaaaaatcataaccaggagctgctagcttccaaaccaaacctgggaactagaaacaccagaacataactgcaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagtttgaaattttggagactctcctttgaagtgg

SEQ ID NO: 4702 - DNA, 218 bp, Homo sapiens
gacgcgaaagaaaactgactctagatgtagagaaggtcaatgcatcacgtcaagaagccaaattgacagaagaaactgctagaatgtctggattaccttacagctcccaaccctcccacaattagagaagagctctgcacagcttgtttgccccaccttcaccgtgtggaacaagtgtctgacgattatcactgggctccctatcccagaccatttgg

SEQ ID NO: 4703 - DNA, 1051 bp, Homo sapiens
atcagggttgcgtctgaaaggaacaaacagtttcccagacagatgtgtgaagaaatgcctagagctacgcgcttcttgctgggagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttgg

SEQ ID NO: 4704 - DNA, 1156 bp, Homo sapiens
atcagggttgcgtctgaaaggaacaaacagtttcccagacagatgtgtgaagaaatgcctagagctacgcgcttcttgctggggttagacgtgaccgggccagactgttaaatacacagcaacatgaaatatgaatattcttttgctttcgcagggaattttttttcctgatagtaaaaaggaagaggagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtctgtgtaattcggctgatagctggatgatagtacccaacatcaagcagaaccactacacggtgcacggtctgcagagcggcaccaagtacatcttcatggtcaaggccatcaaccaggcgggcagccgcagcagtgagcctgggaagttgaagacaaacagccaaccatttaaactggatcccaaatctgctcatcgaaaactgaaggtgtcccatgataacttgacagtagaacgtgatgagtcatcatccaagaagagtcacacacctgaacgcttcaccagccaggggagctatggagtagctggaaatgtgtttattgatagtggccggcattattgggaagtggtcataagtggaagcacatggtatgccattggtcttgcttacaaatcagccccgaagcatgaatggattgggaagaactctgcttcctgggcgctctgccgctgcaacaataactgggtggtgagacacaatagcaaggaaatccccattgagcctgccccccacctccggcgcgtgggcatcctgctggactatgataacggctctatcgccttttatgatgctttgaactccatccacctctacaccttcgacgtcgcatttgcgcagcctgtttgccccaccttcaccgtgtggaacaagtgtctgacgattatcactgggctccctatcccagaccatttgg

SEQ ID NO: 4705 - DNA, 546 bp, Homo sapiens
acgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagtttgaaattttggagactctcctttgaagtgg

SEQ ID NO: 4706 - DNA, 552 bp, Homo sapiens
acgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaaggtgaatatgtactgtgtgaccgatgaccagttaatctgtgccttgtgtaaactggttgggcggcaccgcgatcatcaggtggcagctttgagtgagcgctatgacaaattgaagcaaaacttagagagtaacctcaccaaccttattaagaggaacacagaactggagacccttttggctaaactcatccaaacctgtcaacatgttgaagtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagtttgaaattttggagactctcctttgaagtgg

SEQ ID NO: 4707 - DNA, 1587 bp, Homo sapiens
atggaaacactggagtcagaactgacctgccctatttgtctggagctctttgaggaccctcttctactgccctgcgcacacagcctctgcttcaactgcgcccaccgcatcctagtatcacactgtgccaccaacgagtctgtggagtccatcaccgccttccagtgccccacctgccggcatgtcatcaccctcagccagcgaggtctagacgggctcaagcgcaacgtcaccctacagaacatcatcgacaggttccagaaagcatcagtgagcgggcccaactctcccagcgagacccgtcgggagcgggcctttgacgccaacaccatgacctccgccgagaaggtcctctgccagttttgtgaccaggatcctgcccaggacgctgtgaagacctgtgtcacttgtgaagtatcctactgtgacgagtgcctgaaagccactcacccgaataagaagccctttacaggccatcgtctgattgagccaattccggactctcacatccgggggctgatgtgcttggagcatgaggatgagaagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcctacagactgctaagaatatcaccgagagagtctccatggcaactgcatcctcccaggttctaattcctgaaatcaacctcaatgacacatttgacacctttgccttagatttttcccgagagaagaaactgctagaatgtctggattaccttacagctcccaaccctcccacaattagagaagagctctgcacagcttcatatgacaccatcactgtgcattggacctccgatgatgagttcagcgtggtctcctacgagctccagtacaccatattcaccggacaagccaacgtcgttagtgagtatctcatggcctatttatttctgtctttggtggctttcttcagattgattgcattcctgaatttaaacttcaaaggaagacaaggaaggaaagaacacacaatatttattgacttgtctttcttgaacaaaaaagtgatagcactcacttgtactacattagtaaaaacagctggctaaatattgatgaaaattaatgacctctagcaaaccacatggatgttaagggaaagaagccagaaacaaatatatagagagaaacaaatatatagagagatacatagagagagaaacaaatatatatatatagtattaatccacatataggttcataacttaaagatcaaaataaactattttgcttaaagaaacattcataggtgttaaaactataaaccctgggcaacctgg

SEQ ID NO: 4708 - DNA, 4814 bp, Homo sapiens
aaaggcgggccggctggcgtccaagttcctgaccaggcgcgggccggcccgcgggaccagcagccgggtggcggcgcgatcggccccgagaggctcaggcgccccccgcatcgagcgcgcgggccgggcgggccagggcggcgggcggagcgggaggcggccacgtccccggcgggcctgggcgcggggaggcccggccccctgcgagcgcgccgcgaacgctgcggtctccgcccgcagaggccgccggggccgtggatggggagggcgcgccgcccggcggtcccagcgcacaggcggccacgatgagggtcaacgagaagtactcgacgctcccggccgaggaccgcagcgtccacatcatcaacatctgcgccatcgaggacatcggctacctgccgtccgagggcacgctgctgaactccttatctgtggaccctgatgccgagtgcaagtatggcctgtacttcagggacggccggcgcaaggtggactacatcctggtgtaccatcacaagaggccctcgggcaaccggaccctggtcaggagggtgcagcacagcgacaccccctctggggctcgcagcgtcaagcaggaccaccccctgccgggcaagggggcgtcgctggatgcaggctcgggggagcccccgatggactaccacgaggatgacaagcgcttccgcagggaggagtacgagggcaacctcctggaggcgggcctggagctggagcgggacgaggacactaaaatccacggagtcgggtttgtgaaaatccatgccccctggaacgtgctgtgcagagaggccgagtttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatgggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggaggctgtcaaggatcatcctagagctgaatacgaagccagagtcttggagaagtctctgaagaaagagtccagaaacaaagagaagcgccggcatattccagaggagtcaacaaacaaatggaagcagagggttaagacagccatggcgggggtgaaattgactgacaaagtgaagctgacatggagagatcggttcccagcctacctcactaacttggtctccatcatcttcatgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccctagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggtttttttttcaaatatcaattatgtggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaatccttttatggaaaccatttttttaaaaagtgaatgtacacaaatccacagaggactgtggctggacattcatctaaataaatttgaatatacgaaaaaaaaaaaaaaaaaaaaaaaa

SEQ ID NO: 4709 - DNA, 2907 bp, Homo sapiens
aggcaactggtaaccacctcatttggggatgtttctgccttgctagcagtgccagagagaacttcatcattgtcacctcatcaaagactactttttcagacatctcctgtagggctagattcagagagcagcttctgatatttggagggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttactatgcaaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaaaaaaaaaaa

SEQ ID NO: 4710 - DNA, 1913 bp, Homo sapiens
ctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgaaagcaagcaagtggagaccaagacagatgccaagaatggagaggaaaggggcagagatgccagcaaaaaagccctgggccccagacgggactcagatctggggaaggagccaaagaggggtggtttaaagaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggagtgacaggaacacaggcttgagcagggacaaggataaaaagagagaggagatgaaggaggtggccaagaaagaggatgatgagaaggtaaaagggggtgctccagctgccccaccaccccctccccctcccttggctccaccccttatcatggagaacctgaagaattcactctcaccagctacccagaggaagatgggagacaaagtcctccctgcccaggagaagaactcccgtgaccagctattggctgccatccgctccagcaacctcaagcagctcaagaaggtggaagtgcccaaactgcttcagtaggaccaggctgccaggcaccatctgccaatgccatgactgctcaggcctcacctcccagggctacacagaccctgcccaccccatccctggctgacctgctgtggatgtccctattctgccatgggagagtccaggcctgggtcacgctcaaggaaggatgccttatctcttctcactttccttttcttgtctctgaggctctccaaattttgctttagtacatggagctcaggtttctggacaagaagagtccttttagcacatcactgagaagatggcactgtccagggcccatgtagctggcaagctgcaaaaggcctgtgatccaggaaagatgtcccacagggaccacatccaccccagccccactgccctccagggccaggattcaggcctctgaggagcccacggggcaaagctgctgggccagtggcactctgtgtgggaaaatggcagaaagatggagaggcatgggggcccaaaggggagcgtggggaggggctgaggataccccaaagtccaggctaattagaggatgtggcaggggcagtggcctggatgcacagtgcctgatgggagtaggctccagacaggaggagtgggacagacagcagctggacttgaaggtttgatgccaaagcagacattttcctcacacccacctgctgctgtatgaatagctgtgtatctgtttttccataagattttgataatatatacaaacctttagctgtgaatggctgtgccccacctgttgtcctgaactgtgagtcctgatcctaaccctgggctccctggaggactctagaagctcaggttccctgccacactatttgagttggccaagaaataaattcacatcctcagaaaaaaaaaaaaaaaaaaaaaaa

SEQ ID NO: 4711 - DNA, 1828 bp, Homo sapiens
gagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccgtccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagcgccaggctggagataacagcctcttgcccgtcggccctgcgtcggccctggggtaccatgtggccacaactgctgtggccccctgtccccaagacacttccccttgtctccctggttgcctctcttgccccttgtcctgaagcccagcgacacagaagggggtggggcgggtctatggggagaaagggagcgaggtcagaggagggcatgggttggcagggtgggcgtttggggccctctatgctggcttttcaccccagaggacacaggcagcttccaaaatatatttatcttcttcacgggaaaaaaaaaaaaaaaaaaaaaaaaaaaaaaaaaaaaaaaaaaaaaaaaaaaaaaaaaaaaaaaaaaa

SEQ ID NO: 4712 - DNA, 1763 bp, Homo sapiens
gagccgagcggtagctggtctggcgaggttttatacacctgaaagaagagaatgtcaagacgaagtagccgtttacaagctaagcagcagccccagcccagccagacggaatccccccaagaagcccagataatccaggccaagaagaggaaaactacccaggatgtcaaaagaagtctggctaaacatgttaaaaaaggagagcagatatgttcatgacaaacattttgaagttctgcattctgacttggaaccacagatgaggtccatacttctagactggcttttagaggtatgtgaagtatacacacttcatagggaaacattttatcttgcacaagacttttttgatagatttatgttgacacaaaaggatataaataaaaatatgcttcaactcattggaattacctcattattcattgcttccaaacttgaggaaatctatgctcctaaactccaagagtttgcttacgtcactgatggtgcttgcagtgaagaggatatcttaaggatggaactcattatattaaaggctttaaaatgggaactttgtcctgtaacaatcatctcctggctaaatctctttctccaagttgatgctcttaaagatgctcctaaagttcttctacctcagtattctcaggaaacattcattcaaatagctcagcttttagatctgtgtattctagccattgattcattagagttccagtacagaatactgactgctgctgccttgtgccattttacctccattgaagtggttaagaaagcctcaggtttggagtgggacagtatttcagaatgtgtagattggatggtaccttttgtcaatgtagtaaaaagtactagtccagtgaagctgaagacttttaagaagattcctatggaagacagacataatatccagacacatacaaactatttggctatgctggaggaagtaaattacataaacaccttcagaaaagggggacagttgtcaccagtgtgcaatggaggcattatgacaccaccgaagagcactgaaaaaccaccaggaaaacactaaagaagataactaagcaaacaagttggaattcaccaagattgggtagaactggtatcactgaactactaaagttttacagaaagtagtgctgtgattgattgccctagccaattcacaagttacactgccattctgattttaaaacttacaattggcactaaagaatacatttaattatttcctatgttagctgttaaagaaacagcaggacttgtttacaaagatgtcttcattcccaaggttactggatagaagccaaccacagtctataccatagcaatgtttttcctttaatccagtgttactgtgtttatcttgataaactaggaattttgtcactggagttttggactggataagtgctaccttaaagggtatactaagtgatacagtactttgaatctagttgttagattctcaaaattcctacactcttgactagtgcaatttggttcttgaaaattaaatttaaacttgtttacaaaggtttagttttgtaataaggtgactaatttatctatagctgctatagcaagctattataaaacttgaatttctacaaatggtgaaatttaatgttttttaaactagtttatttgccttgccataacacattttttaactaataaggcttagatgaacatggtgttcaacctgtgctctaaacagtgggagtaccaaaaaaaaaaaaaaaaaaaaaaaaaaaaaa

SEQ ID NO: 4713 - DNA, 2009 bp, Homo sapiens
cccctcctggctgcactcttgcctccggagccctctgatcctgtttgcagtgatgctccgagggcaggcacctgctgctctgtaatgattcagcccctttcagccgtcgtcgcgttaacacaacaggatgctgttgctattgtcactactgcctctcctgccgccgctgctgctgccgccgccgccaccgccgctggtcctccttctgcttttacttctcctgcatgacagttgttttcttcatctgagcagacaccagcttcagatgctcgaggtgagaaacatgcctttcagtttgggctactggtttacttaattaatcagccggcagctccgtcgatctattttcgtccctgtcctcttgacgagcccgggatggtttggagtagcatttaaaagaactagaaaagtggcccagaaacagcagcttaaagaattattacgatatactttgattttgtagttgctaggagcttttcttccccccttgcatctttctgaactcttcttgattttaataatggccttggacttggacgatttatcgatttccccctgtaagatgctgtatcatttggttgggggggcctctgcgtggtaatggaccgtgagagcggccaggccttcttctggaggtgagccgatggagatttattccccagacatgtctgaggtcgccgccgagaggtcctccagcccctccactcagctgagtgcagacccatctcttgatgggcttccggcagcagaagacatgccagagccccagactgaagatgggagaacccctggactcgtgggcctggccgtgccctgctgtgcgtgcctagaagctgagcgcctgagaggttgcctcaactcagagaaaatctgcattgtccccatcctggcttgcctggtcagcctctgcctctgcatcgccggcctcaagtgggtatttgtggacaagatctttgaatatgactctcctactcaccttgaccctggggggttaggccaggaccctattatttctctggacgcaactgctgcctcagctctgtgggtgtcgtctgaggcatacacttcacctgtctctagggctcaatctgaaagtgaggttcaagttacagtgcaaggtgacaaggctgttgtctcctttgaaccatcagcggcaccgacaccgaagaatcgtatttttgccttttctttcttgccgtccactgcgccatccttcccttcacccacccggaaccctgaggtgagaacgcccaagtcagcaactcagccacaaacaacagaaactaatctccaaactgctcctaaactttctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaaggaaaaaaaaaaaaaaaaaaa

SEQ ID NO: 4714 - DNA, 2676 bp, Homo sapiens
cgctgtcctgggtgcgcctcgggccgctgcgctcctggccagctccccccagcgcctgggaggcgacccccagtgcgcccgggttcaaaggcccggcgaggcagttccagcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcagtaattcaaggacggcagaaaaaacagacaaagaagaggaagggaaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagcatcctggtctcgggaggcttctgtcattgctcacacacagttcagatttccacctctttatagacaagaagtgaatttgcctggggcagaacacccacccaaagagtccccacttaacaataccccccccccacggcaagaatgcccaaatccgaatgaccccagttttcctaatgagtaaaatgatcccagatgtgccccagagcatgacgcctgcagctccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgctctgaaaaaaaaaaaaaaaaaaaaaaaaaaaaaaaaaaaaaaaaa

SEQ ID NO: 4715 - DNA, 1992 bp, Homo sapiens
gtccaacttctcccggagcagccggagagcaggcgtcgggacgcagcaaagagaggagaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacgtctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttggtgttaaggtggagagggcatatgcatcctctgtcctgatctaggtgtctatagctgaggggtaagaggttgttgtagttgtcctggtgcctccatcagactctccctacttgtcccatatttgcaaggggaggggatttggggctggggctccattcaccaaagctgaggtggcttctcattaaccctttaggactctgaagggtatggacctacgtgaatgtgtgtcagggggagacttgctggtgggttagtggtcctcaggatgtgatagaaacatccagtgtaaaaaggaagttggaatgggagttggcgggcagtgaacgagtgtggggaaggattggtgctggggcaacaggaaggggcctggggccgtttggctgcactaactttggtagctcagtgtgcatctagagtgggactggggagggagctaagcttgggctgggctgcttggggcttggcatagggtggaaagggctaccctggggctctgaccacactgtagtatgtgtggagggtgccctcccgtctcccacaacttctgctataacaataaactgtagaggaatctgaaaaaaaaaaaaaaaaaaaa

SEQ ID NO: 4716 - DNA, 1288 bp, Homo sapiens
ggggattcgcagtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaaaaaaaaaaaaaaaaaaaaaaaaaaaa

SEQ ID NO: 4717 - DNA, 2225 bp, Homo sapiens
ggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaaggtacttgtatcatctccttccttctttaaataagagtaacaggcaaaatcataaggtgcgtgtaggatttttttttttttttaaatcatcatcactggtgatcctaaattctgatttggggatttaggaccccagctaatacaatgtctgtggctataataataagcttaaaattactaaaggccaaagcttgattacccatgcaagatttcatgtttcatcagttgacttcaaaatactgtaaggaattcttttcttacataagcctcttactttcattcacattcctgactatggcggccctaaaaacaaacatacacccagggggttagatgcctagattaattttagtaacttaagaaaagtgatttgaagaaagtagtttagacttcaaccctttgatgtccacagttagtacgcttggggaagtataatacatgctgaggtcaacagatatttcctgaacactatattacatggaggaatgggtagcagcaagagtacactgttttaaaatcagagcacagctaattttgtgccaggcactgtgctaggttctgggaaagtactgagaataactgaggagcagagtggaagagaagaagagaagaaacaattggatagaaacaaagtgtctagagcagtgtggatcagcaaatgttggttgattaaatgaataaatttattagtcaaggagattgtggacgagtataaccataactaacccactgctgaggaatgcggtgttctgtttgattggaatttatttttattgttattattttgtaattctgtattataactatatgcctaattgttgtacaccatctcacaatcaagccttgtgagattttccaaattttatcttgatcaaactggtttgcaaattatttttcagggttttcttaaaaaaaaaaaaaaaaacccaaactttataagatcctggctatcctgtggatttttaggcccttgtatttgttcttttttatagcaacatcagagctggatctagaaatggaagctcttaaaaccgtgtataagtcaggggaaacgattgtggtcacctgtgctgtttttaacaatgaggtggttgaccttcaatggacttaccctggagaagtggtaggtaccctcaaaacgtgcaatggcttggagcagagcaacagggctcagaagacctgcatttgagctcggtctgtcactgatgggcacatcactgagtttctctagaccttagcttcccacctctgggatgaacacatttgattaaatggcctttaggactccttgatcaatgggagagtttgaaatgatagttcctggaccaggcccttcagaatacataaagagtgtgccgtaagccttctttttcagaagtcagacagaaataggaaggttctctggctacaagatatcaaccaaaaaaaaaaaaaaaaaaaaaaaaaaaaa

SEQ ID NO: 4718 - DNA, 796 bp, Homo sapiens
gctttgtgtaactgggcagagctaacacctgagctgttaaagatcctgcattctcagcatgctcttcactaggatttgcaaaggtaactgccacacagagccatctttaccttcctaacaccccctcccgccccttgccatgtgctgggagatgtggacctggcctggggacagggtgtttctcagggccttgtctcaacttctcccacaacctctgtgttgtgtctgtcccctgccctgcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtaattggtcctgatggtttaatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaacaaacatgtgagatcagaaaaaaaaaaaaaaaaa

SEQ ID NO: 4719 - DNA, 1249 bp, Homo sapiens
aaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcaggctttgcatctgtggctcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggaaaaatgaagcaaatctcattggatatttttaaaggtctccacagagtttatgccatattggaattttgttgtataattctcaaataaatattttggtgaagccaaaaaaaaaaaaaaaaaaaaaaaaaaaaaa

SEQ ID NO: 4720 - DNA, 1835 bp, Homo sapiens
gttcattactacaggaaaaactgttctcttctgtggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcactgtcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtgtagttgtgtatgtttttttaactttactataaagccatttacttcaaaatgacattgctaaagactgcattattttactactgtaatttctccacgacatagcattatgtacatagatgagtgtaacatttatatctcacatagagacatgcttatatggttttatttaaaatgaaatgccagtccattacactgaataaatagaactcaactattgcttttcagggaaatcatggatagggttgaagaaggttactattaattgtttaaaaacagcttagggattaatgtcctccatttataatgaagattaaaatgaaggctttaatcagcattgtaaaggaaattgaatggctttctgatatgctgttttttagcctaggagttagaaatcctaacttctttatcctcttctcccagaggctttttttttcttgtgtattaaattaacatttttaaaaagcagatattttgtcaaggggctttgcattcaaactgcttttccagggctatactcagaagaaagataaaagtgtgatctaagaaaaagtgatggttttaggaaagtgaaaatatttttgtttttgtatttgaagaagaatgatgcattttgacaagaaatcatatatgtatggatatattttaataagtatttgagtacagactttgaggtttcatcaatataaataaaagagcagaaaaatatgtcttggttttcatttgcttaccaaaaaaacaacaacaaaaaaagttgtcctttgagaacttcacctgctcctatgtgggtacctgagtcaaaattgtcatttttgttctgtgaaaaataaatttccttcttgtaccatttctgtttagttttactaaaatctgtaaatactgtatttttctgtttattccaaatttgatgaaactgacaatccaatttgaaagtttgtgtcgacgtctgtctagcttaaatgaatgtgttctatttgctttatacatttatattaataaattgtacatttttctaattatttgcaaaaaaaaaaaaaaaaaaaaaaaaaaaaaa

SEQ ID NO: 4721 - DNA, 1573 bp, Homo sapiens
gggaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgttttactcgtgcacaccccggatgaaccgcaggatggttggtcctgatgttattcccctgccacacatctacggagctcgaatcaaaggtgtggaagtgttctgtcctctggatcccccgccgccatatgaagctgtggtgagccagatggaccaggagcagggatcttcattccaaatgtcagaaggatcagaagctgctgtgatcccattggatctgggctgcacacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctccatccttctgaggagagagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggcaaaaaaaaaaaaaaaaaaaaaaaaaaaaa

SEQ ID NO: 4722 - DNA, 2059 bp, Homo sapiens
ctgtgacagcaggtttgcaaaaccaatgaaaaaaacagttttccccaggcagggaggaattttttttataattaaatactgaaagttggaattcctatgatcatcaaagtcactctcaggaattagaagcaagtttacatgtcatctttattttttgctttagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaaggatgggcattttggacattgaagtgtggggaaaggacaacaaaaagcatgaggaacgtctgggcacgtgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatattgcttacagaactccctgaaagatgtgaaagacgtcggcattctacaagtgaaggttttaaaggcagcagatctcttagcggcagatttctcagggaagagtgacccattttgcttgttggagttaggcaatgaccgacttcagacgcataccgtctacaaaaacctcaaccctgaatggaacaaagtttttacatttcccattaaagatatccatgatgttttggaagtgacagtgtttgatgaagatggagataaacccccagattttcttggaaaagttgccattcccttgctgtccattagagatggacaaccgaattgttatgtactaaagaataaagatttagaacaagcttttaaaggagttatttacttagagatggaccttatatataatccggtgaaagcaagtattaggacttttactccccgggaaaagcgctttgttgaagacagccgcaagctgtccaaaaagatcttatcaagagatgtggaccgtgtgaaaagaatcactatggcaatatggaatacaatgcagttccttaaaagctgcttccagtgggaatccacattaagaagtacaatagcattcgcgcaccgcaaagaggaaccacccctgtctatgaaatgtacccttttctctggtgacattggcccatccttatgagcataataaaatcgcagaatcaaagcgctgcaagagatcttaaaaccacctaagtctaccactgagagcccaagaatcttggaaggacttcacagctggcctcatgccttcactttatatctcagggcattttctctcatttgtaaagggacttgtccttgatcaaattggtaatgtcagccatgggaggagaaatcaagtctcccgactgcaaatctttgtatatttggtatcatgccattcatttctgtcctgtgcaaagatcactataaaaactaatacgaggtatgagtggtctaagagtgtgaatatcagtcatgatcattggtgaatctgatttctgaatgttatgtggttctgcttctgttttctactgccaatatatgctgaatgttctctcttagccaacaggcatagcctcatataaaaaatgggggaaaaaaaacatttattagcccaagaagccaatgggttcaaggtcactcccaacatttttatgccatcaagtatatcagctccaaaagaggcttttcctttgccattggggggtattttgtttgctgtcgtttattttagttctccactgcttcggtgtagaggacctatgctgcctgtaggcttgacctttcctatactttttctgctgtctgaagttgctaaaacatttggccttaataaaaacactaataaaggttttattaatctgtaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4723 - DNA, 4328 bp, Homo sapiens
tatttcctcagtgattacgtacagagcgagtccctgcgggttaggggccccctctggagccatcctgatggctttgggggccttgcttccattttccattattatgtggactaccggagcgacagcgcagtccaagaccttgcagaccccaactgtaaacttgaagacaagactgaagatggagaggcactagattgtaagaagaggccggaagacggggaggagttggaagacgaagctgtgcacagctgtgacagctgcttccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaagctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaaccactgacatgactggtccctcgagtaaacaagcaaaagttaccaacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggaagaaatccagggccttaagccccctatctcctgtggccatagagcagacatctcttaagatgatgcaggcagtaggaggtgcacctgcacgtcccactggagaatatatctgtaatcaatgtggtgctaagtacacatccctagacagctttcagactcacctaaaaactcatctcgacactgtgcttcaaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaggagcgccagcccaggcattaacgtccctcccggcacgaatagaccaggcttgggccagaatgagaatctgagtgccattgaggggaaaggcaaggtggggggactgaaggcacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgccagatggttttctacaatgaatgggatattcaggttcatgttgcaaatcacatgattgatgaaggactgaaccatgaatgcaaactctgcagccagacctttgactctcctgccaaactcaagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaagtgttgcacatgtattatgtcgtctgatactaaaatggtcttataaagacaagtggacttgggccctattcaggcaaaaagaaaaaaaaaaa

SEQ ID NO: 4724 - DNA, 5041 bp, Homo sapiens
agaagggaaaaggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcctgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccggcggcgcggcgccgcctctctgcgcggcgccctgcagctgcgacggcgaccgtcgggtggactgctccgggaaggggctgacggccgtgcccgaggggctcagcgccttcacccaagcgctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccacctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttagacttgaattataataacttgggggaatttcctcaggctattaaagcccttcctagccttaaagagctaggatttcatagtaattctatttctgttatccctgatggagcatttgatggtaatccactcttaagaactatacatttgtatgataatcctctgtcttttgtggggaactcagcatttcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcctgaatgggctaaatcaactgaaacttgtgggcaacttcaagctgaaagaagccttagcagcaaaagactttgttaacctcaggtctttatcagtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttcccattttccatagaggggaatattctgcatcacccctttgtttgccatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgagtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcttaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagtttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaagatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaatccaaaaaaaaaaaaaaaa

SEQ ID NO: 4725 - DNA, 1339 bp, Homo sapiens
actacattgcccagtaacctcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagccctagggatcattgaagaggaaggctttctaaagctttggcaaggagtgacacccgccatttacagacacgtagtgtattctggaggtcgaatggtcacatatgaacatctccgagaggttgtgtttggcaaaagtgaagatgagcattatcccctttggaaatcagtcattggagggatgatggctggtgttattggccagtttttagtcaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtgatctggtcggatctcacaaggccatccaatgagaccccgcacagcattttctaaagaagaatcgaagcctgaccactttcaccttgggcaagaaggtttggcctttgagttgctattctatgctgaagagcctgcttagaggaggagtaccaggagggagccagcatttcagatctgaagtagacgataggaatgtggaagaacacatacatagtgcttaagaaatacatttaacctgttatgtcagtatttatcaatgaagtttgataattcacttttctgtcattgttaaagcgtacatactgtaaattaaagggaggtgaatggaaattaatgaataaacattttgagtttccctagtgttgaaaaaaaaaaaaaaaaa

SEQ ID NO: 4726 - DNA, 3760 bp, Homo sapiens
tttatattaacccctgatgacttcactgtaaaaacaaatatttctgaagtaaatgctgctactcttcttttgggaatagagaatcaacataaaataagtgttcctagagcacctacaaaagaggaaatgtctctcagagcttatactgctcggtgtaggttaaacagactacgtcgtgcagcatgccgtttgtttacttctgaaaaaatggttaaagctattaaaaagcttgaaattgaaattgaagctaggcggttaattgttcgaaaagatagacacctatggaaagatgtgggagaacgtcagaaagtcctgaattggctgttgtcctacaatcctttgtggcttcgaattggtctagagacaacttatggagaactcatatctttggaagataacagtgatgtcacagggttggctatgtttattctgaatcgcctactttggaatcctgatatagcagctgagtatagacaccccactgttcctcacctgtatagagatggtcatgaagaagctttgtccaagtttacattgaaaaagttattgttgttggtctgttttcttgattatgctaaaatttccagactcattgatcatgatccttgtctcttctgtaaagatgccgaattcaaggctagtaaagaaatccttttggctttttcacgagatttcctaagtggtgaaggtgacctttcccgtcaccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcaggttgctttggaaaatagcgtttgcttttcaggtggatatttcccttaacttagatcaattaaaggaagaaattgcctttctaaaacacacaaagagtataaagaaaacaatatctctactatcatgccattttgatgatcttattaataagaaaaaaggcaaaagggatagtggttcctttgaacaatatagtgaaaacataaagttattgatggattgggtaaatgctgtttgtgccttctataataaaaaggtggagaattttacagtgtctttctcagacggccgtgtgttatgttacctgatccaccattaccatccttgctatgtgccatttgacgctatatgtcagcgtactactcaaactgtggaatgtacgcaaactggttcagtggtattaaattcatcatctgaatctgatgacagttctctggatatgtctcttaaagcatttgatcatgaaaatacttcagagctatacaaagagctcctagaaaatgaaaagaaaaattttcacttggttaggtctgcagttagagaccttggtggaatacctgctatgattaatcattcagatatgtcaaatacaattccagatgaaaaggtggttattacctatttgtcatttctttgtgcaaggcttttggatcttcgtaaagaaataagagctgctcgactcatacaaacaacatggagaaaatataaactaaaaacagatctcaaacgccatcaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgtaaagtgatttttgctctccgtgtacaacttttaaaatctgactttgttttaaaaaaacataaactgttcattacattcttcatttttatcatttatagttttatgcatgtaataaactaatatgtcataaaaaaaaaaaaaaa

SEQ ID NO: 4727 - DNA, 3258 bp, Homo sapiens
cttctccctcctgccgccttatgaacagggtgactgtttccccatcggccatgattttaagtttcctgaggcctccccagtcatgctgaactatactgttcctaagagcatctgccccagtcaacttctcatccacagatattaatctcagtcaacctccagatttttagacatattttgaaagtctttcatcaccagatttcaaaggtgttgatagatatctatttttaaacatggaaagatggtggtgcaatggccagtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagcaattattcaaggccttatgccagaccagaattacacagttcaaattattgcatacaataaagataaagaaagcaagccagctcaaggccaattcagaattaaagatttagaaaaaagaaaggatccaaagcccagagtcaaagttgtggacagaggaaatgggagtagaccatcttcaccagaagaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggtcttgcacagtatagtggcgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggggtgaaaaacgcggatgtgaatgagctgcaggagatcgcctccgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacatcaccttaattattaagagattcactaactcctacaagatctttattgtcaaagaatcagtatgtattgaattaatgaaagaactgggctttgaggttaggaaacatcatgcttcgtggctatggctgtggctttaagtccaccaagaaacctgagaatctccaatgttggctctaacagtgctcgattaacctgggacccaacttcaagacagatccatggttatcgaattgtatataacaatgcagatgggactgaaatcaatgaggttgaagtcgatcctattactaccttccctctgaagggcttgacacctctcacagagtatactattgctattttctgcatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagctcggtacggagtatgaagtttcactattggccgtacttgatgatggaagcgagagtgaggtggtgactgctgtcgggaccacacttgacagtttttggacagaaccagctacaaccatagtgcctaccacatctgtgacttcagttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggtctgtataaattcaactgactagaaactctgcagatgttactaacacagctaataagactgtcttcggagatcaatgcaaactttactgctcttttctcagtgactctgccatctccagaaactaatgttctctgttaatctgactccactactggcttcttagtgacctttataaatccaaaacttgctccatgtacaacttgctctaagttaataacctctgaacattttttcaaatattgcttctcttctgctgccttgcacctgttcgagcaccaaagttgggtcataaaaggccatatgcacttgtgtctgtatatatgtatgtatagacatgtataaaagtttaatatagaaaataatttcttctgcccttggaaatctgataaaaaaacttttaagcaaaggacacagaaaaggtcttctatatggtatagtgaaaatattcttaataaaataccatccgtcaaaaaaaaaaaaaaaa

SEQ ID NO: 4728 - DNA, 4853 bp, Homo sapiens
ctgtaacaatttacgcgccgtgtaactgtgaatctttcaaagcctcagttttatgaccctgtggagccagtggactttgaaggacttctgatgacacacctgaacagcctggatgtgcagcttgcccaggagctcggggacttcactgatgacgacttggacgtggtgttcacgacaaaggaatgtaggactttgcagccctctttgccggaggaaggggttgaactggaccctcatgtcagggactgtgttcagacctacatccgtgagtggctaatcgtgaaccggaaaaaccaaggaagtccagaaatctgtggctttaaaaagactggatctcgaaaagattttcacaagacgcttccgaaacagacgtttgagtcggaaaccttggagtgcagtgaacctgctgctcaggcaggcccccgccacttaaacgtgctgtgcgacgtgtctgggaaaggccccgtcactgcctgtgactttgacctccgcagcctgcagcctgacaagcggctagaaaacctcctgcagcaagtgagtgccgaggactttgagaagcagaacgaggaggcccggaggaccaataggcaggccgagctctttgccctttacccatcagtggacgaggaggatgctgtggaaatacgtccagtaccagaatgtcccaaggaacacctgggcaacagaatattggtcaagttgctgaccttgaagttcgagattgaaattgagcccctgtttgccagcattgccctctacgatgttaaagaaaggaaaaagatctcagaaaattttcactgtgacctgaactctgaccagttcaaaggatttctgcgagctcacacgccttcagtggccgcatcaagtcaggcgagatctgcagtcttctcagtcacctacccgtcctcagacatctacctggtagtcaagattgaaaaagtcctgcagcagggagagattggagactgtgcagagccctacacggttatcaaagaaagtgatggtggaaagagtaaagaaaagattgaaaaactaaaactccaagctgaatccttctgccagcgtttggggaaataccggatgccctttgcctgggcacccataagcttatcaagcttcttcagtgtctccacccttgagagggaggtaactgatgtggactctgtggttgggagaagctcagtgggtgaacggaggacattggcccaatctagaaggctttctgaaagagccctctccttggaggaaaatggggttggatccaacttcaaaacctccactctgagcgttagcagctttttcaagcaggaaggagatcgccttagcgatgaagacttattcaagtttttagctgactacaaaagatcatcatccttacagagacgagtcaagtcaattccaggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacagagaagtcttccaggtttcagctgttgctcattaatgctcaccacagccctttgaggtcgatgcaattatgctttggaaaagctaagtaacttgccaaaggccatgcagctaaaagaagcaaaagctggattcaaatctcagctctctgcctccagagagaacaccctcaatcccgcttaacagacattagctctgcttatttgattggtggcagtggagatgaacagaagtgaacagtgagcagagaggggtctgtaccccacacacatccctgcaccccaactgtcaactgtcttccatcatcatttactatatccacgtccactcctgacagcatcagtggctcagtcttaccgacctgcatcagggttttgggctctgcctctgtttagacagagcacgatttgggaagtgctgctaagtcagccagtggctgagtagaaacagccctgcagtgggcctctgcctgctctgtggctcgtttatcatgtgtctcatctttaaaagttggggctcagtctaggtgcctcctggcctgagcaccccagaattctatgctgatcccttcattgtgacatggcctgtcatctactcttctgggaagaccatctgcacctcactgatacttgaagctcattgagtattgtcacatatcagcccagaaagtcacagggtacagcaactcatacttgctcccagcaccaggccagccccattctgcctccagggagtcacccaaaatagagagatgagggtaaaataagacctaggaatactatttatttgcctccatggcctttgaacttgcacatccaacgtaacggctcctgtgtgttcttgattgttccaattatcatttttcctctcgaatacctgagagcattcattattttgcaagagatttgagaatccctgtgccctaacttttctttccttgatgtgggatgttcttctgtgactagaaaccttctctatgtctacccacagaggctgaactttgtaaacaaactagcatcagcccggaacattacaataaagatccagtttatgtgtggagaagatgctagcaatgcgatgccggtgtcttaagacagcggtggggtcctcttagtcctctctgctcaggcccctggcatgccactgccaggagtgccagatatgcttgtgcagatcctgtggcaaccaagatgcccagccaagagtgactgtgggctaaagtccagtctgttcttcattcactgagccatgggttctggtgttgggattactgcatctagaggaaagagctttttttctctgcacaaaggtcatctttggaaaatccagcgggcctgaatttctgcaggaagtgtacacagctgttacataccataataagtctcctgacttttatgaagaagtgaaaattaagctccccgctaagctcacagtaaatcaccacctcctgttcaccttctaccatatcagctgtcagcagaagcaaggagcctccgtggaaactctcctgggatattcatggctgccaattctcttaaatgaacgtcttcaaactggatcctactgtctcccagttgccttggaaaaattgccacccaactactccatgcattctgctgagaaagtcccattacagaatcctcccattaagtgggctgaaggacataagggagtatttaatattgaagtgcaagctgtttcttctgtacacacccaggacaaccacctggagaagttcttcaccctctgccactccctggagagccaggtgaccttccccatccgcgtgctggatcagaaaatcagcgagatggcgctggagcatgagctgaagctcagcatcatctgcctgaactcctcccgcctggagccgctcgtgctcttcctgcacctggtgctggacaagctcttccagctgtccgtgcagcccatggtcatcgctggccagacagccaacttctcccagtttgccttcgagtccgtggtggccatcgccaacagtctgcacaacagcaaggacctgagcaaggaccagcatgggaggaactgcctgctggcttcctacgtgcactacgtcttccgcctgccagaggtgcaaagggatgtgcccaagtcaggggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcttggagcagtggctcacatctgcaaccccagcactctaggaggctgagatggcaggatcgcctggagccagaagttggagaccagcccagggaacataatgagactctgtctctacaaaaaatataaaaattagcagagcatggtggcacatacctttagtcccagctactcaggaagaagctgaggcaggaggatcatttaagcccaggagttggaggctgcagtgagctatgattgcaccactgcactccagcctgggaaacagagcgagatcccatctcttaaaacaaacaaacaaacaaacaaacaccctaaaattccattttcgttttcaggacaatacaaaacttacatgaatgctgaaattatgtgtttctttatagatctttcttcctccctccttgcctctttttatgctctaaacacttattttgtctgcccatttgataatccctcactggtctttacccacttgctaatttatgattcagctgagaatctcttttttaagatggagaagtggtgactgatgcctacgattctagtataataaaggaaataatatataaaaaaaaaaaaaaaaaaaaaaaaaaaaaaaaaaaaaaaaaaaaaaaaaaaaaaaaaaaaaaaaaa

SEQ ID NO: 4729 - DNA, 3345 bp, Homo sapiens
ggagggctcgccagagcgctcgcatggcgggccggtgattgtagtcaatctggccgtattctcaggcagggtcgcccggggcggactacatctcccgggatgctgcgcggccgccccgcggaagattgtgaatatgtatcagaatgttaatgattagctgctgctaaatttggtcaaagaagtcacctacacagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttataatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaaaaaaaaaaaaaaa

SEQ ID NO: 4730 - DNA, 2066 bp, Homo sapiens
aagtggcttcagagatgcagccctcagtgcttaacgtcctagttattgtccttgaaacccgagccatctcaccgctcgcccccaaccctgggctctggctgtttaaaagctggagaggaagtgaaagcgtcaagtacatcccgttaggtgcaaagcaagtctcgttgatcgccattgctagttttgcacacgtttgcgaatcagagctgcccggggtacaccgaccgcgcagggaaacatcgagagtgtaaataaatacatcgcctcttgttcggatttttgctactaccgaaaatatgtaaattgtgaactctgttggctctctttggatccaggttgatagaagtccagatcctgaggaaatctccagctaaatgctcaaaatataaaaactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggtttttcaaatgttgccatttctgtaattattttaagaggtatatgtctctctactgacaataggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggccaaaaaaaaaaaaaaaa

SEQ ID NO: 4731 - DNA, 3586 bp, Homo sapiens
ggggaagggacatttagtttgagacggtgctgagataggatcatgaaggaagaggtgaagggaattcctgtaagagtggcgctgcgttgtcgccctctggtccccaaagagattagcgagggctgccagatgtgcctttccttcgtgcccggagagcctcaggtggtggttggtacagataaatccttcacctacgattttgtatttgatccctctactgaacaggaagaagtcttcaatacagcagtagcgccactcataaaaggtgtatttaaaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgagaggatcctaaggaaggcataaagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagaatagcagctttcgctccaagctgcatcttgtagacctcgctggatcagaaagacagaagaaaaccaaggctgaaggggatcgtctaaaagagggtattaatattaaccgaggcctcctatgcttgggaaatgtaatcagtgctcttggagatgacaaaaagggtggctttgtgccctacagagattccaagttgactcgactgcttcaagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtacaacagctacaagtcttgttgctacaggcccatggaggtaccctgcctggatctataactgtggaaccatcagagaatctacaatccctgatggagaagaatcagtccctggtagaggagaatgaaaaattaagtcgtggtctgagcgaggcagctggtcagacagcccagatgttggagaggatcattttgacagagcaagcgaatgaaaaaatgaacgccaagctagaagagctcaggcagcatgcggcctgcaaactggatcttcaaaagctagtggagactttggaagaccaggaattgaaagaaaatgtagagataatttgtaacctgcagcaattgattacccagttatcggatgaaactgttgcttgcatggctgcagccattgatactgcggtggagcaagaagcccaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggataacataaaagagctagaattagaagtcatcaatctgcaaaaggaaaaggaagaattggttcttgaacttcagacagcaaagaaggatgccaaccaagccaagttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacggatgatgaaaaaccagcgggtacagttaatgcgtcaaatgaaagaagatgctgagaagtttagacagtggaagcagaaaaaagacaaagaagtaatacagttaaaagaacgagaccgtaagaggcaatatgagctgctgaaacttgaaagaaacttccagaaacaatccaatgtgctcagacgtaaaacggaggaggcagcagctgccaacaagcgtctcaaggatgctctccagaaacaacgggaggttgcagataagcggaaagagactcagagccgtggaatggaaggcactgcagctcgagtgaagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccggaggcgtacattctcccttactgaagtgcgtggtcaagtttcggagtcagaagattctattacaaagcagattgaaagcctagagactgaaatggaattcaggagtgctcagattgctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgaccctcctccaggtagccagcagacagaaacatcttcctaaggatacccttctatctccagactcttcttttgaatatgtcccacctaagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaaggggtgctgttgctcacgcctgtaatctcagcactttgggaggctgaggcaagaggattgcttgaggccaggagttcaagaccagcctgggcaacatggcgagaccctgtctctacaaaaccaaaaaattagccaggcatggtggcatgtgcttgtggtctcagatacgctggaggctgaggcaggaggatcactaagtcaaagaggttgaggctgcagtgagctatgattgtgccactgcactccagcctgggtgacagagcaagaccctgtctccaaaaaaaaaaaaaaa

SEQ ID NO: 4732 - DNA, 3390 bp, Homo sapiens
gccaggcgggagctcacctgggctcttagcgtcgccgccggcttcgcagagcaccgcgccttagccgcgaagttctagttcttgctgccggtcctaacgtcccgcagtcttcgccagccagccgtcccgcatgcgcgtttgggcggcgtggagcctgctgccatgaagtcagcgagagctaagacaccccggaaacctaccgtgaaaaaagggtcccaaacgaaccttaaagacccagttggggtatactgtagggtgcgcccactgggctttcctgatcaagagtgttgcatagaagtgatcaataatacaactgttcagcttcatactcctgagggctacagactcaaccgaaatggagactataaggagactcagtattcatttaaacaagtatttggcactcacaccacccagaaggaactctttgatgttgtggctaatcccttggtcaatgacctcattcatggcaaaaatggtcttctttttacatatggtgtgacgggaagtggaaaaactcacacaatgactggttctccaggggaaggagggctgcttcctcgttgtttggacatgatctttaacagtatagggtcatttcaagctaaacgatatgttttcaaatctaatgataggaatagtatggatatacagtgtgaggttgatgccttattagaacgtcagaaaagagaagctatgcccaatccaaagacttcttctagcaaacgacaagtagatccagagtttgcagatatgataactgtacaagaattctgcaaagcagaagaggttgatgaagatagtgtctatggtgtatttgtctcttatattgaaatatataataattacatatatgatctattggaagaggtgccgtttgatcccataaaacccaaacctccacaatctaaattgcttcgtgaagataagaaccataacatgtatgttgcaggatgtacagaagttgaagtgaaatctactgaggaggcttttgaagttttctggagaggccagaaaaagagacgtattgctaatacccatttgaatcgtgagtccagccgttcccatagcgtgttcaacattaaattagttcaggctcccttggatgcagatggagacaatgtcttacaggaaaaagaacaaatcactataagtcagttgtccttggtagatcttgctggaagtgaaagaactaaccggaccagagcagaagggaacagattacgtgaagctggtaatattaatcagtcactaatgacgctaagaacatgtatggatgtcctaagagagaaccaaatgtatggaactaacaagatggttccatatcgagattcaaagttaacccatctgttcaagaactactttgatggggaaggaaaagtgcggatgatcgtgtgtgtgaaccccaaggctgaagattatgaagaaaacttgcaagtcatgagatttgcggaagtgactcaagaagttgaagtagcaagacctgtagacaaggcaatatgtggtttaacgcctgggaggagatacagaaaccagcctcgaggtccagttggaaatgaaccattggttactgacgtggttttgcagagttttccacctttgccgtcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagattgagattttagagaaaacaactactatctatgaggaagataaacgcaatttgcaacaggaacttgaaactcagaaccagaaacttcagcgacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattgttactgaacctaaaactgagaagccagagagaccctctcgggagcgagatcgagaaaaagttactcaaagatctgtttctccatcacctgtgcctttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttccacagtagcacctgcccaaccagatggtgcagagtctgaatggaccgatgtagaaacaaggtgttctgtggctgtggagatgagagcaggatcccagctgggacctggatatcagcatcacgcacaacccaagcgcaaaaagccatgaactgacagtcccagtactgaaagaacattttcatttgtgtggatgatttctcgaaagccatgccagaagcagtcttccaggtcatcttgtagaactccagctttgttgaaaatcacggacctcagctacatcatacactgacccagagcaaagctttccctatggttccaaagacaactagtattcaacaaaccttgtatagtgtatgttttgccatatttaatattaatagcagaggaagactccttttttcatcactgtatgaattttttataatgtttttttaaaatatatttcatgtatacttataaactaattcacacaagtgtttgtcttagatgattaaggaagactatatctagatcatgtctgattttttattgtgacttctccagccctggtctgaatttcttaaggttttataaacaaatgctgctatttattagctgcaagaatgcactttagaactatttgacaattcagactttcaaaataaagatgtaaatgactggccaataataaccattttaggaaggtgttttgaattctgtatgtatatattcactttctgacatttagatatgccaaaagaattaaaatcaaaagcactaagaaataaaaaaaaaaaaaaaaaaaaaaaaaaaaaaaaaaaaaaaa

SEQ ID NO: 4733 - DNA, 2806 bp, Homo sapiens
gccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggcccaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctactcaagaaagatgccccgattagtccagcctctattgcatcttccagcagtactccctcctccaaatccaaagaacttagccttaagagggatatggggaaattgagtgaaacacgtcttagcgaagatgaacaatgcacattggggttacagagatggttttgtcgcctgtggtttatgaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaaaaaaaaaaaaaaa

SEQ ID NO: 4734 - DNA, 4675 bp, Homo sapiens
ggcttggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccagacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaaaattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaagaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaaaaaaaaaaaaaaaa

SEQ ID NO: 4735 - DNA, 3127 bp, Homo sapiens
cttaaagaggacatgctgaaagacagcaacacacagatagagcaactacgaaaaatgatgcttagtcatgagggagtgcttcaagaaatccggtcaatcctagttgactttgaagaagcctcaggcaaaaaaatatgtgaacatgacagcatgtctactctgcacttccgcagcttgggctcagctattagtaaaatactaagagaattagacacagagatttcttatcttaaagggaggatatttccagtagaggatcaacttgaagcactgaaatctgaatcacagaacaaaatagaactacttctgcaacaacaccaagataggattgagcagttaataagtgaacatgaagttgaaataacaggacttactgagaaagctagcagtgctcgaagccaagccaatagtatccagagtcaaatggaaatcattcaagagcaagcaagaaaccaaaactctatgtatatgcgtcagctcagcgatctggaatctactgtttctcagctacgttctgaattaagggaagccaaaaggatgtatgaagacaagacagaagagctggaaaagcagttagtccttgccaactcagagctaactgaagcccggacagagcgtgatcaattcagtcaggaatctggaaatttagatgatcaacttcaaaagctgttggctgatctacacaaaagggagaaggagctgagtctggagaaggagcagaataagcgtctgtgggaccgagacacaggcaacagcatcaccattgaccacctgcggcgggaactggacaaccggaacatggaggtgcagcgcctggaagccctgctcaaggccttgaagagcgagtgtcagggccagatggagcggcagatggcagcaattcaaggaaagaatgaaagtctagaaaaagtatcctccttgactgctcagcttgaatccaccaaagagatgctgcgcaaagtagtagaagagttgacagccaagaaaatgactctggagagctcagagaggacaatatcggacctgacaacttctctccaggaaaaagagagagccatcgaggctaccaatgcagagatcacaaagctccgctcccgggtggacttgaaattgcaggagctgcaacacttgaaaaatgaaggggatcatctcagaaatgtgcagacagaatgtgaggccctcaaactgcagatgacagagaaggacaaggtgatcgagattctgcgacagcagattgagaacatgacacagctggtgggccagcatggacgaactgctggagctatgcaagtagaaaaagctcaactggagaaagaaattaatgataggcggatggaactaaaggaacttaagatattaaaagataaaaaagatgcaaagatccgggagcttgaggccagagtgagtgacttggagctggaaaaggtgaagctggtgaatgcaggctctgagcggctccgtgcagtgaaggacatcaaacaagagagagatcaattattaaatgaggtgaaaacaagtaggagtgaattaaacaatctttcagaggagtatgaagtcttaaaaaggaatttccgaaacaaaagtgaagaaatggaaatgactacaaataagttgaaaatgcaattaaaatctgcacagtctgaactagaacagacaagaaatacattaaagtcaatggaaggatctgatggtcatgctatgaaagtggcaatggggatgcaaaagcaaatcacagccaaaagaggtcagatagatgcccttcagagcaagatacagtttttggaagaggcaatgacaaatgcaaataaggagaaacattttctgaaagaagagaaaagtaaactcagtcaggaattgagtactgttgccacagaaaaaaacaagatggctggggagttggaagttctgcgatctcaggaacgccgtttgaaagaaaaggttactaatatggaagtggctctggataaggcatctttgcagtttgcagaatgtcaagatataatacagcgtcaggagcaagaatcagtgcgcttaaaacttcaacacactttggatataaaagaacttcagggccctggatacacctcaaattcttcattgaaaccacgccttctccagccagcatctgttactcgttctcattctaatgtaccatcttcgcagtctacagccagcttcctgtctcatcactctacaaaagctaacacactgaaggaagatccaacaagggacctgaaacagcttctccaagagttgagaagcgtgatcaatgaggagccagctgtgtctctgagcaagacagaggaagatggaagaacatctctgggagccttagaggatagggtaagagattgcattactgaatccagcctgagatcagacatgtgccatagaagcaacaactcgttgagggactccactgaaggaagcaaatcaagtgaaactcttagtagagagccagtcacattacacgcaggagacagggaagatccctctggttgcttcacattcacatctgcagcaagtccatctgtgaaaaactcagcttctcgttcattcaattcttctcctaagaagtctccagtgcactcactcctaactagttcagttgaaggttcaataggttccacatcacagtatagatctgccaaacctattcattcatctgattctgttaaagattcacagtctccgccaatagaaacaacaggaaaaacatgcaggaagcttcagaacagactagaaagcttgcaaactctggtagaagatttacagctgaagaaccaagcaatgtcttcaatgatcagaaatcaagaaaagaggatacagaaagtaaaagaccaggaaaaaatgttactaaaatgactcgttgcttgcctattctttacagaggaatgaggcccaattaattgtggtgttactcgtaattagtgccctgtgtactttttctttttatgtgaaaatttaataaaagataccctgtcttgtaaactctaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 4736 - DNA, 1500 bp, Homo sapiens
gtttgtattttaggcgccattttcgagtgaaggacccggagccgaaacaccggtaggagcggggaggtgggtactacacaaccgtctccagcctaggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttcaaaaagataaagaaaaggttgaagaatttaaaagtatacctgccaagagtaacaatatcattaatgaaacaacaaccagaaacaatgccctcgagaaggaaaaagagaaaaaaaaaaaaaaa

SEQ ID NO: 4737 - DNA, 1824 bp, Homo sapiens
gtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtgcgctcccccgtctctctcctcttcctgcattgcccactttacttggccttctcctggctctgactcaggcagccaagacccctcccacttccttctttggcctccctctcctcaggtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaataaaaaaaaaaaaaaaaaaaaaa

SEQ ID NO: 4738 - DNA, 4417 bp, Homo sapiens
caaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactctcccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacaggtaagtagggaaattccactgtttggggcaacactgagaagggccacctgaacagccaaagtctccattatcctagccccgtagcctcctgtcttattacccaaattacctgctttatcatgtctgaatcttatcggagaactacttttccagtaagattccgtgttgtctccgtggatgaaaattttcgccctcgaaatgaactgattccactgatataccttgagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggagaatacacttatgggaagcctgtcccaggacttgcaactgtgagcctgtgtagaaaattatctcgtgttcttaattgtgacaagcaggaggtctgtgaggaattcagtcaacagcttaacagcaatggctgcatcacccaacaagtacacaccaaaatgctccagattacaaatacgggctttgaaatgaagcttagagtggaagccaggatcagagaagaggggacagacctggaagtcactgcaaacaggatcagtgaaatcacaaacattgtatccaaactcaaattcgtgaaagtggattcacactttagacaaggaatccccttttttgcacaggtgcttctggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggttttcactgtgcatcccaacttgtgttttcactattcatgggtagcagaagaccaccagggcgctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctgatcatggctaagggagtcatcgtcagatctggaacccacactctgcctgtggagtcaggagacatgaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggctgaaggtattgagcaagaaaagactttcagttccatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagaagacaacctcgtccattgggagcgccctcagagacccaaggcaccagtggggcatctttaccaaccccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccagacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgacaaatcagacgctaagtttttccttcatggttctgcaagacatcccagtaggagacttgaagccagcaattgttaaagtctatgattactatgagacagatgagtctgtggttgctgagtatatcgccccctgcagcacagatacagagcatggaaatgtttgaggaccatacaggctgtatattttggtggattctctgtcct

SEQ ID NO: 4739 - DNA, 575 bp, Homo sapiens
  misc_feature (116)..(116): n is a, c, g, or t
  misc_feature (138)..(138): n is a, c, g, or t
  misc_feature (198)..(198): n is a, c, g, or t
  misc_feature (298)..(298): n is a, c, g, or t
  misc_feature (319)..(319): n is a, c, g, or t
  misc_feature (372)..(372): n is a, c, g, or t
cgacactcttgggtagggtctggataaaaaaaaagtgagcactgcaaatttctagaagaaaacatcaggagaagaaagagagagggggatttattcaagagctgtttccaattccnttcaaaacctcacaaccaggtnggctatgtgtagtggatgtaaccaatgaaaaacaaacgacgatggaacgtgaagtcactngagcagaattgtcacgtgaaacagtaaccacaatgacttacattccttaccaccagaaaggcgggaccagcaagtggctatgctaaagacagcctctcanttggtggagggagccggctgngagaaacaaagcctgactcatggcagcagcgcgttacattaaactcaactggnaagcacacagaggcctatgcctccacgctctaagttacacggagggctcactcacgctgcctccactctgcccaactccccaggctcaacctttgaaaggaaaactcacgttacccgccatgcgtatgaagggagctccagtggcaactcttctccggagtaccctcggaaggaatttgcatcttcttcaaccaagagtgtcg

SEQ ID NO: 4740 - DNA, 605 bp, Homo sapiens
cgttaggaggaggagataatgccctagaggccaggtgggtggagatgtcaatgtggagatggacgctgcacctggcgtggacctgagccgcattctgaacgagatgcgtgaccagtatgagaagatggcagagaagaaccgcaaggtatgcccgaggaagtggttcttcaccaagacagaggagctgaaccgcgaggtggccaccaacagcgagctggtgccagaggcggcaaagaagcggagaatcctcgggagcctccggcgcaccatgcagaacctggagatagagctgcagtcccaggctcaggcatgaaaggcattcccttggaagaaaaccaaggcccttggagggaagacccaaaaggttcggctacttgcattgccagctggcccaggatccaggagaatgattgggcaagcgtttggagggaagccaaggctttgggccccccaaggctttcccgtgctttgcgcagaaatgggacgccagcgagaacccaggagtaccaagatccttgctggacgttgaagacggcggcttggagccaggagaatcggccaccttaaaaggccttcttcagggggttacccggaggctccggaat

SEQ ID NO: 4741 - DNA, 627 bp, Homo sapiens
atggcttttttcaccaccatcgaggcggtgaagcgcaagatccaggttctgcagcagcaggcagatgatgcagaggagcgagctgagcgcctccagcgagaagttgagggagaaaggcgggcccgggaacagaggtatgaaggttattgaaaaccgggccttaaaagatgaagaaaagatggaactgcaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccattccc

SEQ ID NO: 4742 - DNA, 731 bp, Homo sapiens
gcactgcctgctccgaatgggagacgttgtcacctgcctgttcgctgtggcctctatgctaaagagcggagatcggataaaggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacaccgagggggccttatggtgtgtccccagagactcgggggctcagacgcggtgccttcgtcgccctcctcctacatcagcacaaacacgaaaagactccgaacggtctgcctgagcaccgccagcctcctaggctccagcactcgcaggtccattcttctgcacgagcctctctgtcccagatccataagcacggtcagctcagggtcgcggagcagtacgaggacaatgtaccagcagcagctcctctgaacagagactgctaggatcatccttctcctccgggcctgttgctgatggcataatccgggtgcaaccccaaatctgagctcaagccaggtgagcttaagccactgagcaggaagatttgggcctgcagcctacaggtgtgaggactgtggaagtgcatgttggagggccctaccaagacttga

SEQ ID NO: 4743 - DNA, 643 bp, Homo sapiens
gtttgcgggtggttgttgctctcggggccgtgtggagtaggtctggacctggactcacggctgcttggagcgtccgccatgaggagaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatgggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatg

SEQ ID NO: 4744 - DNA, 759 bp, Homo sapiens
aacgctaggaagcctgggatggaatcggccgagggggacggtccagatgactacggttacatctcgggctccggagctagttgggtcttgttttggtgttttagagtcggtgaaggctttaaaggaagtaggcagctggaacccggctgtggcgggttgaaaagcccgggcgtttgagagctgagacttgccagttcccacaggccaagccaggcgtctgcaccccattctcttggctccgacgaatatgctctccatgagggtgtcttcagggcctaccacaatggctggcactagagaagggcacaaaattgaagaacagtgaagacaaaagcaataagatgattaaggccatgtgagacagcaacaatatcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattcttgtatgccccactatgatattgacagtgcctcagtgcccagcttagaagagctgaaccagttcaggcaacatgtgacaactttgagggaaacaaagacatttctttgcgggaggctagagggctagcctctgtgctgctgctttgccgtgagtgacactggctttctatgctgtagctggaaatgcagaaatcacaaaatgaagcagtgtgtgagggggctgcgtactcaaatccgagagctctgg

SEQ ID NO: 4745 - DNA, 752 bp, Homo sapiens
aggctaggtacgaggctgggtgtgaatcggccgaggcattgggcagctgcttctcttacttcctgagtctcaatttccttatctgtctcagtgggatacaaccacaattgatgtatggatcaaataagaaatgggcattaatagcaccttgtaaaggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcactggcctctgcggcctctgccagactctgggggcagtccggctctcgattc

SEQ ID NO: 4746 - DNA, 601 bp, Homo sapiens
gcccagcctttcgcccaggcgcccaggcccgctgcgcgcgtgcgtgagcgcgcctgcgccgccagggccgctgcaaggggaggagagcggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataaccgaaaaatgtcctgtttccccttatcctgattgcgtgatccagtgtgagcagcccttcatgataaaatccactgtggttgatgtaaggtcacagtagaggaagccgccctgtcatctctaatgagttgggagaacaagggtttccttagacctctttctcaatcttgaaaataaaaccaatagttgtctatcataac

SEQ ID NO: 4747 - DNA, 856 bp, Homo sapiens
cctccaggacctcctggtccccagggcctcgagggcccccgggtgtctcaggagccctggcaactatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcagggatggcctacattgtccaggcccaccaggccagccgtgggccacaggggcccacccggcatcagcgagggtcttctcgtgccctacagcaaacgtgacttgggacctcatgggacttcttccacaacttattggagccatttcaagggacccccgtggccaaaaagggagagatggggcactcccaggacccaagggtgacgggggccttgtgggcccaccaggtcatccgtgggcacctggccctcgaggacccggcggaaacggcgccagggtcccaagctatgctgggggaagggaagagtttgtgcagcgggactagctggagcg

SEQ ID NO: 4748 - DNA, 595 bp, Homo sapiens
atctctgagatgagcctggatatcatgaggctgagagccgagattgacaatgtcaagaaacagtgcgccaatctgcagaacgccattgctgtgatgccgagcagggtggggagctggccctcaaggataccaggaacaagctggccgagctggaggatgtgccctgcagaaggccaagcaggacatggcccggctgctgcgtgagtaccaggagctcatgaacaccaggctggccctggacgtggagatcgccacttaccgcaagctgctggaggtgcgaggaatgcagactcagtggagaaggagtttggaccagtcaacatctctgttgtcacaagcagtgtttcctctggataatggcagtggcagtggctatggcggtggcctcggttggaggtctggggggcggcctcggtggaggtcttgccggagagcttcaagagctaaggaaccttgctgcaagtcactgccttccaagtgcagcgtgccacaacggaacgctgcggaacgctgcctcctggtaacggctatgcggggagggcggacccagagtgctacacttctgatcccctttggttaactacccaaatctaaa

SEQ ID NO: 4749 - DNA, 1336 bp, Homo sapiens
  misc_feature (926)..(926): n is a, c, g, or t
  misc_feature (1205)..(1205): n is a, c, g, or t
  misc_feature (1336)..(1336): n is a, c, g, or t
gccagagacgcagccgcgctcccaccacccacacccaccgcgccctcgttcgcctcttctccgggagccagtccgcgccaccgccgccgcccaggccatcgccaccctccgcagccatgtccaccaggtccgtgtccttcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcaacgtgcccgggggtgcgggctccttgcaggactcgggtggacttctcgctgggccggacgccatcaacaccgaggttcaagaaacacccggaaccaacgaagaaggtggagctgcaggagctgaaatgaccggattcgccaactacatcgaacaaggtgcgctttccttggacgcaagcaagaaataaagatcctgtgctggcccgaagctccgagcaagctcaaggggcccaaggccaagtcgcgcctgtgggggaccctctaacgagggaagcgcagattgcgggagaagcttggaaccagggcaaggttgcgcccagttaaccaaaggacaaaggcccgcgtatagagggatgaagacgcgaaaaccgtggccgaggacattcgtggcgcctccgggagcacattgccagggacgaaaatgcttcacgcacgcgacggaaggccggaaaacacccctgcgaaccttatcagcaccacggagtgtgaccacctgcgccgcctctgggacccgttttttacctttgtaccccaaggttgcaactcttttggcacacaagacgaatgccctttatgaagaacacctcccgangacaagagactccacagagacgggacggcacccacacatcagggcaaaaccatgttccaaccggaagggcggattttcacagccatatcacagcagggccgctcggtagacggacctgaccaaacaaagtgggcgtgccaacacaccacggcgaacaagagacagaacaccaagaggagccatcagcgcgacagaaaaacaccctactgccgagcagataatagatagagagcaccccatgatattagataaaaactagaccgcatgaatgagtagcancagagcacaatcgtttttctttttttttttttttttttttctttttttttcttttttttcttttttctttgtttgctgttcctgctctccagtaaccacacatgcacaaccaccaccccaacaccaccacn

SEQ ID NO: 4750 - DNA, 993 bp, Homo sapiens
tgctccgtccgtgctccgcctcgccatgacttcctacagctatcgccagtcgtcggccacgtcgtccttcggaggcctgggcggcggctccgtgcgtttgggccgggggtcgcttttcgcgcgcccagcattcacgggggctccggcggccgcggcgtatccgtgtcctccgcccgctttgtgtcctcgtcctcctacctggacaaggtgcgcgccctggaggcggccaacggcgagctagaggtgaagatccgcgactggtaacagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcgtggaggccgacatcaacggcctgcgcagggtgctggatgagctgaccctggcaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaaatatggaggttcactggccgaggcagaaaccggaaaggatgttgaagccttggtgtcaccaggcccggactgaaggaattggaaccggcgaggtcgtgggccacacgggagcagcttccagatgagccaggtccgaggttactgacctgggggaacccttagggtcttggagattgagtggagaacagtgagcatgagaactgcttggaaaacactggcaaacggggggcttgggccaaggggaatacagggcatagaggtgaacccggggtggagtaagagaagagacggcggaacagggagagacacacag

SEQ ID NO: 4751 - DNA, 928 bp, Homo sapiens
gtgaacgtcatcatctccacctacggcgagggcgagagcggcccatgggcaacatcatgatcgatcctgtcctcggtaccgatgggcttatgggtctggcctccacgggtgggccttcaccctgcaagcagttagccgagcatgtatgtggccaagcttcgccgccaagggggagggccagttggggcctgccgagcgggccaaggagaagtagaggacactgatgaagaagctgtggggtgacaggtacttcgacccagccaacggcaagttcacgcaagctcagccaccagccccgaagggacagacagccgccacgcaccttctgccagcctgactcctggaccccatcttcacacggtgtcgaccgcgactcatgaattccacagaacgaggacgacagcccacactgactagacgaacactggacactcgacaacctggacagcgaggacaaggacacccgaacggcacacccctgctcgcaggctgcgactgcgccgcatgcctgcctgcccggagacgccttgccgcagatgactcacatcgacctgccctcccctgtgacggcccacaagtaccgctgcgagctcctgtacgagcgggccccggacgacgacgccgacaatggcgccactaacaagccgcgacccaaaggccctcccacgcacgctctatccccacccggcgcccaccaccgcccacggccgaccctacgccaacgcacgactctcaagcgcggccgccctccactggcctgcacgtccgaccatcccgccacgctaccccccgggcgccccccgcgggcctctaaccagccggacaacaaataaaccagcacgcatgacaccaaccacaacacgcacctgcgccgaccacacagcgatgcgacccaagcacaaaacccccgaccaacacccacagcaaa

SEQ ID NO: 4752 - DNA, 555 bp, Homo sapiens
  misc_feature (291)..(291): n is a, c, g, or t
tgcaaatctggcagcccccgagaggggtttggaaccttagcacccaagtctaagtcaacttgcatagtgtgaacatggctacgcctcgttcattccgcgtccatgccgagccccctgatgcagcattcaaaggccgcacggaggttgagccgggcacagaaactacaggcaagcggtgaggcagccaatcaccagcactgccaacagacgagctcatcgtgcgcccttgtgtttgagaacgcttaaaagttctgattccacctagggagaccatggacctggcaccccggntacacaacacttggtgtgctcaagaaagcaaagcacacatcaagaaacttgacagaagcgtggcaaacgaaataagccaagtaccaagctcgagaattgggaacgagaacagagatttttaaagtggcgactggaacagctgcagggtcctcaggagatggaacgaatacgaatggacagcattggatcaactatttctttccagaaatttcggatacctggaatttccagaagcgaagaaggagcattgcaagtggatgttga

SEQ ID NO: 4753 - DNA, 374 bp, Homo sapiens
gtctcgtctgtgtgatcaggctggaatttactgggttcatctgattgaccacttctgtgctggatggggcattttaattgcagctatactggagctagttggaatcatctggatttatggagggaacagattcattgaggatacagaaatgatgattggagcaaagaggtggatattctggctatggtggagagcttgctggtttgtaattacgcctatccttttgattcgccttataagttgctgcagaccagcttctaactggggtccatacctggaccaacatcgtggggaaagatataaagacatggtagatcctaaaaaagaggctgaccatgaaatacctactgttagtggcagcagcaccaccagga

SEQ ID NO: 4754 - DNA, 314 bp, Homo sapiens
cgacgtggcttcaggaaacgaacaccatcagtagggaaagctatggacacacccaaaccagcaggaggtgatgagaaagacatgaaagcatttatggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagaccgtgcgcagcgaggaccaga

SEQ ID NO: 4755 - DNA, 573 bp, Homo sapiens
actgagcaggactttccttatcccagttgattgtgcagaatacactgcctgtcgcttgtcttctattcaccatggcttcttctgatatccaggtgaaagaactggagaagcgtgcctcaggccaggctattgagctgattctcagccctcggtcgagagaatctgtgccagaattccccctttcccctcgaaagaagagggatctttccctggaggaaattcagaagaaattagatgcggtagacagtgagatgtgtgtcccatgaagctgaggtcttgaagcatctggctgatacacgtagcgcgcgagatggaagggcttcagaacggcgattggccagagcacatactacttccagtaaaacggccgaagttgactggacctcacaaaatggataggctaatagaggatgaaacgcgaggcacaatgtggtggtccaagatgtggcaacgttttgcgacgagacaggataagcaccctagacagaagtgcggaagagactaggaactccaaagatcctgcgtgacgagactgaagctgactaattgttctgagaactgactttctcccca

SEQ ID NO: 4756 - DNA, 646 bp, Homo sapiens
agctaccactgctaagagccatctccaccagaagcctggccagacctggaagaacaaagagcatcatctctctgacagagagtttgtgttcaaagaacctcagcaggtagtacgtagagctcctgagccacgagtgattgacagagagggtgtgtatgaaatcagcctgtcacccacaggtgtatctagggtctgtttgtatcctggctttgttgacgtgaaagaagctgactggatattggaacagctttgtcaagatgttccctggaaacagaggaccggcatcagagagggaagagaatggcagagtacacatatgtggaaagagtgaagatacccttggatcatgggaccttgttaatcatggaaggagcgacacaagctgactggcagcatcgagtgcccaaagaataccactctagagaaccgagagtgaacctgacctttcggacagtctatccagaccctcgaggggcaccctggtgacgtcagagctttgagagagaagcttcactgaaacggagcaaccttccactgagaagccacttcaagaggctggtgctgctagatctcatgatgtggctgttgggaagatggtgacgttggttgccagcttggagtcctattaaatggaagcagcgactca

SEQ ID NO: 4757 - DNA, 643 bp, Homo sapiens
aaaggagacatcttgagaatccgggacaagcctgaagagcagtggtggaatgcggaggacagcgaaggcaagagagggatgattccagtcccttacgtcgagaagtatagacctgcctccgcctcagtatcggctctgatggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatctttttttttttttcccaagggccatctatacaattttcttacagatgtcaaaagcagctctagtttatatataagcatccgggtaaccggggtgatatttttaagacgtgaagggttccctttccatagttcttaatttaccactattcggggttacgaacgggagggctgggtgtgtaagcttcggaatgggcaatgggaggcggaagcgggctcgtgccgggtgtgtatcagaggggataggtatctggcctcctttctctcaggcaggtgcaattcacccgtgggaaacccgatggacaggacggagtgtcaccacacgg

SEQ ID NO: 4758 - DNA, 503 bp, Homo sapiens
ttctgacctcacctgggacaatctgaaaggcaagaagtcctgccatacggcagttggcagaaccgctggctggaacatccccatgggtcctgctctacaataagatcaaccactgcagacttgatgaatttttcagtgaacggtcgtgcccctgggtctaagaaagactccagtctctgtaagctgtgtatgggctcaggccctaaacctgtgtgaacccaacaagcaaagacgggatactacggctacacaggcgctttcaggtgtctaggtcgacgaacgggagatgtggccctttgtgaaaacacccagacctgtcccatcaggaacactgggggggaaaacaacccctgatccatgaggctaacgacatctgacatgcacacacagactcatgcagtcgcggtgccttgcatggtaccaaggcacatctgtggaggagtatgcgaactgtcacctggccagagccccgaatcacgcttgtggtacaccagggaaagata

SEQ ID NO: 4759 - DNA, 738 bp, Homo sapiens
tcctgtgcaaaatggcaactcttaaggaaaaactcattgcaccagttgcggaagaagaggcaacagttccaaacaataagatcactgtagtgggtgttggacaacgttggtatggcgtgtgctatcagcattctgggaaagtctctggcgtgcatgcaacttgctccttgtggcatgttttggcacagcatcaagcttacacaggagacacatgcatggatctgccagccatgggcagcttatttcttcagcaccacctaacaattgtggcagataaagattattctgtgcaccgccaattctaagcattgtcagtggtcaactgcaggcagtcccgtcaagcacagcaaggggcagcagtcggctcaatctggtgcagagaacatgttcaatgtcttcaaattcattattcctcagatcgtcaagtacagtcctgattgcatcataattgtggtttccaacccagtggacattcttacgtatgttacctggaaactaagtggattaccaaacaccgcgtgattggacagtggatgtaatctggattctgtagatttcgctacttatggtgaaaaacttggcattcatcccagcagtgccatggatggatttgggggaacatggcgactcaagtgtggtgtgtggagtggtgtgaatgtggaggtgtaatctcaaggaattgatcagaaaatgcgaatgaactgatagtgaaaatggcagaagtgactaagatgatga

SEQ ID NO: 4760 - DNA, 880 bp, Homo sapiens
agaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggcctggaactgatgaagatactctaattgagattttggcatcaagaactaacaaagaaatcagagacattaacaggctctacagagaggagcctgaagagagatctgggcaagaaataacctccagaccatctggagatttcggaacggcttggcctttctctgcttaaggtgaccgatctgaagactggtgtgaatgaagactgggtgattcagatgccaggcctgttgaagcgggaaggcaacgggccgacgtaagtgtcaatactgcttgcaccgaggcatcccacttgaagtgttcaaatacccgtagtagataaggacaagttgcacgggtagacaaaaccattctagggaaaaagtctaaattcagagtggccaataccaggcgtgtatatataaaagatccacaagggaagcttcttgtttatttcccagtac

SEQ ID NO: 4761 - DNA, 870 bp, Homo sapiens
ggcgagtttccggtctgggcttggcgggtctggttgaagctctcctgtttgacgaaagtatgtctcaggaaggtgcggtcccagctagcgcggttcccctggaagaattaagtagctgggccagaggagctatgccgccgggaactgccgtccgtcctgccccgactcctctcatggtctcaacattctgaaagtgggatggagcatattcaaatttgaaaattatggtagaaatgtttttacctcatatgaaccacctgacatgtggaacagactttcttttcacaagtgttaccaaagactgtgaaattattcgatgacatgatgtatgaattaaccagtcaagccagaggactgtcaagccaaaattggaaatccagaccactctaaggaatattttacaaaacaatggtgcagctcttaggagctctcacaggatgtgttcagcatatctgtgccacacaggaatccatcatttgggaaaatattcagagtctcccctcctcagtccttcatataattaaaagcccatttgtgcatgtaagttcagaccttctccaggtcttttcaggaaggcctattctcttcaaagcagttaatggaactactggacatggtttgcatggacctttaatagatgaccatgatgatatttgatatggtaataggtgagtgaagaaaactttctgtagtattttgggactataatccatgttccataaaatgttctatggtctgttttctatatttggaaaaaaaaaaaaaaaattgggggggcggccgagaataaaaaagggggggcgagtagaaggtagtagacgggaaagtggtcaaaaaggggggtgaaaggttgtgtaagatccccctgta

SEQ ID NO: 4762 - DNA, 939 bp, Homo sapiens
  misc_feature (660)..(660): n is a, c, g, or t
ggacagttttctgacaaacgcagattagaagccaggttgcaaggcatggtgacagaaacgacaatgaagtgggagaaagaatgtgagcgtagagtggcagccaaacagctggagatgcagaataaactctgggttaaagatgaaaagctgaaacaactgaaggctattggtttactggacacttaaacatgtggaagcccggagagagcctctcgggcgaggcgcggatcgtcgaagaagttagtcacatcgatcgtatctgtcctctcaacttcatcctgttgcctttactcttctcaaccctgatcgagaacgcaccaccaattcgtctccgacacagacgatcacgctctgcaggagacagatgggtagatcataagcccgcctctaacatgcaaactgaaacagtcatgcagccacatgtccctcatgccatcacagtatctgttgcaaatgaaaaggcactagctaagtgtgagaagtacatgctgacccaccaggaactagcctccgatggggagattgaaactaaactaattaagggtgatatttataaaaccaaggggtggtggacaatctgttcagtttactgatatgagactttaaagcaagaatcaccaaatggttagtcgggaacgaagatcttcccacaagtagcancttgccccaacccaggatggtgcagagtctgaatggccgatgtagaaacaggtggtctgtggtgggggagataagaggcggatcccagtgggacctggtatagattcagcaaaaccaagggaaaagctggatgggtccagttgaagaccttcttgtgtgggtattcgaagcagcgaagagtttcaggcacttggaaccagttggtgaccggcccgatcacagcacaaagtttctgttcaatttcactttgttggattaagagactccgatctgatatag

SEQ ID NO: 4763 - DNA, 1038 bp, Homo sapiens
gtggatggccgtgagtgtttcacagaaagttctccgctcccagtagcatgggatccgctcgagggtatccttgcgcctcggcaatcagcacgagagctgtgcaatcgtgtgcgaacggtgaacgagcttctcctataggatgagcccatctcgaagccggtccatcctcacaggccttcctgggatacaaggctggcatgactcacatcgtgcgggaagtcgacaggccgggatccaaggtgaacaagaaggaggtggtggaggctgtgaccattgtagagacagcagccatggtggttgtgggcattgtgggctacgtgggaaacccctcgaggacctccggaccttcaaggactgtctttgctgagcacatcagtgatgaatgcaagaggcgtttctataagaattgggcataaatctaggaagaaggcctttaccaagtactgcaagaaagtggccaggatgacggatggcaagaagcagctggagaaggacttcagtagcatgaagacagtactgccaagtcatccgtgtcatttgccacagccagatgcgcctgcttcctctgcgccagaagaaggtccacctgatggagatccaggtgaacggaggcactgtggcccgaagaagccggccgggggcccgcagcagaaggcttgagccaagcagagtacaccgcgtgaacccaaagggtctgggccacggatccgacgaacgacgctcaaccagctgaacacagggcaagggctatcaaggcggccaccagtccgtcggccaccccaagaacagctcccccgcaaagtacccccacaccctggtgaaaggtgccctgaccatcggcgcccgggagcacccggcaccgtggcaacacccacacagagagcgcagccccatcgggctaacagctatcgcgacaccggccgagccccatccaacacaatgctcccaccgtctaggcggccaccatataaggccggcaacatacactgcaacccgatcccaggtacccccactgaaccccatcacggagcggcaccc

SEQ ID NO: 4764 - DNA, 338 bp, Homo sapiens
tcccatttcacctgcccattctatacaaaaacaacaaaaggaatctcaaccaccagcaggattttaaaaaggctatctaaatatttggattacttccttaggatagattgccagaagtggagttactgggtcagaggaatgtgaaaacctttgcatcttctgatagtctagccaaggtccaagaagtagcaagctggcttttggaaatgaatcaggaaccgctctctgtgggcagcaaaagacgacgaactggaggctctctgagaggtaacccttcctcaagccaggtagatgaagaacagatgaatcgtgtggcaggtgaaggaactgggtaccga

SEQ ID NO: 4765 - DNA, 992 bp, Homo sapiens
ccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccacctccactctcacgggcctgcccagcccctaagccccgtcccctaacccccagtcctcactgtcctgttttcttaggcactgagggatctgagtaggtctgggatggacaggaacagggcaaagtagggcgtgtggttttccctgcgtcggccctgggggtaccatgtggccacaactgctgtggccccttgtccccaagaacttccccttgtctcctggttgcctctcttgccccttgtcctgaaagcccagcgaacacagaaaggggtggggcagggtctatggggacgaaaggcagccggggtccgaggaagggcaatgggtggcagggtgagacgttgggggcccacatgctggcttttacaccccaaaggacacagcgacgcttccacacttattatcttctgtccagggaaacaacgtaaccacacatcaatacacagatgcaacacaacacaaaacaaaaagacggcgggccatatctacacgggagcggtcactccactgaggcaggcgcctcgataataaacacggcgataatacgagagacgcttagtaacaaccggggaaaaacagatcgcaacatagggcacatcgcacaagaaaac

SEQ ID NO: 4766 - DNA, 955 bp, Homo sapiens
ttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctggaactctttcttcggggcccccggggcacaccatggaggtctcctgttgaatggcccttgttgccctagagtgggacccagccctcacctcccccagagctaacctgggaggtgctgaaggggcattgggccaccgtaagcaagggaaaaagggcagatcatgcggggagatgaccttgatctttgattgctaccctaaccttgacctttaacccgtgattccccccagctcctggaagagatgtcctaatatctcttagggacccagacccctaaattctcctcctcccccattttggtgttaaggtggagagggcatatgcatcctctgtcctgatctaggtgtctatagctgaggggtaagaggttgttgtagttgtcctggtgcctccatcagactctccctacttgtcccatattttgccaggggaggggatttggggctggggctcccattcaccaaagctgaggtggttctcattaaccctttggactctgcagggtttgggcctacgtgactgtgtgtccggaggcgacttgctggtgggttagtggccccagctgtggttgcacactcccgggtccggacttggactggcgttgcaggcctgacactttgggccggttcgtgctgggcccaggaagggcggggcctggggccactggcccggctccgggggggggcaccggcggtctggtgcaagggggcccggccccgtgtggccccccctaagagaagcg

SEQ ID NO: 4767 - DNA, 758 bp, Homo sapiens
  misc_feature (716)..(716): n is a, c, g, or t
caccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagctgaggatttgtgactggaccatgaatcaaaacggcaggcatttataccccagtaccagtgaggatacatgggaattacttggcaaagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaacattttttttttaaactacaaaacaacacccggcccacgcggacgactggccaaaacaacacaaaggcgagaaaggaacgaactgacgaacgaagataatagaccagcaatgggcagcacttacaatcactaaatttccccttaaggtttgaaacctgtgattgaccatacacacgggtcgactgatatttcactgatggtagatcgcagccctgtaacgtagcctttggttacctgaaaggtccgtgggaaaatagactggttctggctcttatgacaatatttttactgactttctagatgccttaaatnttgctgaaaagccagataagggcacgaacctcggggtacccg

SEQ ID NO: 4768 - DNA, 782 bp, Homo sapiens
tactgatttgagaatttaaagcagattaccttttaaaactggaccaactaagtaatggtatttaatcaaagagaaaatggtaataaacttttcaaaatcttggtgaaaccaaacattcaacacaaaataaactagaaggccagaggatagtggaataaaagatcattgcaattacttatccttcctaaaaatatagttttatattaatgtgtgcttatggaagaaacaatgtcagccaagtccattttatagtttgagtgcaattctttgaacaatagaaatatctgcagtctttcacagatttgtattatgctgaagagtttcatctgacaatctgcttcaagaaatctcagaaaatatgataacattttaactttcgttttagagcacgtttggtcatttttaaaaatacctaaagtgccagaccggaacctatagctactgctagaagtcttaaaaaaaccaacagcagcacaggatgtattaagaattatatgaagtccaggtggttaaatataataattatgttatttgcaaaaagccacaagacacgtgtacgcggctttggggggcccgggaacaccgagtagggttatccccctctttgttcaaatggggacagcctgcggacaaacacagcgactataaccacattaaccttcaagaaacgtggaatgcccttttcccacagtcttttatttatataacatattttgtcaacccgtttcgatctggtttgacacggctaccaatcctgtgctattgtccctcgtgatcataag

SEQ ID NO: 4769 - DNA, 836 bp, Homo sapiens
gactcaggcagcagccccttctttcttgccccagtctccagttctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgagagggacagaggatgagctggacaagtattctgaagctttgaaggatgcccaggagaagctggaactggcagagaagaaggctgctgatgctgaggctgaggtggcctccttgaaccgtaggatccagctggttgaagaagagctggaccgtgctcaggagcgcctggcactgcctgcaaaagctggaagaagctgaaaaagctgtgatgagagtgagagaggtactgacggttattgaaaaaccgggcttaaagatgacgacacacgatggaactccaggaaatccaatcaaagaagctaagcacattgagaagaggcagataggaagtatgaaaggggtgggtcgtaagtgggtgatccattgcaggagactgtggaaccgcacagaggaacgagctgagctgcaggagtcttaagtgttctgagctggaggaggaggtgaagaatggtacaaaaactcaagttttttggaagctcagggggagaagtcctcctacacgagattatttggggaggcaaataagattttcgggtaactaaggggggagacccgggagattgggaaaacgggcgcgcggaaagacatgtgcgggagaag

SEQ ID NO: 4770 - DNA, 839 bp, Homo sapiens
gggcccagtctccagttctccagtgttcacaggtgagcctaccaacagccattgtcatgatggaggccatcatgaagaaagatgcttgtatggctgtagagttatgataagatagcatatgctctggatcgggatagagtaagctgaaggttgatgcaatgaaattgcaggcagaatgagagaatttaacaagtctggaggatgagctggctatgccatgcagaagaagctgaaagggacagaggatgagctggacaagtattctgaagctttgaaggatgcccaggagaagctggaactggcagagaagaaggctgctgatgctgaggctgaggtggcctccttgaaccgtaggatccagctggttgaagaagagctggaccgtgctcaggagcgcctggccactgccctgcaaaagctggaaggaagctgaaaaagctgctgatgagagtgagagaggtatgaaggttattgaaaaccgggcttaaaagatgaagaaaagatggaactccaggaaatccaactcaaagaagctaagcacattgcagaagaggcagataggaacgtatgaaagaggtggctcgtaagttggtgatccttgacacggagacttggaacgcgcagaggaacgagctgagctggcagaggtctaagtgtctgagctggaggaggaggtgaagaatggtccaagagctcaagtatcttgaggtcaggcggaggaggtctctccagaacatactttggcgcgcgcagccagattcttctggtaaccccggggcgaacccggcggcttgctggaaaccgtgctggaaaaccatgttgtcggaaagtttcccaat

SEQ ID NO: 4771 - DNA, 812 bp, Homo sapiens
actcaggcagcagccccttctttcttgccccagtctccagttctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcgagaagaagctgaaagggacagaggatgagctggacaagtattctgaagctttgaaggatgcccaggaaaagctgctgatgagagtgagagaggtatgaaggttatgtgaaaaccgggccttaaaagatgaagaaacagatggaactccaggaaatccaactcaaagaagctaagcacattgcagaagaggcagataggaagtatgaagaggtggctcgtaagttggtgatcattgaaggagactgtggaacgcacagaggaacgagctgagctggagagtctaagtgttctgaggctggaggaggagctgaagaatgtcaccaacaacctcaagtctctttgaaggtcaggcggagaagtactctcatacagaagataagtttgaggaagaatcaggattcttactgataaacttcagaggcagagaccgtgctgaagttggtgaagattggtagccaagtggaagaaattgtgactggaaatgagttttatgccgaatgagttaggcttgaggggtggaagcccagagacaaaataacggtgcgggaaggctattgggaaaggcttgggttttggggggccaaagg

SEQ ID NO: 4772 - DNA, 610 bp, Homo sapiens
gagccactagacgctccaccaccatcttttgcatgtgcaacatttgcagccggacagaaaacctctcccagggctatggagactgcgggaaaaatctggcggctcgcgatggattgctaaggagaactagtcataatcttaaaccaccgaaacctctttccttttttttctttcttttctttcttttcttttttttttttattttgggggtgtgagatttatacatttataggcgcgcccatcggtctctcaaggcgttctctgaacagcctttaggaacgagtgcgagagaaagagagagagcgcgcgccagggagaggagaacaagaagatgaggattatttccagacagatggtctggtaattttcgggatttgggggactcgccaggggagcctttccgagcagcgtgcaaatagggggtctcttcatccgaaacacagatcgggaatacacgggtttccgattagacaatttttcttcataacaccagccccaaggggtcggaagctcctttaaattggggtacctctggtgggaccactttgagacagccaacaagtttggcggtaacaaacgccttcggtcccagtattctagaggagtatag

SEQ ID NO: 4773 - DNA, 882 bp, Homo sapiens
ggaaggagctgaccagccagctgacccctcacactcacctagccaccatggacatcgccatccaccacccctggatccgcgccccttctttcctttccactcccccagccgcctcttgaccagttcttcggagagcacctgtgggagtctggatcctttttcccggaacggtctaattccctgtgagagttcctctctatacttcggggcacacctctctcttcctgccggggggacccagccgtgcgtggttgccgactggtgcgtacatcagacggatgccgtcctggaagcaaggaacgaggtccctctgtccagcctggcagtgacgaagacacttcccttccccaagaaggaaactcaaagttcacaggtgtgggaaagatgtgatctgagcgtgcattggaaacaacatgaagagccgccaggatgacacatggtttcatctccagggagttcccacaggcaaataccggatcccagctgatgtagaccctctcaccattacttcatccctgtcatctgatgggggtcctcaactgtgaatggacccaagggcaacaggtctctggacctgagcgacaccattccccatcaaccgtgaccgagaaagactggatggtcaacgggaggccccaagacagtacgatggccttttgttgaactggatgttttcacaagcaaagaaaggtttacccaagcggtgacatgacaagtcttggtggactaggggtgaacgcttataatggtaaggggagggccaaatatcaagatattcgagataattacgcaacacagagacacccaaaaaattggaggtgtgtatgagaaagtgtaaacaaatattggggggccccttaagaacggtctgtgaaggactcc

SEQ ID NO: 4774 - DNA, 1615 bp, Homo sapiens
gatgctctggtattcatgccaaagacacaccagccctcagtcactgggagaagaacctctcataccctcgatctggcaccactccttctacaatgagctgcgtgtagcacctgaagagcaccccaccctgctcacagaggctcccctaaatcccaaggccaacagggagaagatgacccagatcatgtttgaaaccttcaatgtccctgaccatgtacagtcgccattcaagctgtgctctccctctatgcctctggccgcacgacaggcatcgtccatggattcaggtgatggcgtacacccacaatgtccccatctatgaaggctatgccctgccccatgccatacatgcgaccatggactaggctgtgccgtgacctcacggactacctcatgaagatccctcacagacagaggctatccttgtgaccacagctgagagagaaattgttgccgagacatcacaggacaagctgtgctatgtggcctggatctcgaaatgagatggccaacagagatacatctacgccccgggagaagagctatggagctggcagatggcgcgggtaataacatcgacaagagcggaatcagctgccagagacctcatcacagctccaatggcaggagcccgggatcacgaaacagcaaacccacagaagggaacagcacgaaggaaaatccaaagacccgaggcgcacaccggcaggcagagcaggcaaccgccgacgaaaaaagaccaggaaagggggacacctcccacgtgacgtgccgtcaccacagacggacaaaggaagagcgagtaagaggaccaggaagagcaggccagccgaatcacgcaacaacaacgaaacgcaacgagcgcacaactacgcgtacaaaaacaagaaccagcagcacgaacgcacaccgcaacagcagcgaagaacgcacgacaaagcaagacaccagcaaccgagagccactcggagcgccaggggcgcgagcgcgcggcgcggacggcccggagaggagcaggaggcacgggagagcagcggaggcgagagcgagagcaaggagaagacgacgaagccgcgagaggcgggggcaagggacgcgagagggcgcggaacggcgggccagggagagggagggggcagaggaagggagcgggcggaggccacggcgaggcacagaggaggaggcgggggagaactagagcggcgacgcgggagacaggcagcagagagcgcagagcagcaggagcgaagcaggcgacgagcggcgcagagcagaacacggagcgcgacgacgagaccgcagaggcagcgggcaacgaagagcggcagagagcggagcgaaccgcagaacgaggaagagagagaacgggaacagagcaaggcgggagacagagcgagagggacagaacgacagggcgaggagagaaaggagaggaagacgaggagacggaaggcgagcagcggaggaacggagcgacgagggaggaaacgcaaggaggaagcggaggtgagaaaggaggcacgagcgaggacgagagaccgggcgagcaaggcaaggcagacgaggcgcacgacgacaaggcaagcgacggcagagagacagagagccagagaga

SEQ ID NO: 4775 - DNA, 1074 bp, Homo sapiens
  misc_feature (709)..(709): n is a, c, g, or t
ggggaagcgcagctcgaaaagcgatgccgattctggtttcctggtggctgcggcccacttcggtgtgacccatgcgctgaggcggctggcgtgctgatggccctaatgacaatacagaatgctggtggcttgtgctggctgtgcattgcttcatgtgatgccctgctgtgtgtgcttggatgtgtttgaccatgttcctgtgaatgactgtgctggctacatggagcgcactgagcgtgttggcttgttgtcagaggccccaaatgaaaaactcttcttctgtggacacttggctccaatggaacaacacgggctgacaaagaagagaaccaaatgtccagaagaagtcactgcttctcaagaaaccccttcgggttgacctcatcctcgagaacacatccaaagtccctgaccccaaagacgtcctcgcccaccaggtcccaacgccaagaagctcaggcggaacggagcagctatgggagaagctggacaagcagggctgagctgccctgggaggtgcgcaagggcccaggcccggctcctcaacccttctgcaacaagggccaagaccgggcccaaggacaccgtaagagctggccttctacgaactctggggctcagacaacacctggacaggcgttggttggccaggatgagtattcctggagcagacaaggagaaaggagtgaagcggcagcacgcctgacancaaggctgccaggcgccgccggggaggtggtgcatgcggagcttcctaaagcatctttgaagacacagaacatggctcaagggccaggagtggattgacagggaaggaggggaaactgaacgattgctggcgcacggaaaggacgcaacagggtccaatcaagaggtggcaagagattaaggagagacagatgacagtggccaggacggacatgacagagagatatcggagccaacgcgggagcaaagaaagagagaaagggcgagcgagacggagacagcaaagagaaagaaaagacagcatcgacacgagaagagagcagagagcaagagcaaacaaagggcaggaacaatcgaacgaacacg

SEQ ID NO: 4776 - DNA, 701 bp, Homo sapiens
gtcagacggtttcggtgcttctcccactcggatgttcccgcggttaaaagagtccgcaggagcaccgaaatacctcttccaggttaccttgaggatagtttgtgtaaaatctggagtcttcaatgtatcagaacttgtaagagtatccagaagcgcccataacccaggaactgagtcaacttcccaatgtgagaaatcccaagccaaccatactatcatgacatgaactcgggggtcaatcttcagaggtctctgtcttctccaccaagcagcaaaagacccaaaatatatccatagatgaacacatatggaaccaagtcctacaggagacttttacccctctccaagttcaccagctgctgaaaggtcgaacatggcacgaaagagatcaagatatggtcttctccgactactatgaagaagcctgaaaagcattgttcagctctgatctccacaggattcttccccaagaactgagcatttcccccagaacacatcccggaatacctggagttgcacacaggggttcatctcaatcgaatcaactccacttcaccgttgccatttccaacaaaagctatccttcctccagccccatcgagctactttttctcatccaaaaatcagatatcttcccactgaatctcaggaaactctgaagaatatgtactttatgacccatcagtcaaaaacagcagcta

SEQ ID NO: 4777 - DNA, 889 bp, Homo sapiens
actcaggcagcagcccccttctttctggcccagtctccagttctccagtgttcacaggtgagcctaccaaagccactgctcatgatggaggcatcaagaaacagatgcagatgctgaagttagacaaggagaatgctctggatcgggcagagcaagctgaagctgagcagaagcaggcacgaaagacagaagtaaaccgctggaaggatgagcgggccagcccatgcagaagaccgctgaaaagggacagaggatgacgcggaccaaagctatctgaagctgtgaggggatgcccaggagaacgctggaacgggccgagaacgaacggccgctgactgctgaggcctgaggtggcctcctttgacccgtaggatccagctggttgaagacgagctggaccgtgctcaggacgcgcctggccactgccctgcaaaaatgctgggacgcaacgctgaacaagctgtgactgaagagctgacacgacggtatgacggttcttggccaccggggcttacatggatgatgaacagatggaactcgggaaatccaactcaagagaacgctaagcacatgcagaacgaggccagactaggaacggcctgaaccagggggctcgacagctgggactcatcggacgcgccactggcacgcacacgaggacgagctgaggctggacgagcataagctgtctgaacctggcgaagacctgagaaatgcacaaccaaccacagcctcctgaggcacagccgacacagctcccccacagaacatcaacagctgggcacaatcagactctaccgataaccaagcgcaaaacccgcgtcgctcggacaaccggccaccgacaaccggcccggaaccaacccaacgcacgaccagacggccaccg

SEQ ID NO: 4778 - DNA, 532 bp, Homo sapiens
aataagcgcgtacaggtggcatcttccattcccaacctccagtctgtggacttagaagctgtggcaatcacagtgaaagagctagttcgatatacactcagtataaatccaaataaccattcttggttacttatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggctattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcagtgtataaaacctctgaaggggggagaggaacagccgcag

SEQ ID NO: 4779 - DNA, 469 bp, Homo sapiens
  misc_feature (430)..(431): n is a, c, g, or t
ctagagaaaagcgatgccgattctggcttcctggcggtgcggcccacttcggtgttcccagcgctgaggcgtcggcggcgagcgggaagaaataagaagcggggctggcggcgccttgctcaggagccgctggggctggaggttgaccagttcctggaagacgtgcggctacaggagcgcacgagcggtggcttgttgtcagaggccccaaatgaaaaactcttcttcgtggacactggctccaagtaccaggcacctgacatcgacgtgcagctgagctcggagctgacagactcgctcaggaccctgaagcccgaggacaacatccttcgagaccggttcaagagcttgcagaggagtaatatgatcgagcctcgagagagagccaagttcaaacgcaagtacaaggtgaagctggcggagaagcggnncgtccgtgagatccagttgtagctgccatcagatgccg

SEQ ID NO: 4780 - DNA, 681 bp, Homo sapiens
tgcctgggtggtctttaccagcttagactctatcatgggcccccatgaagctccattctcaatactgaataattattacttcccttgttgagtttctttttctgtcatgccctgggggcttctgctcttctcaccagaaagaacatttgaatctggattcttgtacacctgggttagaccctgttcagaggtgtggccaatttatcccgatctcctggaaggctgtgtgatttccatctaagaaatgagggtcttgagaatcaaccagtcccaagattagcctgttatcctgttatctactgagaccccaaatttctcaccaatgtttgggagatcctggaaaagatcccttcagtttagggtgtcaccaagacttctacacaacccaggactaccattgacctcagagcagtaccccacatcttgaagtaaattgatcccaccaggtcccacgtttgttatctctgcctaaatgttagcttctccatcctcaccacatgatgaccagctgtgtccctctggaatgcaagtccttcttccctttggaatgtactctggatcccttcccctgctttgaccccagactttgctccatctattattgttctccatcctggatccttgacatttgtcaccccactggcttctcaggtgcatcaagtaaaatgctgagactctgga

SEQ ID NO: 4781 - DNA, 1014 bp, Homo sapiens
  misc_feature (562)..(562): n is a, c, g, or t
  misc_feature (650)..(650): n is a, c, g, or t
cggcagcaggccaccatggcggagctgcaggaggtgcagatcgacagagtgagaagccactgttgccaggacagacgcctgaggcggccaaggaggctgagttagctgcccgaatcctcctggaccagggacagactcactctgtggagacaccatacggctctgtcactttcactgtctatggcacccccaatacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaagtgagaggcctgggaacccctccaaaccagagttctctttccagcacaaggagacccttagaacttccagtttctctacaataattggagttggtgttggagctggagcctacatcctggcgagatatgctcttaancacccggacactgttgaaggtcttgtcctcatcaacattgatcccaatgccaagggttggatggcattgggcagcccacaatgctaancaggcctcacctctatccatgcgcggagatgatccttgggacatcttttcagccaggaagaggtctctggaaattctgagttgatccaaaagtcccgacaatttccttaccttgaccaaccgggattaccttgcactggcccgggaccaggttcaacaagcccgccgaagaacctgtaacctttgtaacggttgcagcggtaatttatcccctcagggggtccccgagcaaactgcggggtggtcgagagagccccagcccccttgtatgaagtaccggaggcaaagtataaccacaaacggtggagcccccccaaagaggtactgtgcttcaacaatagagcgtatcacagagagatacacca

SEQ ID NO: 4782 - DNA, 526 bp, Homo sapiens
  misc_feature (455)..(455): n is a, c, g, or t
ataaggtgcgaggcatgttgatgcactgatggatgagattaacttaaatttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggaggctgcaggcagaacaagctgggcgggaattggcgaataacttcggcaaaaacaaaggcaattgagattcttcttgaagaatgaaacgggatggattccgagggctgagagccggagatttgacaatgtcaagaaaacagtgcgcccaatctgcagaacgccattgcggatgccgagcagcgtggggagctggccctcaaggatggcaggaacaagctggncgagctggaggagtgcctgcagaaggccaagcaggacatgtgccggctgctgcgtgagtaccaggagctca

SEQ ID NO: 4783 - DNA, 378 bp, Homo sapiens
ggtgaacaacttctcgaactgcttcgggggtaacctggcgtgcaccgtacaccatgaagagatactccatgtgcctgacacccaaaggtggggtccggacatcataccagccctcgtctcctggccgcttcaccaaggagaccacccagaagaatttcaacaatctctatagcaccaaagtctcactaccggccattctaggtcaacaaaggccacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgcca

SEQ ID NO: 4784 - DNA, 482 bp, Homo sapiens
gagtccacacagcgccacaaaccagatggaactgaagtcactgacagaattgtcactgaaacagtaaccacgagacttacatccttaccaccaaaaggcgggaccagcaatggctacgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaagggagctccagtggcaactcttctccggagtaccctcggaaggaatttgcatattaaggggactatcagccacattaacttgctgtcataagcctttgctcgtggcactatagaaatgcatcttcttcaaccagaggacggagtcaaacacgaga

SEQ ID NO: 4785 - DNA, 340 bp, Homo sapiens
gtcgctgtaagatcccgttttgggctgtcgtgctggtagacctgcgtcgtgtgattcatgattgcggaaacgcgtctccatcctctctctccttgcgttcatgattggaggcagcttgtcttgttcagtgatgtctccccatttcctagaagagggggtggcatatgccccctgtggtcacctggcttccccttgtagtgatgctgtcctggctgtggaatgggagtgtgatgaagctaccaaaaaggcctgtttacagcgacggcaaatcaaaggaggaatgtcagaactacatccgggtgcttctggtgggtggcgatcggtaattcacctgtgtgag

SEQ ID NO: 4786 - DNA, 950 bp, Homo sapiens
agcgggctcacccctggcggcgcgctgcctggcagcccgggaagccgcggcacagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagcccagcttcagccccggctcaggtcgcttcagcccgggagcctccccgcttgcgccccaaggcacgcgcggacagccatgaacaccaacgatgccaaggagtatctggcccggagggaaatcctcagctttttgagagccttttgaatggactgatgtgttctaagcccgaagatccagtagaatacttggaacagctgttaccacaaagtacccggaactgggtggctgtgaccacggtgaacactggggatacatttgtacacgccaggaaagacgaagaccttaccctaccactagatggaggacagtcacggagatcctttctaagaaatgaaacgtgaccacggatctctctgagactgcagagttgatagaggagtatgagttttagatacctaccagacctcgaccaaacatcaattcctggttacatgggtgggtccaggaaggtggcacggggtacatcagagttttgacaattgcgaacggctatggctcccactacacttgctgtggacgactttaagaccgcagatccagtacccgggcatagcactggagatttatgcacggaaaataccggagattggccccggaacaactcggatcacatatgggcaacctgatacagctgcacggacccgaagggccgacccattggagaataccagatggaatcggggaccaaaaatatacgccgataaagagatacccggaa

SEQ ID NO: 4787 - DNA, 748 bp, Homo sapiens
agcggggtgagctgcatgatgtcttacatttcatgagcttcctctaaatctagttgtatttttcgtctgaggggggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaactatgaggaagaaatcaagattcttactgataaactcaaggaggcagagacccgtgctgagtttgctgagagatcggtagccaagctggaaaagacaattgatgacctggaagataacactgaaaatgcagcaaagaggagcagctctgtacacaaaggatgctggaccagaccctgttgaccttgaatgagatgttaaacggccccagtcccaccctggttggtgtcttcctctgaccaagactcggctgag

SEQ ID NO: 4788 - DNA, 973 bp, Homo sapiens
ggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgtttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagaacattaaaaagacatctcaaggatggagagctaataaaattaatactttctactgcatatggtgaagtgacagtaagtgaaactggcatttttaaactacaagcgaagaaggatgcaagaacagagagactgtaatatggttttactgtcactgccttgattgtgttgaggcaccagcgaggtttttcaccggttgcttggttaccatcattacaattgtcaacccagctggaacaaggtgtgaatattggtctgaaaaattaggtttggacctcatggacccccccctccaaaggggtctccagaacccacagggggatctacaggccagacttaagaacttgctgggcctggaccaaaaacggctttctcgctggtaacagaccttggacagtttggacctgcctgaagagacacgattggggccttcccctagggagaggcctcagaaccttgcgacgggaaagagttagaagtttcactggagcgcctcccgtggaaagagcccccaaggaccacaatgggggcctccaactttggccggcagagatagcgctgggacaaaaacacggcggg

SEQ ID NO: 4789 - DNA, 1077 bp, Homo sapiens
atgcagatgctgaacgctggacaaggagaacgccatcgagcgcgccgagcatggccgaagccgacaagaagcaagactgtggaccgttgcaatgcagctgtgaggatggagctatgcaggctcctccagaacgaagctgtaatggtgacagaggatgaggtggaaaagtattctgaagtccgtgaaggtaggcccaggagaatactggagcaggccgagaagaaggccactgatgctgaggcatgatgtggcctccctgtaaccgctgcattcagctggttgaggaggagctggacctgggtcccaggagcgcctggctacttagccctgcagaagctggaggaggccgagaaggcggctgagtgagagcgagagacggaatgacggtcatcgaataccgggccatgaaggctgaggagaagatggaactgctggagatgcagctgagggaggccaagcacatcgctgaggattcaagaccgcaaatatgaagaggtggccaggaagctggtgatcctggaaggagagctggagcgctcggaggagagggctgaggtggccgagagtccctgtgggacctagaggagggagtgaaaatggttaccaaaaatttgaaatccttggaggccaggcggacaagtattccacaaagaagattactttgaagaaggagatcaactgtggaggagaagtgaagaggctgagaacccgagcagagtttgccgagaaggtctgtgggcaagttggaaaaaccattgatgactaaaagaactgtggcatggccaggaggagacgttcagatttcccaactggggcagaaccgtggaatctacacttggggggcgaccccacccccagccccaggttgtggtgcgccccccccacaaaaagaggtgttatgctcttacaaaaaaaagagggggcggatagatgatacacagagggcaagtcgtaacacccctttataagagccccaacggaatacattagaacgcacacgatacgagactctcgtcatcaaacacggtgatgtgaatacaacacgcaactaatatcacagtgtgtgcgttcaaccga

SEQ ID NO: 4790 - DNA, 1012 bp, Homo sapiens
caagaacttgggggcagaaatgtgcaccaatgtctgacctgacagacctcaagagcttgccgtgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagtgaaggcatccctggggaaagtaggtgtgaaagaagagctcctagcagtcggcaagttcacacggacgtcaggggagaccacgcacacgcacagagagccagcaggagatggcaagagcatcagaacatttaaggagtctccaaagcagatcctggacccagcagcccgtgtaactggaatgaagaagtggccaagaacgcctaaggaagaggcccagtcactagaagacctggctggcttcaaaagagctcttccagacaccaggtccctctgaggaatcaatagactgatgagaataacttacaaaatagcctgcaaatctccaccagccagaatcagtggacactccaacaagcacaaagcgaggcctaagagaagtctcaaggaaagcagaatgtagaggaagaattcttagccactcaggaaactaaaaccatcaaggaaggcaatagcccatgcataaccacacaaacagcaggagatggttgacaaacgaccaatcaagcatttaggagagactcaaggagagacgaaccctgcaggaacattaacaggagaaaagacacatacgactcaaagcaaaacgcacggtctaaaacacggcggttaaagacatcagaactcagacacacgaatacggacgaggaaccaaaaccgcgactcacagccgaaaggacgccaaacaagatagacaaaagaacacaaacaatacgaagaagaactaatacaacaataacaaaagacagaaccagcaggcataaaacaagacgtaacaaaacaaaacaacaa

SEQ ID NO: 4791 - DNA, 851 bp, Homo sapiens
ggacgcgtgggtcgccacgcgtcgccacgcgtccgggaggcagtggcgttggtgggaagcgcagatcgaaaagcgatgccgatttctggtttcctggggctgcgggccacttacggtggacccagcgctgaggcggggcggcgaggcccaagaaataagaagcggggcatggcggcggttgctcaggagccgctggggctggaggttgaccagcttcctggaagacgtgcggctacaggagcgcacgagcggtggcttgttgtcagaggccccaaatgaaaaactcttcttcgtggacactggctccaaggataaaagggctgaccaagaagagacaccatagtccagaagatgtcactgcttcatacaagaaaacccttcgggattgaccctcatcctcgagaacacagtccataagtcccctgcccccaaagacgtcactcgacccacacaggtcacacaaagacaatgaagacctcaggcggaaggagcagcatatgggagaagctggccaagcagggatgagcttgccccggtgagagagcgcagggccaggcccaggatccatcaaccatatctgcaacaggggccagccacggggggccccaggaacacccgatagaggcgggcactttcatacgacatcgtgggacgtaaacaaacccccgtgtacagggccagttagatcgcccagaatgagttatacatggagcagaccctgaagaaaggacctgaagcgggcaaataacagctgcacacaagcaagtccaggagacgccgcggcagtagggcctgccgaaacatctagaatacaacttttatgggcgacaaacctgactagaggcaaacgg

SEQ ID NO: 4792 - DNA, 889 bp, Homo sapiens
tcaagaacatagcaaagaaagtccagctcgtagcacaccccacagaacccccattattactccaaatacaaaggccatccaagaaagattattcaagcaagatgtatccaatgactttgaaataaatatgaagtttacagctggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgtggatcttacacattatcatgtcttcagtaggaaatactaagttgttctggacaaggtcccctttttatcttcttggaaggtcatatttatttaaaaataaaatgtcaagtgaattccagtgttgaagaaagaggttttctaaccatattgaagatgttagtggtttggtgcctggcatcgaagatggtgtgttctttctggaaactgtatatcttatcggacttatccagatgatgagaaacgcaagaatccataggaaggataaatctggtaattgtaccagtcgtcagatagaacagcaacagagaatttgtgcaagacggaacacttttgaattaattactgtccgaccacaaaagagaagatttgacgggagaatcctgttagcaatggcgggacacactttggtgtttcccagaactgggtggtgggatatcaaagaaagcggggtccggaggaaaaatccacagtttgttgaaatggttgggacctgtgttgtggtaaaccatggaacttaaggggatacggataaagttgagtcttaaaacaaaacatatgggttagtataaaggt

SEQ ID NO: 4793 - DNA, 1131 bp, Homo sapiens
ggcagcctggcgcgcggcgcccgccaggcgcccagtcctctgccatcgcccacgcctccctggtgccagggaacaggtatcagcgcgcctccccagcggctgggagagacgctgaatgaagaagagggaaggacggttagtcagcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacatagtattctgggtttggactgtgctggaaagacaactgtcttatacaggctgcagttcactgacattcgtaaataccgtacctaccaaaggatttaacactgagacacacttacggtaaccttgggaaattctaacaacagtcacttttcacttctgggatgtaggtggtcaggcagcacacttaaggccactgtgcgaagtcatataccagcatgcccaagatggcattgtatctgtcgcggcactctgctgattgtcagacagggactggccacgaagccaacaactgaaccttcactcaaattaactcagggatctcacaacatcagggcagctcccttgtaccttatagttgctaaccaacaagatatgacggcactccttcgtcctttccgaactctggagaacatgggtcacgccactgggttgacgtgccgctccatacacttcttgagcactttcgcagcctacctgttgccatcctaggcaactggccctcaggacggactgcacacccttactggtaggacctacacgaagcacatgttcgggacacacaacaccaacacccatgatcctttcacccccataattatcgcagtcgagcaagtccatcggagtcgactagcaaacttcagactggtccccccactgtagctcgtcaacagcggtagagtaacacacctttcgtccgcatagagacaccgagcgcgctaaacccagccggactcgctaagcgacactcccccccagcgtttcaccagtgtcgccacctgtctcatcatcgtgactgacgaccctcgaaacagactccctcatatctcacatta

SEQ ID NO: 4794 - DNA, 277 bp, Homo sapiens
  misc_feature (31)..(31): n is a, c, g, or t
  misc_feature (35)..(35): n is a, c, g, or t
ccaaagatgtgcatactgcatgtcctcctgnatgnaccaaagtccacatttgtccaaggtcaagagttgggcagaagctctggtttctctttaagagataaatgcagagggaacaccagaggacgtttttcttcaactctgcacagctattgactctattattttctgaaggcaaaaatgcatgtttgttagaatggaaacagaaaaacattaaaaagttcattccttaaaaaaaacaaaataacactaaaagaaggaaactatgaaaacgctaacc

SEQ ID NO: 4795 - DNA, 811 bp, Homo sapiens
aatcctgtgaagcagctccagctatgtgtgaagaagaggacagcgcgtgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagagggctatgccttgccccatgccatcatgcgtctggatctggctggccgagatctcactgactacctcatgaagatcctgactgagcgtggctattccttcgttactactgctgagcgtgggattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacgggcctagcacccagcaccatgaagatcaagatcattgccccttcggagcgcaaatactctgtctggatcggtggctcctcctggcctctctgccaccttccagagatgtggatcgcaaacaggaatccatggagccggcct

SEQ ID NO: 4796 - DNA, 798 bp, Homo sapiens
  misc_feature (12)..(12): n is a, c, g, or t
  misc_feature (15)..(15): n is a, c, g, or t
  misc_feature (558)..(558): n is a, c, g, or t
atccgcttgtangcnttgataaaaaaaaacaaagtgagacaaaacttcgagaggaattgaataaagttcgaggtatcaaacactttgatccttcaaaggcttttcatcatgaaagtaaagaaaattttgccctggagaccccattaaaagaaggcaatacaaactgttaccgagctcctatggagtgtcaagaatcatggaagtaaacatctgagaaacctgttgaagatgattacattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattattcctcctgtcctgaaaccttagtttcaagagtcctaacccccagattttttcagcttgaaccttgnaggtccttttttaagctgagcttcctttaacctaggcctaaaccacctcggctttgttattgcgccttaacttggattctaaaaatgctaacttgggcccaaccaattatccttctacctgggcaagttaaaataagaaataagggacagccttacttaatagaaaccttcctatttttaaatcaattgtttaaaaatttacaagttctttaggctccctcctgtttggctgaaataata

SEQ ID NO: 4797 - DNA, 542 bp, Homo sapiens
agccagtaaaagataggacatgtctgagagtctttggagaaaatcaagattcagttagaaaaaggaaattaagaatttggtgaccaagctgaagcagcacaggatgccaccttgactacaactactttccaaaatgaagatggtaatcacatactgaacagaatatttataagaaaagaataaagaagtatatatgactccactcaggggtgtaaaagcaacccaagcatcaaagtctactcagctaaagactaacagaggacagagatttgtgaccgtttcagctaggacgaacaggaggtgtcagactgctgaagccgactctgaaagtgatcatgaagttccagaaccaggatcagaaatgaagatgagactaccaagacaagccaaaaccgcagcactagaaaaaagtaaacttaaccttgcccaatttctcaatgaagatctaagttaggaaagacgatggaggtggaatcctttaagattatgcccagttatttgctttaataaagaaggagttacccttgtcaaaaaaaaaaaaa

SEQ ID NO: 4798 - DNA, 873 bp, Homo sapiens
tcgacccacgcgtccgagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcaatgggagccaattcacaattcactaagtgactaaagtaagttaaacttgtgtagactaagcatgtaatttttaagttttattttaatgaattaaaatatttgttaaccaacaaaaaaaaaaaaaaaaaaaaaaaaaaaaaaaaaaaaagaagcaagaaagagcaacacaaaagcaatccacaaaggaaggaggcaccgcaggtgcggagccagagtaccccagctagtgcggaggcaacaccagggggccccatagcgcgagcattcatctgctacagagggatctgaggccacgtagcgggcgccagcttctccaccacgcatagacggccagcggaacacgaacgggcaacaccacgaggagatcacgacagaaagagagaccccctcagccaagcgtgcacccctgcgcgacagagagcggggcacaaacctccaggcagccgcgaaaccaccaacgcgcctacgaggcgcccactagcccaacacgttcaaacgcgcccacggcgagaaaaagcagtgcggacaacgagcaggatggcggacacgctgagcgcaacgggcatgcacacgagacatgaggaccaacggcacgaggaagcacgaaaccagaagacagcctagaggtg

SEQ ID NO: 4799 - DNA, 789 bp, Homo sapiens
gcacggtcctctgaaggccggcgggctcggagatgaagttgggatctcggaggatgggctgaggctgaggtggcctccttgaaccgtaggatccagctggttgaagaagagctgaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccacctgtgctgtcctccctctgacccagactccgctgaggccagctgcgggaagctgactttaatgagggtgatctttaactggaagtggtttctctttcacacccctcctcctgtgtttttcgcaatgtttgctcttccgggatcg

SEQ ID NO: 4800 - DNA, 448 bp, Homo sapiens
  misc_feature (323)..(324): n is a, c, g, or t
  misc_feature (370)..(371): n is a, c, g, or t
gcgctccgtcctcctcgcctgccagcggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaacgtattccctgaatcccgtgcaacggcaggcccccaggagcannaactgggagcccaggcccggagcacacgacagggccaactggaatnngctgacggcagatgtggcctccctgaaccgccgcattcagctggttgaggaggagctggaccgggcccaggagcgcc

SEQ ID NO: 4801 - DNA, 764 bp, Homo sapiens
gccggatcctgcggagtactgtgatggttcgtgtggaggtggatggatggcacttgatgagttcttagtgaaaaatgatccttgcagggccaaaggaaggacaaacatggaactgcgtgagaagttcattttagcagatggtgccagccagggtatggctgctttccgaccccgaggccgaagatcccggccatcatcacgaggcgcttcacccaacagatccacttctgtgtccagtcaggctgcgcaggcggcctccccacaggtccctgccaccaccacacccaagggaacgccaatacaaggaagcaagcttcgacttccaggatatttatcagggaaaggcttccactctggggaggacagtggcttgataacaactgcagctgccagagtccgaacacagtttgctgattccaagaagactcccagccgaccaggaagtcgagctggaagcaaagctggcagcagggccagcagccgccgaggcagtgatgcatcagactttgacatttcagaaatccagtccgtgtgctcagatgtggaaactgtcccccagacacacagacctacaccccgagcaggttctcggcatccacagcgaagccttcaaaaatccccacgcccagaggaaatcacctgccagcaaattggacaagtcctcaaagagatagtgcacttggttctaccaagggccttccttgagcatatattatttaaggtttgaacgactgtagaatatgggtggagaaattcttgggaaa

SEQ ID NO: 4802 - DNA, 812 bp, Homo sapiens
gggagacgcacgcagctgactttgtcttctccgcacgactgttacagaggtctccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgtttggaagattattctgtgaccgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtatctggattctgctagatttcgcttaccttatggctgaacaacttggcattcatcccagcagctgccatggatgggattttgggggaacatggcgactcaagtgtgggctgtgtggagtggttgtgaatgtggcaggtgtttctcttcagggaattgaatcacgaaatgggaactggccatgatgtgaaattggacggagtgctaaaaggggggaaaggcctataagcttcagctaaaggttacacgggctttggtaatggggggcttttgaaccgtgtgaattcggagttccgtcaggaggggttgtaaaaacgacgtc

SEQ ID NO: 4803 - DNA, 777 bp, Homo sapiens
ggtgagagaggtatgaaggttatcgaaaaccgggccttataagatgaagaaaagatggaactccaggtaaatccaactcaatagaagctaagcacgattgcagaagaggcagatagggaagtatgaagaggtggctcgtaagtgggtgatcattgaaggagacttggaacgcacagaggaacgagctgagctggcagatgctcccgtatgccgagagatggatgagcatggattagactgatggactcagacaccctgacagttgtctagaagttgctgctgtacactaaacagtattctcttacagaaacacgaagataagatatgaggagagaaatgcacgagttcttactgattcatactccgatggcggcagagacccgtggctgcgtttgctgagagatcggtaaccaactgctggaaaagacaatagatgagcctggaagatgagctctatgcccaggaaactgaaggtacaaggccattagcgaggagctggaccacgccctcaatgacatgacctctatatacaactgaaatgcaccaaagaggagcacctctgtacacacaaggatgctgtgaccagaccctgcttgaccctgaatgagatgtagacacgccccaagtcccaccctgtctgctggtcctccctctgagccagactccgcctgaggccagactgcgcgaagctgagcttcaaactgaggggctgatctttaactggaaggctgcttgctcctttcacaccccctccttccctgcgtcttcgccgcaaca

SEQ ID NO: 4804 - DNA, 747 bp, Homo sapiens
gactctgctcccactctcgccatgtgatatgcctgctccccttcttcttctgccgtgattgtgagcttcctgaggcctcattagaggcagatgttctgtatggcctgctgaactgaggtctattataagaactccctgcccatccttttaacaagaggcttagaaagagacatgccaaaaccacctccaaaaaccaaggaacatggatggagctggaggctatcatgcttgttgactcacaagcacattacttttctgggaagaaacttttaagtggagaaaccttctactcctccacaatgaaaagaagctgtccagtaaacgaaatccctcctgcttcatgtccacttagcatggcagataattcgtactctacactctcctgtggaacagagagccttacagcttactgttgtatcatcacagttctatgatggcaatgtataaaaattaagattgaggcatgatattttaatgtcttttttattttcagtcacattaatttatcagggttaattagtgcctggtatcacatattttttttttcgggggatgggtcccttattcaatttttaaagattagaccatcttaaaatatttttagtgtcgactgtgacaattgtgtcttgtggctttcaaaacaaattatggtgtgtttcaagttttgatgaccctagcttttatggcgggtatatatctacctcctttggcctttaatttgctaaatagctcatactgtatctcata

SEQ ID NO: 4805 - DNA, 761 bp, Homo sapiens
gagtgtgaaatcttcagagaagaatttctctttagttctttgcaagaaggtagagatagagacactttttcaaaaatggtcaatggtatcagaattcctcaagcaggcctggtttattgaaaatgaagagcaggaatatgttcaatactgtgaagtcatccaaaggtggtcccggagtcagcggtgagcccctatgctatgcttcaatccatcctcggcatgtcgctgccttgcattaaggcctataatggttaacacggtgtggatgaagcgaaccatcattgtactattctaactaagcgaaacaatgcgcagcgtcagcagatcaaagcagcatatctccaggagacaggaaagcccctggtatgaaactactgaagaatagtcccattacaggtcagccttgaggaggtagttttggctactgtctgaaaacactctcgagcgcaattggatgtctgatgaacttcgtcgtctgccatgtaagggccttggaatctgactgaatgatactctagatcgagggatttttggcactcaaagaaactaacccaagaacagcagcagacattaaacaggggctacagacgaggacactgaacgcagagatctggccaaaggacataacctcagatgccagtctggagatgtttcggaacgctttgtttctcttgcttagggtgaccgatctgggacctggtgtgaatgaggaattgggtgatccgattccctggcctgttttatgcggcgccacgacgaag

SEQ ID NO: 4806 - DNA, 1010 bp, Homo sapiens
ggcgggccgggcgtcatgggcggcctcttctggcgctccgcgctgcgggggctgcgctgcgtgccgcgggccccgggcccgagcctgctagtgcgccacggctcgggagggccctcctggacccgggagcggaccctggtggcggtgaagcccgatggcagtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgcacctcatccgctacatgagctctgggcctgtggatggccatggtctgggaagggtacaatgtcgtccgaggcctcgagggccatgattggacaccaccgactcggcttgaggcatgccccaggaaccataaggggtgacttcagcgtccacatcagcaggaatgtcatccacgccagcgactccgtggaagggggcccagcgggagatccagctgtggttccagagcagtgagctggtgagctgggcagacggggggccagacacagcagatccacccaggctgaggctcaagctgcccttacaacccatcccccagcatggaccaatacctccgtcagcaagaacccaagcccaatccaaaactgacttgtcacaaacattacttcctgttaacctctgccccaacccagccagaggagtttgaggccacaaagttcagttgcttactgtaccccaagcaagacaaagatggacacaatcatttttgaaacaagaggtgacggaacacacctttatggtggtgggagggggagactaaccaaaaatgattaccacctccgattaacaggagaggcataacaatatcgctggtgcccagacactgggtgggtacacgtaattatgattacccccagagatgaggtaagaagttacgcgcttatgaaagtgaaacgcggttaccaggacgaggacgattggcagcaaa

SEQ ID NO: 4807 - DNA, 936 bp, Homo sapiens
gactcgcggcattggagtcaagatggaggagtacgcgctgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtagctttgcagtttggggagggctgttttccatgattgactgtagtatggttcaagtcacgaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatggtcctcagtttgcagaagacccctcccagttgccttcaactcagttaccttcctcacctttggagactatcgacaatatcagtaggacttctttcctaggatttctttaacagaacgagttgtggttcgagaaggatctcagaagatcaagtaacaggctgtctgcaaaaagcatagcgtgggacagctaatggcaataggcctataaagcagacatttagcacttttttctattctcacaggaacagcggcggacgggtgctaccacgatatccgtctatccattcccactgaaattggccttggtgaccacacactcatgtttaactccgctgaaggacaatccaggaagggctgaacagatgaaggaccagagggccaaacaccggtgacacactactcatcattcgtggcggacactctgacggatcgggtgtcggtacataaagcacgacaagcgtgttgcaactaacaggtgcgac

SEQ ID NO: 4808 - DNA, 833 bp, Homo sapiens
gccttgtccagtgaaacaccctcggccgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaacaagaatagaactttctcattcatctttgaataacgtctccttgtttaccctggtattctagaatgtaaatttacataaatgtgttgttccaattagctttgttgaacaggcatttaattaaaaaatttaggtttaaatttagatgttcaaaagtagttgtgaaatttgagaatttgtaagactaatttatggtaacttagcttagtattcaatataatgcatggttggtttcttttaccaaatttaagtgtctagttcttgctaacatcaagtcatgcattgtgttctaataaccaaggtatggtgtattcgaggacttgcttagatggtcggtattgctggcattctaatgggggtgatcatgggactggtgccctatggtcactccttctagtggcttaaaaaggaggagtacaatcttgctttttacaaa

SEQ ID NO: 4809 - DNA, 879 bp, Homo sapiens
gcttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttaagtattcaagtataatgcattggttggttgcttttaccaaattaagtggctaagttcttgctaaaatcaagtcattgcattgtgtctaattaccagtatgttggcatctgagattttgctctagaattggtgctactggctggcaatttgtcaatggcggttcggactattggcaatcgctgccctattggtcgactcccttctaactggcttacaaaagcagagtaaattttggcacattaaaacttcccactcacttaagctgtattatatacct

SEQ ID NO: 4810 - DNA, 835 bp, Homo sapiens
ggagttgcttggagctcctggggcctaacaaaaagaaacctgccatgctgctcttcctcctctctgcactggtcctgctcacacagcccctgggctacctggaagcaggaatgaagacctactcccacagaacaatgcccagtgcttgcaccctggtcatgtgtagctcagtggagagtggcctgcctggtcgcgatggacgggatgggagagagggccctcggggcgagaagggggacccaggttgccaggagctgcagggcaagcagggatgcctggacaagctggcccagttgggcccaaaggggacaatggctctgttggagaacctggaccaaagggagacactgggccaagtggacctccaggacctcccggtgtgcctggtccagctggaagcagacaggtccctggggaaggcaggggaaccatagggacctcaggcgcaagcccaggcccaaacaggagaaggcttgggcccaaaaggacgaacgtaggtgccgcgaggccctgcaggcgctcggccagggggcaagaaggcctcgcaaggccctaatgggacgagcgaggatgtccctgggtgagcgtgggagtccctgggaaacacaggcgcagcagggtctgcttggagccatgggtacccagggaagtccaggtgccaaggggaaccccgggatcgcacggtggacaaaggcattcctgggaggacaacggcgcaaaggggacgaacgcgggctccagatgtcgctctctgaggcaccagtgagcgctacagggacagtacagcactcaggctgctcatctcacataccaagtgaatcttccaatggcaacg

SEQ ID NO: 4811 - DNA, 862 bp, Homo sapiens
gagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaaggtaagccactcacactcctccaaaaggcagtcagagctccttcagctttgccccccaaacttctccttcataaaacgctgggtaaatattttgtcaaaaacatcaaatttaactcacactgcacatttattatagaaaaaaacacatttattggagaggggccgtgactctgtcaaaacctcagagagtccattaaggattgcttatggggtaatgcattgcgaattagatctggtttcccactggtactgattagggttccctgggggcactatgcttacccaggaactaagggaaagaatactctctgctcatggggaccaaatctgctaattttttctttccatgcccgatcttggaatgttgagaacc

SEQ ID NO: 4812 - DNA, 770 bp, Homo sapiens
gctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccatccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcattaatcttaagaaggaagggccttaaccaggttccggcaggaaatgggccggatgaggatggcagaaggcagtcgtggcacaaggcacttcagcagctgtgacgaagtacgtgccaagatcatccgtgtacattgcccacaacccagatgcgcctgcttcctctgcgccacaacgagggcccagctgactggacgatccaggtgaaccggaggcactgtggccgagaagctgcactgggccagcgagaggcttgaagcagcaggtacctgtggaaccaagctgtcgggcaggatcacatgatcgacgctcatcgcgggtgaccaaggggcacacgcgctacacaggggtcaccagtccgtaggcacaccaggagc

SEQ ID NO: 4813 - DNA, 801 bp, Homo sapiens
agggacccgcagctcagctacagcacagatcaggtgaggagcacaccaaggagtgatttttaaaacttactctgttttctctttcccaacaagattatcatttcctttaaaaaaaatagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgtctgggctgcagaagcgatcagcgatgccagagagaatatccagagattctttggccatggtgcggaggactcgctggctgatcaggctgccaatgaatggggcaggagtggcaaagaccccaatcacttccgacctgctggcctgcctgagaaatactgagcttcctcttcactctgctctcaggagatctggctgtgaggccctcagggcagggatacaaagcggggagagggtacaccaatgggtatctaattaaatactttaagaggtggcaatttgcgaaaaaaaaaaacaaaacaaaaacaacttttttgggcccccttggccccttaaaaagttttttgaaccacttcctttgggccccgggccccattggtatggcagactggcccaagtgttcccaagag

SEQ ID NO: 4814 - DNA, 881 bp, Homo sapiens
gaggggcggaggcggaggcagaggtggaggcgctttgaaaggactctgaaaaggaatcttgcccaagcagtgatgaagttgatgaggaggaagaagaggataattatgaatctgatgaagatggagatgattatattatcgatgactttgtagtgcaagatgaggagggtgatgaagagaataaaaaccaacaaggagaaaaattgactacatcacaactgaaattagtaaaacggaattctctttattcttttagtgaccactatactcattttgaaagagttgtgaaggctcttctgatcaacgctttagatgaatcttttctgggaacattatatgatggcacaaggcaaaaatcatatgcaaaagatatgctaacatctcttcattatttggataaccgctttgttcagcctcgtctagagagcttggtatctagaagtcgttggaaagagcaatataaggagcgagtagaaaattattctaatgtaagtattcatttgaagaatcctgaaaactgttcctgccaggcttgtggactgcatcgctactgtaaatattcagtgcatttatcaggagagttgtataacaccaggaccatgcaaatagataatttcatgtcacatgataaacaggtgtccactggttggcagaatttgtgccagccgtaccagaaattaatcataaactgaaaccattcttacaattccaaactattaccaggaattgttgcaccatgggcattgaccgaagacagttgaagatgaacaagttaaaagaagccgtggcacacgaatttccaggcgtcaacagaacactggtggatcaggacaactactggccacttgaagaattctcatttgccggattaattcagacga

SEQ ID NO: 4815 - DNA, 816 bp, Homo sapiens
gagggacccgcagctcagctacagcacagatcaggtgaggagcacaccaaggagtgatttttaaaacttactctgttttctctttcccaacaagattatcatttcctttaaaaaaaaatagttatcctggggcatacagccataccattctgaaggtgtcttatctcctctgatctagagagcaccatgaagcttctcacgggcctggttttctgctccttggtcctgggtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggcctgcctgagaaatactgagcttcctcttcactctgctctcaggagacctggctatgaggccctcggggcagggatacaaagttagtgaggtctatgtccagagaagctgagatatggcatatcagtagcgcattctaagtaaaatggcttaagaaggtcacaaaaagaagacaaagaagacaaaaagatgtgtgtgggcaggcatgagggccgtgaaaaaggtgtttgacaaacagtccgataggggcacggggcacccgacggatagggaaaagtggt

SEQ ID NO: 4816 - DNA, 418 bp, Homo sapiens
gagggacccgcagctcagctacagcacagatcagcaccatgaagcttctcacgggcctggttttctgctccttggtcctgagtgtcagcagccgaagcttcttttcgttccttgggcgaggcttttgatggggctcgggacatgtggagagcctaccctgacatgagagaagccaattacatcggctcagacaaatacttccatgctcgggggaactatgatgctgccaaaaggggacctgggggtgcctgggccgcagaagtgatcagcaatgccagagagaatatccagagactcacaggccatggtgcggaggactcgctggccgatcaggctgccaataaatggggcaggagtggcagagaccccaatcacttccgacctgctggctgcctgagaaatactgagcttcctctta

SEQ ID NO: 4817 - DNA, 802 bp, Homo sapiens
gttgtttctgtgccctggattgtggacacgttctgaattagactggcagctgggaagggagaattatttcttcccattcagaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggtgcgtgtgggtgggagagaaccagcagcctgcagctatgctctctaagcgtggagctcacttgagtagggtgacggtgtgtgcagtgccaatcatccctgtttccccaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggcggcatgggatgacctccgaaaaccaagcatgagatctctgaatga

SEQ ID NO: 4818 - DNA, 739 bp, Homo sapiens
cttctcttcactcagccaactgctcgctcgctcacctccctcctctgcaccatgactacctgcagccgccagttcacctcctccagctccatgaagggctcctgcggcatcgggggcggcatcgggggcggctatggcggtggcttcagcagcagcagcagcagctttggtagtggctttgggggaggatatggtggtggccttggtgctggcttgggtggtggctttggtggtggctttgctggtggtgatgggcttctggtgggcagtgagaaggtgaccatgcagaacctcaacgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgaattcccgaacaaggtatgagacagagttgaaactgggccttgattgtgcgagcgccgacttcaatgggctctgcgccagggtggctggaacagaaccgggaccctgggcacaaaagttggaactggaaaatggcaattgaggaactctgaaagcgagaactctggcataccgtgagagagaacacacaaagaggatataagtgccctgaaaggac

SEQ ID NO: 4819 - DNA, 908 bp, Homo sapiens
ttgaggacctgaggaacaagattctcacagccacagtggacaatgccaatgtccttctgcagattgacaatgcccgtctggccgcggatgacttccgcaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacagatcctgctggacgtgaagacgcggctgagcaggagatcgcaactaccgcggctgctggagggcgaaggacgcgcaaactcttccttcctcccagtttctccctttggatccgcagccattccagagaatgtgaacctcctccagccgcaaaatccgcaccaaggtcatggatttgcaccatggcaaggtggctgtccaccacgaacaaggtccttcc

SEQ ID NO: 4820 - DNA, 696 bp, Homo sapiens
tcaggctcctccggcctggggggcggctcgtcccgcacctcctgccggctgtctggcggcctgggtgccggctcctgcaggctgggatctgctggcggctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaaggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatctcaacgagatgcgtgaccagtatgagaagatggcagagaagaa

SEQ ID NO: 4821 - DNA, 788 bp, Homo sapiens
ctggccggcatggcgatgacctccgcaacaccaagaccatgagatctctgagatgaaccggatgatccagaggctgggagccgatgattgacaatgtcaagaaacagtgcgccatactctgcagaacgccacttgcggatgccgagcagcgtggggagctggccctcaaggatgccaggaacaagctgggcgagctggaggagggcctgagaacggcaagtcacgtgacatggcccggctgtgttgcgtggagtaccatgagctcatgaacaccaagctgtccctgggacgtggagatcggcagtttaccgcaagctgctggagggcgaggaatgcacgcaactcagtgtgagaagagaacttggaccagtcaagatctctgtagtcacaagcagtgtttcctctggatatggcagtggtggtggctatggcagtggcctcgtgtgggaggtcttgagccggcggcctcgggtggaagcgctctatgccggcagagttagctagctggaaatgctaacaactccattcagcaaggtagagcgagtgctgtcgcgccctaggatgatgggactcagtagtggggggctctgaccttttagttgcaaagcacgtggccgagcgagctggcggggataggcgctatgtgcaaggtgcgcgggagtagcatgggatccaggctgtcaaagattggtcctccaccaactccttcacgtcccggaaaggacgcttacacagaagccttaagaaaccctgtcttgcaaagttcactggcctttcccaaggtgcag

SEQ ID NO: 4822 - DNA, 744 bp, Homo sapiens
ctgctttctaataattgcctttagtgggaacagaagtctcctttcaagaagcttttaattcattttaagatttaattttatgttttctgaagaacaacaaaaaatatttctggaaaagactgctgagaagatttccctctttcagccagaagagcagagagaagattgtaaatcaaggaaaagatttcccccttcagatctaacgattacattagggctcctgcatctttttggaaggattctttttataaatcagaaagtgttcgaggttcaaaggtttgcctcggagcgtgtgaacattcctccgctcggttttcaactcgcctccaacctgcgccgcccggccagcatgtctccccgcccgtgaagcggggctgccgcctccctgccgctccggctgccactaacgacccgccctcgccgccacctggccctcctgatcgacgacacacgcacttgaaacttgttctcagggtgtgtggaatcaactttccggaagcaaccagcccaccagaggaggtcccgagcgcgagcggagacgatgcagcggagactggttcagcagtggagcgtcgcggtgttcctgctgagctacgcggtgccctcctgcgggcgctcggtggagggtctcagccgccgcctcaaaagagctgtgtctgaacatcagctcctccatgacaaggggaagtccatccaaagatttacggcgacgattcttccttcaccatctgatcgcagaaatcc

SEQ ID NO: 4823 - DNA, 802 bp, Homo sapiens
cttctgcgtcctgctgagctctgttctctccagcacctcccaacccactagtgcctggttctcttgctccaccaggaacaagccaccatgtctcgccagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggcgcctggactcagagctgagaaacatgcaggacctggttggaagacttcaagaaccagtaatgaggatgaaatcaaccaagcgtacccactgctgagaatgaagtttgtgatgctgaaagacggatgttgatgctgcta

SEQ ID NO: 4824 - DNA, 826 bp, Homo sapiens
gattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcacgattgagaacctcaaggtaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccaccttaccgccgcctgctggagggagaggatgcccaccttgacttcagtacaagaaagaaccggtgaccacccgtcaggtgcgtaccattgtggaagaggtccaggatggcaaggtcatctcctcccgcgagcaggtccaccagaacacac

SEQ ID NO: 4825 - DNA, 939 bp, Homo sapiens
cgcggatgacttccgcaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagataaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaaggtgggtgtcatttgaggtggaaggaacccagaccacctgccttctggggccttctggtgtgaatggcattctcttttttgcagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggcttggagcaggagatcgccacctaccgcgctgctggagggcgaggacgcccactctcctcctcccagttctcctctggatcgcagtcatccaagagatgtgacctcctccagccgcaaatccgcaccaaggtcatggatgtgcacgatggcaggtggtggtccacccacgagccggtctttcgacaagaatgaggtgcccagcccgtcaggcttaggggccc

SEQ ID NO: 4826 - DNA, 793 bp, Homo sapiens
cgcgtggtaccggcccggaattttgggatcgtttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggcttcggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgtaggatgagctgaccctggccaggactgacctggagatgcagatcgaaggcctgaaggcaggagctggcctacctgaggaagaaccacgaggaggaggatgcttgctctgagaggtcagaccggcggagatgtgaaccgtggagatggatgctgcacctggcgtggacctgagccgcatctgaatgagatg

SEQ ID NO: 4827 - DNA, 930 bp, Homo sapiens
  misc_feature (612)..(612): n is a, c, g, or t
gccggctgctgcgtgagtaccaggagctcatgaacaccaagctggccctggacgtggagatcgccacttaccgcaagctgctggagggcgaggaatgcaggtgagtagacagcatgaactcaagatggccttcagctgataaagcgaagctgctctactgtggggtgtacaacacacatacatgagatcagtgacttgtgcgtgataatgacacatcatcaacactatttcagtctgactcatggccatatagctgacctcaactcacttttctggtctcttttcccccaccggtgttcctgggcactggctgtcctccaagcacctgagcaactcagcaatcttcttgacacttgtgccttttctgcttttgctcacgtcctttgctcaacctcaatatccatgtcatgcccacctccatccacccttgtcctccagtaccccttccttcaggaaggctttcatgtttactccagctgagttaaactcagctacctttggattgtcaaactactgtttgcttcaacctctgacattgcccattgcctactttctgttggaggaatttctgtccgtgccaagttctctcacagaatgtaactcctacaaggncaaaaactgctttcgaccataatcaccattttccaaatctcttatactttccccatagtgggtggacgaagactgtgaattataattctttccctaacaactgttacctaagggtcgatccctcttcattgcgacaactccctactgagagaacgtcctcccctttcctttaactttaagcagctttagaggtgtacaagactcccggacttaatggaatgcacttcgaattcatgcaggatggcaggtacgccacattagaactaatgccgcactatacgggaagccgtgtacccccttcacttcagcatattcccc

SEQ ID NO: 4828 - DNA, 925 bp, Homo sapiens
gcatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttctttgtttggtaaatgtttcttttaaagaccctcctattctataaaactctgcatgtagaggcttgtttacctttctctctctaaggtttacaataggagtggtgatttgaaaacatataaaattatgagattggttttcctgtggcataaattgcatcactgtatcattttcttttttaaccggtaagagtttcagttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaaactttgggaaaacatgttaatgacaatattccagatctttccagaaaatataacacatttttttgcatgcattgcaaatgagctctgaaatcttcccatgcattctggtccaggctgtccatttgcacatcaagccttcccattgtttaatttttaccagtgccaacaagggccagcgtggctcctacacaaggttaattggtgtggggattggccctctgcacaaagtggtgtctatattctggtgtgcaaattggcttactttggatctccgatccaatttcttttccttccttgggattaagctcggaattcccaaagaaccacacttgccaaacccttttttaaacgcatatggatttgccatgaacataccattttatgtaagacttcccacattccaattagaac

SEQ ID NO: 4829 - DNA, 795 bp, Homo sapiens
  misc_feature (117)..(117): n is a, c, g, or t
agcggaatcgcagctccgggcattgggggaacccgagccggctgcgccgggggaatccgtgcgggcgccttccgtcccggtcccatcctcgccgcgctccagcacctctgaagtttngcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgcatacccataaatgagactattccaaacataaactctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaagcaaatcagagaaaatgcagaagtctccatggacgtttccctggcttaccgtgatgacgcgtttgctgagtggactgaaatggccatgaaagagtaccacggaaactcaaatggagcttcacatctcccaagaattcagagcatgagggcgtactatgaatg

SEQ ID NO: 4830 - DNA, 774 bp, Homo sapiens
agcggagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatccatgcccctcaatacttctattgttatgcctccaaaaaatctggtagagctctttggcaaactggcgagtggcagatatctgcctcagacttatgtggttcgagaagacctagttgctgtggaggaaacttcgtgatgttagtaaccttggcatctttatttaccaactttgcaataacagaaagtcgttcccgccttcgtcgcagagacctcttgctgggttcaacaaacgtgccattgataaactgctggaagattagacacttccccaacgaattattcgttgagacaagatctg

SEQ ID NO: 4831 - DNA, 678 bp, Homo sapiens
agcggagactaaggccagcggtgatggcttgaatgccaggctgggggctgggatttttcctgaggatttcacaggacagaggttggcttggaaagaccaaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaaggaggaatgtaaatatgatataccccatttccaaaagagaaaccctctatggctacaaaattaaacattcatttgctggttgtgcgttcaaaattctctggcagatttttccccaaagtaccacctgtctgagtgcctcttggtctaacatcatgcatgaagaacaacaggttcattcccattctgacctgatgaagaaag

SEQ ID NO: 4832 - DNA, 632 bp, Homo sapiens
agcggagcagaattcaactccagtagacttgactactgcctctgggcaaagaagcagagctaacgaggcacagggatttaaacgagtttttcttgggtgtttgtcaaacttttattccctgtctgtgtgcagaggggattcaacttcaatttttctgcagatggctctgtggtccagaccccttacttaaagatctggaacagcatgacgactagggctattattatcctatgtctcttgaggaactgcagctgcaatcccgacaaatgcaagattattatctgatcattccaaaccaactgcgtgaaaacggtagcacccgacaaacactggcaatccccagatttaagggctgaagctgcaagaacacatgaaaacgaaacagcagtatccacagaagacgattcccaccataaggctgacacacaatcatcagatactaaagtcacaagaggacagcccatgaacagtcaggcacgacaccgggcaaggaagtcactagacacacgcagcctgcggaatcgaaaggacccaaagcaggacccgaggatagtcacattaagccgtgcacttcaggcagaatgcacccaacgtgcaaggtacataggacactacacgaaagatatgagtga

SEQ ID NO: 4833 - DNA, 693 bp, Homo sapiens
caccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagcctaacggcagtggtcaagtagtagggaaagtgcctggccatttcactcctgtcttggcaccctctccccatcccagtgcagtgcgacctgtgaccctgagcatgacagatactaaacccatcactacatccactgaagcctacacagcctcaggcacatctcaagccaatcgatatgtgggactaagcccaagagacccatccttcctacatcagcaacagctgaggatttgtgactggaccatgaatcaaaacggcaggcatttataccccagtaccagtgaggatacattgggaattacttggcaaagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaat

SEQ ID NO: 4834 - DNA, 688 bp, Homo sapiens
gcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggacggagtctcgctctatcgcccaggctggagtaggcgcgatctcagctcaccgcaacctccgcctcccaggctcaagcgattctcctgcctcagctccttagtagctgggattacaggcgggcgccaccacgctcggctatttttcttttcttttcttttttcttttttttttgagacggagtctttctctgtagtccaggctggagtgcaatggcacgatctcggctcactgcaacctctgcctcctgggttcaagtgattctcctgcttcagcctcccaagtagctgggattacaggcatgcaccaccacgtccggctaattttggtatttttagtagagacagggtttggccatgttacaggccaggctggtcttgaactcctgaccttaggtgatccacccgccccggccccctaaggtgctaagattacaggtgtgagccaccagacccagcctaaattcgtattttagtag

SEQ ID NO: 4835 - DNA, 875 bp, Homo sapiens
ggcagcaaggagaccaggaaggggtgagacaaggaagagcccctaggatgtctgagctggagaaggccatggtggccctcatcgacgttttccaccaatattctggaagggagggagacaagcacaagctgaagaaatccgaactcaaggagctcatcaacaatgagctttcccatttcttagagagatggagtctccctatgttgcccaggctggtctcaaacttcctgtgctcaagttatcctcctgccttagcttcccaaagtgctgggattacaggaaatcaaagagcaggaggttgtggacaaagtcatggaaacactggacaatgatggagacggcgaatgtgacttccaggaattcatggcctttgttgccatggttactactgcctgccacgagttcttttggaaccattgaagttgaacaataaagaaacgcagccaaacctttccgtgtacacagagacgggtcatgcaaagaaagcagacagcaagggcttgcagcctagtaggagctgagctttccagccgtgttgtagctaattaggaagcttgcatttgctttgtgcattgaaacaattgaaaacctctttccaaaggctgttttaacggcctgcaatcattctttctgctatattaggcctgtgtgtaagctgactggccccagggactcttgtaaacagtaacttaggagtcaggtctcagtgatcaagcgtgcaccgtgcagcccgccatggccgaggtaaaccctaacccggaggggaacccctgactacagaaattacccaggggcacccttaagaacttccaactacctttacaacaacagagccttatccagcatcatctgaaaacactgctgtacttaaatgc

SEQ ID NO: 4836 - DNA, 615 bp, Homo sapiens
ggcggtccgagctgtggcttgaaagaccgacgcgatgaagcccagacctgcagggttcgtggataataaactcaagcagcgagtcatccagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgatcagcaaatcacatgaacagttccctgctgtctttatatcggaaaggaaatcctgattctgtttcaaatactcctgagatggagcaaagagaaaccacctcttcaacaccacgaataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggggagtgatatgaaacggaaaggcaagctacagaatacaggaagcaaaaaaaaaaacaaaatataaaaaacact

SEQ ID NO: 4837 - DNA, 727 bp, Homo sapiens
  misc_feature (580)..(580): n is a, c, g, or t
agcggggggcgcgggctcggccggggcaccggtgagtcgccggcgctgcagagggaggcggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacatagctgcttgtctcctactatacctgtctgacacaatatcaccagagcaagccatagacagcctgcgagacctanagaggatcccggggcaatacagaccatcaagcaatacaattatcttcatgaagtttcgggacaaattagctgcacatctatcatcaagagattcacaatcaagatctgtatcaagatcaaggaattcaaatagcatatatatgacca

SEQ ID NO: 4838 - DNA, 728 bp, Homo sapiens
gattttcgagtgaaggacccggagccgaaacaccggtaggagcggggaggtgggtactacacaaccgtctccagccttggtctgagtggactgtcctgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagatcatacttctgtctatcacataagtggaaagaaaaagacatttaaggatgttggaaatcttcttcgaagccatggaattgacttggaccataatagatttttaattttacagggtgaaagttgaacaaattgctatgatgaaaccaaaagggcagaatggacacgatgaggggtatgcttgaatatttaga

SEQ ID NO: 4839 - DNA, 959 bp, Homo sapiens
ggagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacgcagctacaagacctggggcttgcatctcttcagctggaacccctcctatgcacggctggacaacgcaggcaacttcaaagcctgggttgcggggagctacggtaccgatcaggtggttgcagatcttcccttggcaactgggaacaccaatcccacagaagacttgtttgagaaggccatcctggtccgtatgtggcatctgcttgtgctggcacaccgattccctgggc

SEQ ID NO: 4840 - DNA, 259 bp, Homo sapiens
ttggacaagtcaacatctctgtggtgcagtccaccgtctccagtggctatggcggtcccagtggtgtcggcagtggcttaggcctggtggaggacttcaaagaacaaatatgaggatgaaatcaacaagcgcacagaagcagagaatgaatttgtgactctgaagaaggatgtggatgctgcctacatgaacaaggttgaactgcaagccaagggagacactctcacagacgagatcaacttcctgagagccttgtttg

SEQ ID NO: 4841 - DNA, 605 bp, Homo sapiens
gctgttcgcctgcagtaccggtccggaattcccgggtcgacccacgcgtccgggcggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacagaacctccaataccatgtggaatagaagtgatgggaagatagcttcgtcttattcctaatcttaggcaaaggccaggatggaattggtagcaaggcatagaagactctgggtgactttgcag

SEQ ID NO: 4842 - DNA, 658 bp, Homo sapiens
ccaagctctaatacgactcactatagggaaagctggtacgcctgcaggtaccggtccggaattcccgggtcgacccacgcgtccgcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacaggatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggca

SEQ ID NO: 4843 - DNA, 346 bp, Homo sapiens
ggaccgaactggagaatccgccccgggatgtggttcgtaggggtgtctgcgcccttctgctcgggttcaaactggtctcggattagtgtcccagaccctactcggtcacggactcacactttaggggatcattttcttcctccgtaaaagaattggagatgactagtttatttacaaatgttggagtaataaagaaggcagaacataatgagctgggctttggaagaatggaaagaagggctgcctacaagagctcttcagaaaattcaagagcttgaaggacagcttgacaaactgaagaaggaaaagcagcaaaggcagtttcagcttgacagtctcgaggctg

SEQ ID NO: 4844 - DNA, 442 bp, Homo sapiens
tagaggacaggaggagctggagattgagctgcagtcccagatcagcatgaaagctgggctggagaactcacttggcctgagacagagtagcgctatgccacgcacgtgcagagatccagtggctcattggtggcctggaggcccagctgagtgagctccgatgcgagatggaggctcagaaccaggagtacaagatgctgcttgacaataaagacacggctggagcaggcgatcgctacttaccgcagcctgctcgagggccaggatgccaggctggctgccattggcatcagggccgcctctccaggcaggtggtggtcgcagcagcacattccacatcaatgtacaagagtcagtggatggacaggtggtccctccccacacgacacccccctccctgtctcatcgccggagcaacgtcccttgcccactccccactctc

SEQ ID NO: 4845 - DNA, 772 bp, Homo sapiens
gcagccgccagttcacctcctccagctccatgaagggctcctgcggcatcgggggcggcatcgggggcggctccagccgcatctcctccgtcctggccggagggtcctgccgcgcccccagcacctacgggggcggcctgtctgtctcatcctcccgcttctcctctgggggagcctacgggctggggggcggctatggcggtggcttcagcagcagcagcagcagctttggtagtggctttgggggaggatatggtggtggccttggtactggcttgggtggtggctttggtggtggctttgctggtggtgatgggcttctggtgggcagtgagaaggtgaccatgcagaacctcaatgaccgcctggcctcctaactggacaaggtgcgtgctctggaggaggccaacgccgagactggaagtgaagatccgagactggtaaccagaggcagaggcctgctgagatcaaagactaacagtaccctacttcaagaccattgaggacctgaggaacaagattctcacagacacagtggacaaatggcaatgtacttactgcagattgacaatgaccgtctggccgcggatgacttacgaaacaagtatgagacagagttgagactgcgcatgagtggtggaaggcgaaatcaatggctaggcaggggtgctggacgaaatgacctggacagagttgacatggagatgcggatggagagctgaaggaggagctgggctaacttgaaaaagaaacagaggaggagatgaatgcc

SEQ ID NO: 4846 - DNA, 1004 bp, Homo sapiens
gccggggcggcgggttggtctacgctgtgcgcggcggacgtggaggcagcggggagcggagcggggccgcggggcctctccaggtccgcagcggcagcagttgggccccccgccccggccggcggaccgaagaacgcaggaagggggccggggtggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggcactgaggggaccccatatgctggaggtctgttaccgcatgaaactcctgctggggaaggacttccctgcctccccagccaagggcatacttcctgaccaagatcttccacccgaacgtgggcgccaatggcgagatctgcggtcaacgtgcctcacgagggactggacggctgagctgggcatccgacacgtactgctgaccatcaagtgccttgctgattccaccctaaccccgagtcttgcacttcaacgaaggaggcgggcctgcctgcatcttggcagaacctacagaggagtatgcggatcggggcccgatcttgtcacagaagatccacggggggcgccaggaggggccacacgggcaaggggccgcaagccgggtacgggcccttggcacagtggccacttgacagcttcctccaactgaaccattggggcccccaggggggcccgggaggggcttgaaggggtaccattggccccaacaaaagccattgcttggtgaagcggccgatcaggacagccttgacggaccacgcgacaaatggacggtccaagtaatcacgtggcaaccttccgcggctgtatcgtgggcctctctttccttcctttcccaccgtgtaaccccaacctctcctgttcccgctccccttcaagttatcactctagagtcatta

SEQ ID NO: 4847 - DNA, 634 bp, Homo sapiens
  misc_feature (14)..(14): n is a, c, g, or t
tcctaggattaacncccccccggggtatgggatatcgcgaaccacgccgtcgccaggtccactgacaaagggcaagcaccctgtaaatgagtttccctcctgactcttgctgggtggaggagataggcagaggtttagcccttaaaaagacatggctaggatatccagccctagtggcctgagaatacagcaagatgacggagctgtcactgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggaatttggtgcattgatgagcaattactctctccccccacccctgcccacctatcatgtcctgctggagggggagggcctgggacagtcactaggcaacttcaaggacgaactgctcaatgtatgcatgcgccacgttgcagaagatgtgcaaggcggaactgagccgtaacttcattgagaggaaccacatggagaacggtggtgacc

SEQ ID NO: 4848 - DNA, 1010 bp, Homo sapiens
gagagagccaaggtgctgcatgaggacaagcagacccgggagcaagctgcatagcatcagcgactctgtgttgtttctgcaggaattggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacggggattgggtccaacggaagcccatgagctcctggcggaaggaacgaggcgccacagccctgctcttcctcctgaccctgctgctcttgccttctaagctacttgtgctagtctcgggtggagaagggaagccttggttcctggaagcttggccctctggcaggcctcttgccagacctcttgggggcagtaccaggacctcttccgaatttccccacttgggcccacacctccatttcagacttcctatactggacttgttgacttcgaatggtcaccatcattcctggagagtcagaaggcaaccaatacagggggcaac

SEQ ID NO: 4849 - DNA, 899 bp, Homo sapiens
  misc_feature (899)..(899): n is a, c, g, or t
gaagaggccccaaaagaagtcccacttcttcctggtggagaggtgagggctgcaggcccaaccctatgagtgatgggggcaagtgagggacactagttccacgcccgcatgctgccaaatgtactcagcaccctgctaaggaggccggagaccccatcacggccatggcaatcccgaaggaggagctgtttcaaggtacgtgccctggaggaggccaatgctgacctggaggtgaagatccatgactggtaccagaagcagaccccaacagcccagaatgcgactacagccaatacttcaagaccattgaagagctccgggacaaggtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagcatgaaggagttcagcagccagctggccggccaggtcaatgtggagatggacgcaagcaccgggtgtggacctgacccgtgtgctggcagagatgagggagcagtacgaggccatggcggagaagaaccgcgggatgtcgaggcctggttcttcagcaagactgaggagctgaacaaagaggtggctccaacacagaactgatccaagaacagcaagacggagatcacaggacctgacgacgcacgaatgcagggagctggagatcgagctgcagtcccaggtcagcattgaaagcttggggtggagaactcactgggccgaacaagagtgccgtattgcacgcagttgcagaaatccagggtcattggtggcctggagccagtgagtaactccatgcaatggaggccagaan

SEQ ID NO: 4850 - DNA, 796 bp, Homo sapiens
agcggacttcgacgaccgcttctccgacgagcagctggtgaccatgtctgtgcgcgagctgaaccggcagctgcgcggggtcagcaaggaggaggtgatccggctgaagcagaagaggcggaccctgaaaaaccgcggctatgcccagtcctgccgcttcaagagggtgcagcagagacacgtcctggagtcggagaagaaccagctgctgcagcaagtcgaccacctcaagcaggagatctccaggctggtgcgcgagggggacgcgtacaaggagaaatacgagaagttggtgagcagcggcttccgagaaaacggctcgagcagcgacaacccgtcctctcccgagtttttcatagttcttcatgtgaaacgttgatcacctttgaagcctgcatcattcacatattttttcttcttcttccccttcagttcatgaactggtgttcattttctgtgtgtgtgtgtgtttattgtgttggattttgggttgtaatttgacttttagagcttgctgtgtggcccaccttttttccaacctccaccctcactccttctcaacccatctcttccgagatgaaagaaaaaaaaaggcaaagtttgcagagcgtctccgtgaagtctacatggtgagcattgagccttgcacagggaacaccacacatggtgaacacggttcataagaccttggcagcgttgccgaggatcccatcggagcttaatcttgtgaaccatgggtgaatgcgctacaaccttggaccaagcaaaagattccctctagtgaagcccttcccaa

SEQ ID NO: 4851 - DNA, 707 bp, Homo sapiens
agcggactaagctaaagcagaagcttggatgagtaagaaggccccactcatggttcacacctgctgctatgttacctggagcctcagtcaccttttctgtaaaatggggctgagaacaggagatgatcggatggcgttagatttggcaaatgcaggcattttaaaaatgagaactggaggaattgctatgatttacccaaagtttggatcgccatatgcaaacccaccacggacaccataaaccattccgatgcaaactctgctccttcaagtcctcctataacagccggctgaaaacacatatactcaaagctcatgctgactcatcatattcagagcccccagatgttcagcagcagttgaaccactatcagtcagctgccctggcaaggaacaacagccgtgtcagccctgtgcctctttctggggctgctgctggcactgagcagaaaactgaagccgtgcttcactgcgaattctgtgaattctcctccggctacatccagagcatcaggcgtcattaccgggacaagcatggtgggaagaagcttttcaagtgcaaagactgctccttttacacaggctttaaatctgcttttactatgcacgtggaagctgggcactcagcagttcccgaggagggcccaaagatcttcgctgtcctctctgcctctatcacaacaaatacaagcgcaacatgatggacc

SEQ ID NO: 4852 - DNA, 897 bp, Homo sapiens
agcggagccagccaccgccgcccccaacgtccatgcctgagtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaacacagtgaggaatgctctgaaggacttactgaaagatgaactcagagttcattggacaaggtagtgccccctttcacagagtatgatttcttccaatgtgaccagtactctactaatggccaatggtcctcagaccgcaaaatggtcacgaattgcgaacgcgtgtaccccagactttcaagcagacccacgactttgacgcgttggaaatggcaagcccctcctgggacgttcccagaagagcgcccaccctgcccaacctcggcgccgccc

SEQ ID NO: 4853 - DNA, 779 bp, Homo sapiens
agcggagaaacggggcccaatggcagcgcgtggcgagttcagtgctgctcgtggggcttctccatccaggtccctggagttcctggtccctggagctccgcacttggctggcgcaagcctgctgatgagtgcagtcgctgatctctggtctgactggccggtccttgtctcctataccgtggcttgagtgactatagaacctgttggtacacccattgtgcactacggctcctacggaccgtctgccattaagaaccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccacgacacgagttttgcaaaaacatttgttggcacaccttattacatgtctcctgaacaaatgaatcgcattgtctacaatgagaaatcaggatacc

SEQ ID NO: 4854 - DNA, 753 bp, Homo sapiens
agcggggggcgctaacgtctaacgctaacggcggtcgtgccccgccgctgctgtcacccccggcgctgctgccctccccgccgaggttctactgctctccttcttaagaagggtgggaggcactcggtctctccccacacctctcgctggggaggcgccaggtgtcgcctgaagccagacagccggtttgggagcgagcctgagttattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaatctcaagatagtgtgtgaggtcttatcatgtgaccataatggtgggtcgccccggatcccgttcagcaccttccagtttctctacacgtatattgcaaagtggatgggggagatctctgcatcacatgtcagcaggatgctaaactacatggaacaggaagtaattggccctgatggtataatcacagtgaatgatttacccaaaaacccaggttcagctggagtaaaaagccaattttggcatttacacgaagatc

SEQ ID NO: 4855 - DNA, 364 bp, Homo sapiens
agcttccaatctccctaagtgtcgttaccagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttttttttataaggtgtactaatcatacactgagcttggtcttcacggttctgcgcgatgtcccagtaagagatctgaaaccagccatagtgaaagtgtatgattactacgagacggatgagtttgcagttgctgagtgcaatgctccttgcagcagacatcttggaaatgcttgaagaccacaaggctgaaaa

SEQ ID NO: 4856 - DNA, 666 bp, Homo sapiens
agcgggttgttgctcagtcttcagaccgcggcacagcatcatctgcaccgggacccgggaatggggggacacttggagactgagagagaggaggctcgaggaatgaaccttgagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgtaatgcctgaaaactcaaactttccatatcggcggtatgaccggctccctccaatccatcaattctccatagaaagtgacacggatctctctgagactgcggagttgattgacggagtatgaggtttttgatcctaccagacctcgaccaaaaatcattcttgttataggtggtccaggaagtggacaagggtactcagagtttgaaaattgcagaacgatatggattccaatacatttctgtgggagaattattaacgaacagaagatccacagtacgagcagcaataggaaatggagtcttattgccaagataattacaactggagaattggccccacaggaaacaacaattacagagataaaac

SEQ ID NO: 4857 - DNA, 877 bp, Homo sapiens
agcgtggcggcccggcctggatgcgctgggcggagggtgcagtggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatgcccatatcttctctccaaatctatgcttcattcaggaccaagagtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatactataccaaaggaaaagctctttgtatcagaaaactggatttgttttcattccaaagtcttggaaaagacacaaagatctctattccagctttctcgagtaacgctaattaaagaaaaaccaaaaacgtgcgtcttcttagtgccaagcgccctggatcatagcaagaagtcacagacagggtacataatttggtcttcctttattctccagaggattcaactttacaaactacttaagaatctgtgtggtggacacttacagagact

SEQ ID NO: 4858 - DNA, 598 bp, Homo sapiens
  misc_feature (552)..(552): n is a, c, g, or t
agcggaggggtgggggtgggtgccattgggtgtggacagaaagctagtgaaacaagacgatgacaagttcactggccggtcgctataaacgagtgtgtgtcatctcgttattcttagtgtcagtgagtactgggtatgtgtcacattgccaaatcccggatcacaagtctccatgaactgctggtgagctaggataataaaacccctgacatcaccattccagaagcttcacaagactgcatatataaggggctggctgtagctgcagctgaaggagctgaccagccagctgacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtccctctaccttcggccaccctccttcctgcgggcacccagctggtttgacactggactctcagagatgcgcctggagtacaggacaggttctctagtcaancctggatgtgacagcacttctccacagaggaactcaaagttaagtg

SEQ ID NO: 4859 - DNA, 363 bp, Homo sapiens
  misc_feature (67)..(67): n is a, c, g, or t
  misc_feature (74)..(74): n is a, c, g, or t
agcggagcagcacggagcgggcgctcggttgctgcgcacaaaggctgaggctccaagagctgcaggngcggtgntttttggggacccccccaaagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccac

SEQ ID NO: 4860 - DNA, 704 bp, Homo sapiens
agcggatgggaaaggggagctgttggaattcacaatagactttctggttcccagtcagtcggcagtaatagaatgctttcaggaagatgacagaatcaggagaaagatgctgttttgcactatcttgatttgttacagcagccaagcttattggcatgatggagtgacaggaaaaacagctggcatggaagatgaacagagaagatgttcaaaagaaaacattcacaagaatgggtaaatgcacaatttctctaagtttgggaagcagcctagtgagaacctcttcagtgacctacaggatgggagcgcgcctcctagacctcctcgaaggcctgactagggcaaactactgccaaaagaaaaaggatccacaagagttcatgccctgaacgaatgtcaacaaggcactgcgggtttagcagaacaataatgtcggatcttagtgaatattggacgtactgacatcgctcgcattggaactcataaactgactctggagtttgattctcggaatatatatcctccactggcaggtcaaaacatgtcctgaaacaataatcatggctggattgccacaaaccaactagtgacaagattctcctgagctgggtccagaagaatcaactcgtacttatccacaggtaatgtaatccaacttcaccacaggctggtctgatggcctggcttagaatgctctagaccat

SEQ ID NO: 4861 - DNA, 608 bp, Homo sapiens
gcctggaggtgatgctggtgagaacagagtaatcacaactgagtggactaacgttgcagagagagacatctattaacaagtcaaacagatgcgtcaagagagatccctcacacgtggttggatgcagctgagagatggagaattccagtcaaggcaaggcctgggtagtatgtgtaggtggtggtcgttgaccctgaaatagatggaatcttggagggagaaagcgagtgtggaaatgtgaagtccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatatgctcttaacccagataaaaaaacgtgcacaaagatagactactgtgcctcatctaatcacggatgtcagcacgagtgtgttaacacagatgattcctattcctgccactgcctgcaaaggctttaccctgaatccagataaggaaaacct

SEQ ID NO: 4862 - DNA, 805 bp, Homo sapiens
agcgggaggacacagcaagaaggtgccatctaggaagcaggaagcaggcctgaccagacaccaaatctgctggggccttagtcttgaatttccagcctccataactgtgcaaaatccatttctgttgcttataagctacccagcttatgggattttgtttagcagcccaaatggactaagacagtggcataagtggaaataaactcaagctgatgcttcaaaaacgagaagcacctgttccaactaagactaaagtggccgttgatgagaataaagccaaagaattccttggcagcctgaagcgccagaagcggcagctgtgggaccggactcggcccgaggtgcagcagtggtaccagcagtttctctacatgggctttgacgaagcgaaatttgaagatgacatcacctattggcttaacagagatcgaaatggacatgaatactatggcgattactaccaacgtcactatgatgaagactctgcaattggtccccggagcccctacggctttaggcatggagccagcgtcaactacgatgactactaaccatgacttgccacacgctgtacaagaagcaaatagcgattctcttcatgtatctcctaatgccttacactacttggtttctgatttgctctatttcagcagatcttttctacctactttgtgtgatcaaaaagaagagtcaaaacaacacatgtaaatgccttttgatatttccatgggaatgcctctcatttaacaatagaaataaagcatttcgttaacacacgacaacaaaaaaaaaaatctccagggct

SEQ ID NO: 4863 - DNA, 1126 bp, Homo sapiens
agcggagggccagccaacattgatctaaaccttgggaaatacccctaaacatatctatgcctcagggttgaaaaacaatgaagtgttggacctgtttcagacttctcagattctcactggatgaacatggtttcatctccaggagttccacaggaaataccggatcccagctgatgtagaccctctcaccattacttcatccctgtcatctgatggggtcctcactgtgaatggaccaaggaaacaggtctctggccctgagcgcacattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacagaaaacaacaacaccgacccacacaagacacaacccacacgggtcacacagccaacagaaacagactctccacaaccgggaggaaacccccagacaaaaaagcgggccgaaacgcctaagcggagagacgcccgagacaccacacttattgtgccccactaagaagagcgagcaaccaaccgaccacacgcgcacaaccacagggacaaaccaggacccccgggtgcaacacatgacaccggggccaaactcgccccaaaatgtcgccgcacacagacaccaccccaacagcacaaccaaccgaaacaaccaccgacccacacacaaccacacaaccaaccaaccacccacacacccaacgccagccaccacacaagcaaacacccagcaccaacgaccccccccgccaccaccacgcacagcacacagcacacgccggacgaacggcgcgcggcgcgccgcagaccaggcccccacacaggggccaacgcccggcaccggctggccacgcaccagcaaacagggcgccacgcgcactcgccacacccgcacacaccgcaacgcacccacccacaccacgggccaaccacgacgcaccagggatggagcaccagcacgaaacacaagaccgcggacacgcgcacagcgccgacccgacacagccag

SEQ ID NO: 4864 - DNA, 771 bp, Homo sapiens
agcggacggggtctgtctgggggccgttgcggcttggcatccccggcctgtgctgccgccggccgcctctgggtctgtacgcgcgcatgcggcggctgcccgggcaggaggtgtctgggcggagcgtggctgcggccagcggaccgggcgcctggggcactgaccactactgcctggagctgctgcggaaacgggattatgaaggttatttatgctccctgctgctccctgcagaatcccgaagctctgtttttgcactgagggcctttaatgtggaactggctcaggctggttaaagactcagtctctgagaaaacaatttgactgatgcgaatgcagttttggaaaaaaactgtggaagatatatactgtgacaatccaccacatcagcctgtggccattgaactatggaagtgattgccaaaagagggtttctgtaacaggagccacccacagacctgacagtggtacacctcttctcaggtctgcacaccagcagaggcaggcccagtttctgggccccagattgacttcacagagccccagtaaagatggaaagccagaaacgccccaactgggggattgagaagaaaaagcggatgggaagctgctgttaaaaagacattaatctgactaaaagatgggttatgacaatcgtcgatgaaagagaaaaaaatctggatgacaaagcatatcgtaatatcaggaactggaaaattatgctgaaacacacagagctctcttctttacttagcactagaaactattgcc

SEQ ID NO: 4865 - DNA, 929 bp, Homo sapiens
gttatcaaagagcacttgagactgtctgaagcccaaagcctgaggacagaaagaccctgatgcaggtcagcccatggcaggcagatgcccttgtctgggcctggtggttttccaagccctcaggctggtcctgatccagtgatggatgcacagcttcttcaccttgtctcactgagactcactgatcatgagagcattctgagacacgctgtaataatcctgcacaggcttgctgtatgacccctggccacagccttccctctgtcattgacctggaggggagaggtcagccgttgagctaatgaggtagctatagttgcagccctcatggacaagttcgagagatccaggatcagctttgaaggctggattctatctaccataagtccgtttcgacattaccacacacgggccgatgcagcggagcgtaccgatcctagcattgtagcgactttaagctcgagtgcatgggcaactagaacacgctaatgagacagcagattacgcagtgtatttgagaatgcatgagggacaacctagtaaggcccttaactatcacctatgtgcatcacatctgcacactctcttctccattccctagcaggaacttctagtctcatttaacagataaagaaactgaggcccacggtttcagcatagacaatgatttggccaggcctagtaaccaaggccctgtctctggctactccctggaccacgaggctgattcctctcatttccagcttctcagtttcttgccttgggcaatggccaggggcccaggagttggggagagttggtgatggagggcgagaggggtcacacccatccacttgctgggtctaggctgctgtacaccaaggccctgcatctgtctgctctgcatatatgtctctttggagtgggaattccatttatggtcaaaacat

SEQ ID NO: 4866 - DNA, 781 bp, Homo sapiens
catctgctccaactgagagtcaggctgagctggagttatttccattttcctgattggtagactaaggctcagagagaggaggcggcattacccaaagccgcacagctggtaaatgggaaaagaggggtttaaaggtacgtgccctggaggaggccaatgctgacctggaggtgaagatccatgactggtaccagaagcagaccccaaccagcccagaatgcgactacagccaatacttcaagaccattgaagagctccgggacaaggttgctactggctggaatgttctgtagatccatggctgtgtccaaggtgtgcaggaggcagtgaccatgagttgtccacagtggggctggtggagtgtctctgagagagctattgtcagagctggctgcaccccactgccccactctcctgggcaaccaattcccacaggcaatactgcctccttggtctttcgtgccctggagataaggaaggcagctcctcaggtgtctcaaggaggctggatgggacaaaacaagaaatggacactgaaaatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctaactgaaagaagaaccacgaaagag

SEQ ID NO: 4867 - DNA, 771 bp, Homo sapiens
cttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtacgtgccctggaggaggccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccaggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggaggaagaaccgcgggatgtcgaggcctggttcttcagcaagactgaggagctgaacaaagaggtggctccaacacagaaatgatccaga

SEQ ID NO: 4868 - DNA, 753 bp, Homo sapiens
gaaagctggggatagacttcaggtatctaccctgactacccgtgccaacctttggcttcttgggcccttctttttcgcgtctccaaagaaagtttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggctacatggcctcatcctgcatgactcgcctgtcccggtctcgtacagcctctctgaccagtgcagcatccgttgatggcaaccggtcccgctctcgcaccctgtcccagagcagcgagtctgga

SEQ ID NO: 4869 - DNA, 804 bp, Homo sapiens
ggagtggggaagttgaggggagtgcctttacatcctgctggtcatcgtggccacttcagtcttgttgagcatttcctgtgagtcatcttgctccaactgagagtcaggctgagctggagttatttccattttcctgattggtagactaaggctcagagagaggaggcggcattacccaaagccgcacagctggtaaatgggaaaagaggggtttaaagcattcaggcacatagagccttctgcagcggcccctccccagccagcacttgacaggacagatgggggctaatctggccctgctaagcagcgacatgcctctcctggagaaggcaggggcttcctggaacttgccccagccttatcagcggaggtttgccccaacacatcccagaaacgagcaaaggttcagcgccgtgcagttggcaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggacgag

SEQ ID NO: 4870 - DNA, 836 bp, Homo sapiens
ctccggctgggaggtgcgtcatgatccgagctcgccatccagtttcctctccactagtacccccagttggagatctgggagcaacaaggcaccatggcgcagaagggccaactcagtgacgatgagaagttcctctttgtggacaaaaacttcatcaacagcccagatggcccatggctgactgggccgccaagagactcgtctgggtcccctcggagaagcagggcttcgaggcagccagcattaaggaggagaagggcggatgaggtggttgtggcagctggtggacgaatggcaagaaggtcacggttgggaaagatgacatccagaagatgaacccacccaagtttctccaaggtggaggacatggcggagctgacgtgcctcaacgaagcctccgtgctacacaatctgagggagcggtacttctcagggctaatatatacgtactctggcctcttctgcgtggtggtcaacccctataaacacctgcccatctactcggagaagatcgtcgaccatgtacaagggcacacgaagaggcacgagatgccgcctcacatctacgccatcgcagacacgtgctaccggagcatgccttcaagcatcggcgaggacccagttccattctattgcacaggcgagtctggagccggggaaaaccgatttacagcaagacaggtcattcagtacctggccgtggtggcgtcctcccatacaggggcaagcacagacacaagttatcacgggcagagctgcacccagccccttctaccacgcaaaccgaatctggaggccttccggcaacgccaacacaggacacacgaccatcctcc

SEQ ID NO: 4871 - DNA, 841 bp, Homo sapiens
gccgggcatggggcgcgcggcagccgcctgaagccccggcctggcccggccgcacccggccggaggcggagggcagagcgcgcgcccagttgcccgggcaccaaatcggagcgcggcgtgcgggagggcccagagcaggactggaaatgtcctggccgcgccgcctcctgctcagatacctgttcccggccctcctgcttcacgaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggttgggcatccagcaggatgtgacccacaccaatggctgcggttggcccttgggcattcaaactacctcacacggagtacgagatcttcaaaaatggacccaggatgcccgggggcgctatctgctgttcaacggtcagaggccccagcgacgggtccagcccagacaggccagagaagaaagccacgttctaccaaagcccttggtccagtggtgcctc

SEQ ID NO: 4872 - DNA, 858 bp, Homo sapiens
ggaggcagtggcgttggtgggaagcgcagctcgaaaaggcgattgccgattctggtttcctggggctgcggcccacttcggtgtgacccagcgctgaggcaggcggtcaggtcgctggcgcggaggctgaggctgacaagcccctgatagggctgtggcgcgtgctcaagctaccaggcacctgacatcgacgtgcagctgaggctcggagctgacagactcgctcaggacccgtgaagcccgagggcaacatccttctgagaccggttcaagagcttccagaggaggaatatgatcgagcctcgagagagagccaagcttcaatgacgcgaagatacaaggtgtacatcatggtggcgaagcgggcgttccgatgtagatccagttgtagctgatcagtcagatgccgtgacgactcgcccattcaataaaaatatctcttctagcctgaaaagataacaagatacaggcggggggcacgtatcatagcataattgtccacctcagcaggggtgcccctagagactatgcacgagttatcaccgcgagatttcttcatgtcctgaccacaagaaggggggcaccccccaaaagataagtactgggcaggccacggccaacatatcaaaaatacaccgccttctagccgaacgcgtttgagtgccccgctcgccgacacctaatagacagcgtagtgccccgtgccgaacgccgttggacggactaaaatacccgggagtaggccaagttgaggagcaaccctactttctgtgggtgaacgaatgcgaccactccttgagagctctcttggtggcgagtgtgtgcatcctagaactgtgggacaaacaactgaaccat

SEQ ID NO: 4873 - DNA, 681 bp, Homo sapiens
gaaagcatagctggagggcccgcctgaatcacaggtgacgggcctgagaccagaggcacgcacacgcacggcactcagcacgaggatttggagaaatgaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagacgatggcagagaagaaccgcacaggatgccgaggattggctcttcaccaagacagaggacctgaaccgcgaggtggccaccaacagtgagctggtgcaca

SEQ ID NO: 4874 - DNA, 823 bp, Homo sapiens
gccggagccgaaacaccggacattcagagtgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagtcgacaactattaaatgaacacagaggagagaagagaaacatgaagactgaagtgaacaaaaaactctctaaatatcgttccgtgtgactgaactgtgtaacgctcatgcctgtaacttccagcactttgggcaggctaaggcaggaggatcacttgcaggctgggagtccaaagaccagcctgggcaacatagcaagaccgcatctctacaacacacaggacatcatgtggtgaacttacccaatgtgaggactatctggctggtgacacctgtcatcccatggatcaccagggttgcaactccatcaacatttaggcatataaatcaatccatcgcaaggtcgcactccagaggtatcctggctcaaagttgggagttatgagttgcagaacgcattcgctgacacacggaaacttccacaggtcacaattcatgaacgatcc

SEQ ID NO: 4875 - DNA, 943 bp, Homo sapiens
gatcgaggcggtgaagcgcaagatccaggttctgcagcagacatgcagatgatgcatgaggagcgagctgagcgcctccagcgagaagttgagggagaaaggcgggcccgggatacaggctgatgtgctgacgtgtggcctccttgaaccgtaggatccagctggttgaagaagagctggaccgtgctcacggagcggcctggccactgacctgcagaaagctggaagaagctgacaaaagctgctagatgagagtgagagaggtatgaaggttattgaaaaccggggcttacaagatgaagaaaagatggaactccaggaagatccagtgtcaaagaagctaagcacattgcagaagaggcagataggaagtatgaagaggtggctcgtaaggttggtgatcattgaaggagacttggaacgcacagaggaacgagctgagctggcagagtcccgttgccgagagatggatgagcagattagactgatggaccagaacctgaagtgtctgagtgctgctgaagcaaaagtactctcaagaagaagataaatatgaggaagaaatcaagattcttactgataaactcaagggaggcagagacccgtgctgaggttgctgagagatcggtagccaaggctggaaaaggatacttgatgacctggaagattaactgaaatgcaccacagaaggagcacctcttgttaggccaagggattgtggacagaaccgtgttgactgaattggatgtaaacggccaagtccaagctgtgtagtctcctatgaacaaaaatccgctgaaggccagcctgcggggaagctgaccttaactgaggggtgatctttaactggaaggcttgtatctcagttagcacccgcatcttcccttggatctttatcgcaaattgcactgactcttcccggaaaatcagtgggaaaaggtta

SEQ ID NO: 4876 - DNA, 698 bp, Homo sapiens
gccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagtctcacgcatgtaatagcattcccatggaaggggccaaaccttgggcagggaagaccatcgaatgaaaccccgccttacatcggcgttgccacgcttgttcccaggattcccacgggagctgcattgggcagccttggaggagccagctgcgccagcttcgctgcgagatggagcagcaagaaccaggcaattcaaaaatccg

SEQ ID NO: 4877 - DNA, 786 bp, Homo sapiens
gcttctcttcactcagccaactgctcgctcgctcacctccctcctctgcaccatgaccacctgcagccgccagttcacctcctccagctccatgaagggctcctgcggcatcgggggcggcatcgggggcggctccagccgcatctcctccgtcctggccggagggtcctgccgcgcccccagcacctacgggggcggcctgtctgtctcatcctcccgcttctcctctgggggagcctacgggctggggggcggctatggcggtggcttcagcagcagcagcagcagctttggtagtggctttgggggaggatgtggtggtggccttggtactggcttgggtggtggcttggtggtggctcggctggtggtgatgggctgctggtgggcagggagaaggtgaccatgcagaagctcaaggaccgcctggccacctacctggacaaggtgcgtgcacaggaggaggccaacgccgaccatggaagtgaagatccgtgactggtaccagaggcagcggcctgctgagatcaaagactacagaccctacttcaagaccatagaggacctgaggaacaagattctcacaggcacagcggacaatggccaatggtccaatctggcagatgcgacaactgaccgtcagggcgcggatgacattccgcaccaagtatgcagacagagctgaacctgccgcctgagtgtggaaagccgacatcaatggactgcgcagggtgctggaccgaactgaaccgggacagagcagacccggagcacgcagatcgagac

SEQ ID NO: 4878 - DNA, 737 bp, Homo sapiens
ggctcgctcacctccctcctctgcaccatgactacctgcagccgccagttcacctcctccagctccatgaagggctcctgcggcatcgggggcggcatcgggggcggctccagccgcatctcctccgtcctggccggagggtcctgccgcgcccccagcacctacgggggcggctgtctgtctcatcctcccgcttctcctctgggggagcctatgggttggggggcggctatggcggtggcttcagcagcagcagcagcagctttggtagtggctttgggggcggatatggtggtggccttggtgctggcttgggtggtggctttggtggtggcttagctggtggtgatgggcttctggtgggcagtgagaaggtgaccatgcagaacctcaacgaccgcctggactcctacctggacaaggtgcgtgctctggaggaggccaacgccgagctggcaagtgaagatccgtgactggtaccagaggcagcggcctgctgacgatccaagactacagtccctacttcaagaccactgaggacctgaggaaccacagactctcacaggcacaggggacaatgccaatgtacgttctgccagcatgacaatgccccgactggccgcggcctgactgccgcaacaagcactgagaccgagttgaacctgcgcatgagtgtgcaagccgacatcaccggcctgcgcagggtgctggacgaagcgcaccctgggcagagccga

SEQ ID NO: 4879 - DNA, 753 bp, Homo sapiens
gggcgtgatgtctcacagaaagttctccgctcccagacatggagtccctcgtggttcctgcctcggaagcgcagacagcaggcatcggtgggaaggtgaagagcttccctagggatgatccatccaaggcggttcacctcacagccttcctgggatacaaggctggcatgactcacatcgtgcgggaagtcgacaggccggcatccaatgtgaacaataaggaggtggtggagaggtgtgacccattgtagagataccagggatggatggtagattgggcactggtagggtgtagcgtgtaaaaaccatcgatgccatgcggacgcttgaatgatgtcgtttgatgagaacatgagatgaatgaatgcaagaggcgtaatgtataagattttggcatatgtctaagaagaaggtctttaccaagatactggaatagatggtaggatgaggatggtgagaagcagctggagaaggacttcagcaggcatgaagaagtactgccaagtcatccgtgtcatagcgcacacccagatgcgcctgcttcctctgcgccagaagaaggcccacctggataggagatccaggtgaacggaggcactggggccgagaagctggactgggaccgcgcagaggcttgaggcagccgggtacctgtgaaccaagtggcgggccggatgagattgatcgacgtcatcggggtgaccaagggcaaaggctaccaacggggtcaccactcgtgggacaccacagaag

SEQ ID NO: 4880 - DNA, 798 bp, Homo sapiens
gcagagacatcaccctgaaatggttcaaaaatgggaatgagctctcagacttccagaccaacgtggaccccgtaggagagagcgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgagttccacccaccttggaggttactcaacagcccgtgagggcagagaaccaggtgaatgtcacctgccaggtgaggaagttctacccccagagactacagctgacctggttggagaatggaaacgtgtcccggacagaaacgggctcaaccgttacagagaacaaggatggtacctacaactggatgagctggctcctggtgaatgtatctgcccacagggatgatgtgaagctcacctgccaggtggagcatgacgggcagccagcggtcagcaaaagccatgacctgaaggtctcagcccacccgaaggagcagggctcaaataccgccgctgagaacactggatctaatgaaccggaacatctatatggtggtgggtgtggtgtgcaccttgctggtggacctactgatggcggcctctacctcgtccgaatcagacagaagaaagcccagggctcacttcttctacaaggttgcatgagccgagaagaatggcagagaaataacacaggacacaaatgatatcaccatattgcagacctgaacctggccaaggggcaagaagcctgctcac

SEQ ID NO: 4881 - DNA, 1060 bp, Homo sapiens
gctgaataatccagagtgaggagttggacgggaccgggagtgatgaaatccagaggggaacctggagtcagcagttaggagggccccgccttccccagctgcatataaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggaccctgagcccgcatcctgacactgagatgcgtgaccagtacgagcagactggcacgagaaaaaccgcagagacgctgagacctggtcctgagccaagaccgaggagccgaacaaagacagtggactccaacagccgaaactggtacagagccagccgagcgtgaggtgacgcgagctccggagcggtgctccaacgccctggacaatcgagctgcagtccccagttcacgcatgaaaggcttccttgacagaaccagcctgcacgagcacccaagcgccggctaactggcattccagtctgtccccagaatccagtggaacttgctttcgcgacgtgatggaacgaaccagtctggacgcatgcttaacgcctgcagcagactggcacgcacgactcaccgcccgaagtaccaccattcaggccccgctctaaccccccgcaccggcccccgcaacatgcaccccatacccaccgccatgccgcacgacacgactcccgccctccctcac

SEQ ID NO: 4882 - DNA, 831 bp, Homo sapiens
gcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgtaggtgggggtataggatggtggcttaggtggtggcgatggtggtctcctctctggcaatgagaaaattaccatgcagaacctcaatgaccgcctggactcctacctggacaaggtacgtgccctggaggaggccaatgctgacctggaggtgaagatccatgactggtaccagaagcagaacccagaacaggccagaatgcgactacagacaatacttcaaagagcatagaagagctccgggacaagatcatggacaccaacatcgacaactcccgggtcaatcctggagatcgacaattgccaggatggctgaggacgacttcaggctcacgtatgacgaatgagctgagcctgcagccagggacggtagagggctgacaatcaacgggctatgcgccgaagatcctgggatgaggactgacaagtgggccaggactgacctggagatgcagaatcgagggcctgaatgacggaggctaagcactgactgaacagaaagacccacgcacggaggagatgaa

SEQ ID NO: 4883 - DNA, 834 bp, Homo sapiens
ggaggaccggaggctctggatggaagccatggatggccgtgtaacctgtctacaactcgaacaaagacagccagagtgaagggactgcgcagtttggacagcattggcttcaggacactaatcaggaaatgcagtccatgctgtggaaaccatgagggatcaatcggatgcaagggctgtactcgaattcgtgggggtcaactccagagtgcagaagttgctgagtgtcctgatggcaccccatagcactgcttcgtgagaccatgaacacacgactatctgttgcgtgaactgggatgatacaagacctagtctacgtagctgctctgcaagacctatcctaacgaatgcttccaggaacactcatgatgtaccagttgcaacataagtttcatccagagcgagccaaaagctggaagaagccaggaagtctcagggtcgtcgtgagagatccacaggccttggttcatcggctcccagagaacaaatcggccagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaacgatatttaacaccgtgcccgatatgcctctcaccaatgcccagctgcacctgtctcggaagaagagcagtgactccaagcccccggtctgcagcgagaggcccctgacgctcttccacaccgttcagtcaacagagaaacaggaag

SEQ ID NO: 4884 - DNA, 1084 bp, Homo sapiens
  misc_feature (1005)..(1005): n is a, c, g, or t
  misc_feature (1048)..(1048): n is a, c, g, or t
  misc_feature (1059)..(1059): n is a, c, g, or t
  misc_feature (1073)..(1073): n is a, c, g, or t
ttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaagggatcaatgactaacgaaaaactaccaaagtatcctacagagcttcacagccagacctagtggacacccccacagctccaagccacaggccaagagaagtctcaggaaagcagacactggagaaagatttttagcatttaggaaacaaacgccatcagcaggcaaagccatgcacacacccaaaccagcagtaggtggagagaaagacatcaacacgtttttggggaactccagtgcagaaactggacccgnccagaaatttaccctggcagcaatagacggcttacaaactccntagggaaaaanccccaggctcctanaaagacgtgac

SEQ ID NO: 4885 - DNA, 944 bp, Homo sapiens
  misc_feature (782)..(782): n is a, c, g, or t
aattttcgggattcgtcgaccacgcgtccgttgagggtcgcgggtggttagttgagccggctccggcggggaaggaggcgggctgcggctgcggctggggctgaagctgaagctggggctggggttgggggactgcccggggcttagatggctccgagcccgtttgagcgtggtctcggactgctaactggaccaacggcaactgtctgatgagtgccagccccaaaccgcgcgctgctcgggaccttagagcctctgactcaggctggaagatttgagagctggattaaaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctcccctttgagtggagtgcctctcctgatccttgacgaagagagacagccttgaaagttgtttcanctgggccccccttcacctgcgaagatgccctctcccccctgggaattccacccctgtggagtctcccttcaagcaatcctgtcaaacccccgcaacggcttaaattggccaacctggctccgccggtgaactaaacacattttacatttttttaaggggccc

SEQ ID NO: 4886 - DNA, 964 bp, Homo sapiens
  misc_feature (888)..(888): n is a, c, g, or t
tcatctgctcccagtcctcaccgctgcaggtcatcaccatgctcaatgcactgtacactcgcttcgaccagcagtgtggagagctggatgtctacaaggtaggagtggaccagggaaataattgttttaccagcaaactcactggggaacaagcactgtgcctaggacctgaattataatgcaactgaaaggccacctctgtagggtcttgcaagcccagtcctgggagcaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaatttttttaggcaaagcatcaggaatagattagcaacctatatacctatttataagtctttgggggtttgactcattgaagatgtgtagagcctctgaaagcactttagggattgtaagatgggctaacaagccagtattaaaatttcaggagcccaagtcaccaatctttctccctgtttacatgnacaaaatggactcaactcagtacttcagctcttcaaaaaaaaaaaaaaaggggcgggccgctctaaaggatcccct

SEQ ID NO: 4887 - DNA, 1053 bp, Homo sapiens
ggattccttggaatcgtcgaccacgcgtccgtgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagggtctcactctgtcacccaggctggagtgcagaggcacaatctcggctcactgcaaccttcctctccctggcttaactgatcctccctactcagcctcccgagtggctaggactatactcctgagccagtcaaatatacagcagagtgactattctgcagccctaaagcatggcacagggaaaaagaatcgaaacttcttctatcatcccctggggaaaaatacaaagggttggcatttccatccccggaagggaagaagggccccgactaccttcatgcccccctaaatcatggggctatttaccccgaggcaatgaattctcctttaccccggcacccttttccttatacccttcaagg

SEQ ID NO: 4888 - DNA, 1102 bp, Homo sapiens
  misc_feature (628)..(628): n is a, c, g, or t
tctttgcaagaaggtagagataaagagtcttgttatgtcgcccaggatggagtgtagtgacactttttcaaaaatggcaatggtatcagaattcctcaagcaggcctggtttattgaaaatgaagagcaggaatatgttcaaactgtgaagtcatccaagggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacactgaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactagcaaagaaatcagagacattaacagggtctacagagaggaactgaagagagatctggccaaagacataacctcagacacatctggagattttcggaacgctttgctttctcttgctaanggtgaccgatctgaagactttggtgtggatgaaaacttggctgattcagatgccagggcccttgtatgaagcaagagaaaaggagaaggggacggacgtaaacgtgttcaataccaatctttaccacagaagctatccacaaccttcgcagagtggtttcaaaatacccccaagtacagtaaagcatggacatgaaccaaggttctgggaccttggaagttgaaaaggggaacattgagaaaatggcctcccaagctaatcctggaaggggggcccacaaagcaaaccaactttttcttttgcaaaagaaagctttcttccaacgccgtgaaaaagggttttgggaaactccccccattaagggcatttggattcccgggattatatgggtttctccccctttcttgaaaatttggacggttgaaatggggaattttccaagacgcttttctctaattcccaaaaaaaatgggt

SEQ ID NO: 4889 - DNA, 1087 bp, Homo sapiens
gctgaatgctatctgtgcacaagtcattcctttcctgtcccaagagcaccagcaacaagtggtgcaggctgtggaacgggccaagcaggtgaccatggcagaactgaacgccatcattgggcagcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgagaatgaaaaatctactactcccgtctcaaagtccaatacccctactccacgaactgatgcgcccaccccaggcagtaactctactcccggattgaggcctgtacctggaaaacaccaggagttgaccctttggcctcaagcctaaggacccccatgggcagtaccttgtccatatccaactccatttgggattgtgccccatgctggaatgaacggagagctgaccagccccggagcgggctacgctgggctcccaacatctcccctcagatgaacgcaactggctgccgccgccgctgctgctgctgcccatgggaaaacccccacgggggggatttgtacacaccatcccatgtccggggccagcaaacccccaaaccacgcacgccccccagttgcagaaaccagaaacccccctcccgggtacccccacaaggttccaatgcccccttggcccctccttcccccacacacccctgtccggaccttggatacctcccccggtgtgatcaccaaaaaacaataccctcaccaccacgcgtctcccggctcctccctccccacggaacac

SEQ ID NO: 4890 - DNA, 1020 bp, Homo sapiens
cggcattacccaaagccgcacagctggtaaatgggaaaagaggggtttaaagaacctcaatgaccgcctggcctcctacctggacaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtgcgctcccccgtctctctcctcttcctgcattgcccactttacttggccttctcctggctctgactcaggcagccaagacccctcccacttccttctttggcctccctctcctcaggtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaaggagctggagatcgagctgcagtcccagctcagcatgaaaagctgggctggagaactcactggccgagaacagagtgccgctatgccacgcagctgcagcagatcaggggggctcatgtggtggccctggaggccccagctgagttgagctccgaatgccaaaatggaaggcttcaaaaacccgggagtt

SEQ ID NO: 4891 - DNA, 1055 bp, Homo sapiens
cctccagctccatgaagggctcctgcggcatcgggggcggcatcgggggcggctccagccgcatctcctccgtcctggccggagggtcctgccgcgcccccagcacctacgggggcggcctgtctgtctcatcctcccgcttctcctctgggggagcctatgggttggggggcggctatggcggtggctttggtggtggctttgctggtggtgatgggcttctggtgggcagtgagaaggtgaccatgcagaacctcaacgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttccgcaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccccgaggaggagatgaatgccctgagaggccaggtggggtggagatgtccatgtgggaaatggacccttgcccccgccctggacctggaacccccattccgaacccaaatgcgtggaccccttatgaaaaatatggccagagaacaacccgccccggcatccccaagggaatggcctcatatccccccgactcagggcgccccgacccgccagagacgcccacacaaagtactaaacctcgggaccgagccgcgccccacacaaggaatccccccgcacgcccccagcgcccctccttcgcatttcaccctcggcgcgcacttgaacctccacatacttccctaccagggctcaccatccccaggccccgaccgccaccccaacccactccgtcctacacccagtgac

SEQ ID NO: 4892 - DNA, 551 bp, Homo sapiens
cacgaggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaatgctccactcatctttgtgtgtgccatggccacatctcctgggtacagttca

SEQ ID NO: 4893 - DNA, 457 bp, Homo sapiens
gttacaactctaatcacatgcttgatctttctggtgatcagtcccctgcccgaagctatctgtggggccactatgcgtcaccacattagctcaacaaagatattcctggcactcaggaaattgcaaggatttttgaagatctatgccaggaaagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttg

SEQ ID NO: 4894 - DNA, 540 bp, Homo sapiens
ccatccaccacccctgggatccgccgccccttctttcctttccactcccccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagc

SEQ ID NO: 4895 - DNA, 533 bp, Homo sapiens
actcggccaggcgccggcgacctgaggggagagggaacgcagctgaaagcgtgaactgtacctgtcatttactccatcctttatagtgatgctacaggacgaagaggaatggataaaaacattggcgagcaactcaataaagcgtatgaagccttccggcaggcatgcatggatagagattctgcagtaaaagaattacagcagaagtcactgcaataacatagcaaaattaatggattaacaatataagggaaactggcatttaagacaccaaaggtcaactatattctcttaatttcttaaaacttagtggagaagtttctgactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagc

SEQ ID NO: 4896 - DNA, 329 bp, Homo sapiens
agaaagtgcctgattcagagagcaggagaagggtgtcttgtttttcctgaagtgctctgacgacccttcgacattcacagcagacaacgccagcaggaatactggatgatggcgtttgacggtatttgcgggctgccattcccctgcatatctgtactggtgcggtttctggagcagcagaacaagctgctggagaccaacgtggacgctgctgcaggagcacaagtcggacaagagcagccgactcccagacatctttgaggcccagattgctggccttcggggtcagcttgaggcactgcaggtggatgggggccgcctggaggcgg

SEQ ID NO: 4897 - DNA, 649 bp, Homo sapiens
gcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagccttaacggcacagttacgcagtcaacaagcttttgatgccggcccacagcaggaagagacctgtgccagtcacacagtggaatacaaaggaagttggagggcttcacccttgctgcggcttgatctagttcaactgctttgggagtttgacactcggagggcactgtgctcctgctgaagagggtactgggcgatccctgcttcctgtgcccaagctctggtgttttacaggtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtca

SEQ ID NO: 4898 - DNA, 672 bp, Homo sapiens
tataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtccgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtgacctcgttcctcaagatggctgactccggaggtcagccccagctgactcagccaggcaagctgaccgaggccttcaagtact

SEQ ID NO: 4899 - DNA, 710 bp, Homo sapiens
gatacagaaaccagcctcgaggtccagttggaaatgaaccattggttactgacgtggttttgcagagttttccacctttgccgtcatgcgaaattttggatatcaacgatgagcagacacttccaaggctgattgaagccttagagaaacgacataacttacgacaaatgatgattgatgagtttaacaaacaatctaatgcttttaaagctttgttacaagaatttgacaatgctgttttaagtaaagaaaaccacatgcaagggaaactaaatgaaaaggagaagatgatctcaggacagaaattggaaatagaacgactggaaaagaaaaacaaaactttagaatataagttactctttcaacctgatcagaacgcaccaccaattcgtctccgacacagacgatcacgctctgcaggagacagatgggtagatcataagcccgcctctaacatgcaaactgaaacagtcatgcagccacatgtccctcatgccatcacagtacctgttgcaaatgaaaaggcactagctaagtgtgagaagtacatgctgacccaccaggaactagcctccgatggggagattgaaactaaactaattaagggtgatatttataaaacaaggggtggtggacaatctgttcagtttactgatattgagactttaaagcaagaatcaccaaatggtagtcgaaaacgaagatcttcc

SEQ ID NO: 4900 - DNA, 1093 bp, Homo sapiens
  misc_feature (450)..(450): n is a, c, g, or t
ggtgatcctggaaggagagctggagcgctcggaggagagggctgaggtggccgagagtaaatgtggggacctagaggaggagctgaaaattgttaccaacaacttgaaatccctggaggcccaggcggacaagtattccaccaaagaagataaatatgaagaggagatcaaactgttggaggagaagctgaaggaggctgagacccgagcagagtttgccgagaggtctgtggcaaagttggagaaaaccatcgatgacctagaagagacccttggccagtgcccaggaggagaacgtcgagattcaccagaccttggaccagaccctgctggaactcaacaacctgtgagggccagccccacccccagccaggctatggttgccaccccaacccaataaaactgatgttactagcctctcaaaaaaaaaaaaaaaaaaactcagactangttctctctctctctctcggcttgagtagggcagagagcaccgcccagcagccagtgggttcccgcgcgtgccgagactctgagggccttgcacccccacgatcccgtacgatggccgtcaagaagatcgcgatcttcggcgccactggccagaccgggctcaccaccctggcgcaggcggtgcaagcaggttacaaattgacagtgctggtgcgggactcctccaggctgccatcaaaggggccccggccggcccacgtggtagtgggagatgttctgcaggcagccgatgtggacaagaccgtggctgggcaggacgctgtcatcgtgctgctgggccccgcatgccccccccaaactggagccccccccttggcccccgggccctccccttacaccttgggcccccagggcccccccccgccccccgggccccgccccttgcccccccttgccgccgttcgctggcccaaagagggggagccccctctattcgggccccccctctagggcccccccaaacctttattgttcccggggggccccccccgaacattttggggccccccattgaagggttcatgggggggcgaaaacaagggtcctgggccctcccccccccggctttttccggcgcccgggg

SEQ ID NO: 4901 - DNA, 1177 bp, Homo sapiens
  misc_feature (747)..(747): n is a, c, g, or t
  misc_feature (1158)..(1159): n is a, c, g, or t
gcctgggtggcgatctcggcacgagggttagagagactgatgatcaaaaattcatcaccatcctgtgcacgctcaacgtctctcaccctgctgaacattgtgtgcaagagtatgactaaaattgccaatgtaaccattcaggaccttatcaacactggcacccctggatcactggaggaagccatgctcgctgtcgtgaaatgcaccctgaacctcctcagttactttgcacagatactctactatgccatgtaagggagcagggacacttgatgggaccctgataataaacactcgtttctgggagcgagattgacttaaatcttatcaaatgtcgcttcaagaagatgtacggcaacaccctcagcagcatgatcatggaagacaccaccggtgactacaacaacgccctgctgagcctggtgggcagcgacccctgaggcacagaagaacaagagcaaagaccatgaagccagagtctccaggactcctcactcaacctctgccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcangagcttcccaagctggtcacagagtctcctgggcacaggttatacagaccccagccccattcccatctactgaaacagggtcttcacaagagggggcaggggaatatgggtttttaacaagcggtcttacaaaacacttctctatcatgcaacccggaaaactggcttggggaacccttttggttttaaaacccaccatccttttgccactttgaaaaaccaaatcccaatccctccccaaccgaaatgccctttaacattcctcttaaaatggttagggctctaaagggaccaaaaaaatctctcccccctcttaattaccaaaataaactttcgaaattccttacccccggggcgacttgtggttttataaagagggggggggcctccccactaggggcgggaacaaannacacagctgtccctcttg

SEQ ID NO: 4902 - DNA, 1029 bp, Homo sapiens
  misc_feature (899)..(899): n is a, c, g, or t
  misc_feature (934)..(934): n is a, c, g, or t
  misc_feature (941)..(941): n is a, c, g, or t
gccgcggcggcagcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtccctgtgatgctggtggtaggagaaccagcacctcatgaagatgcagtgggtggaatgtaactcaaaactggaccccacccagaccntcgtttctcaagaatgcctgactccgggaggtcancccccanctggactcaaccagggccagcctgaacccaaggcctttcaagtactttcctggccagggcatggggcctacatgggccttcattcttg

SEQ ID NO: 4903 - DNA, 316 bp, Homo sapiens
taacattttctcggccctgccagcccccaggaggaagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaagctgagcctgctcatgtacctctgattaataaatgcttatgaaatgaa

SEQ ID NO: 4904 - DNA, 1324 bp, Homo sapiens
cccctccttctcccgcgccttctcctcatctattatttaagaaaggaaaggaattcctttcataaaaaggaggtcttcatcaaattttctaatttcactccttattaacagagaaacgcttgagagtctcaaactggactggtttaaagagcatctgaaggatttgactagatgataaatgccaatattaaatctgttggagtttcacgtataagacagaggagaaagagaacatcacaaattacttagcaagctatggaatggagattcagttttcattttagtttgttaaatctacaaggctgtaaaatgattatagcatgtcctttgcaacctgatcacacaaatgatgagaaagaatagaactttctcattcttctttgaataacgtctccttgtttaccctggtattctagaattcacgaaccagccatgggcacagaccacgagccaagatgggataaacaagggttgctttatccctgcatgacatgagatggacatcaccacattaaaggttcttaagctagagagtaacaggaagtatctgtatgtatccaagggttttgaaatgaaatgactagcgacaatactggaacaacagcaagaatttgttgactttcatccttacagaactcaagttacccgacgttcacctaacattgagacctattgactacatttcccctacggggaacccactaattgggttttttcctctccccggcagacgccctttaccatccccttatgggcgcttaaaacaaacctcccttaccctttcccttggcactacaaattctatttctggaacactactttttctgcatttggacgaacacggtaatacctctcttgaaagcctacctttggcctggtaccttttacgctagcacccttggtccctgttaagaatccttgggaacacaatcctttagttaagggggaaaacgggattgcaaatcgatatatcgggagacatccttaaaacccctaggggccaacaaaaggggagccggaccccccttggttttcttcccgacccatatccggggtctccccctacgcgggtattatttggaggggtctcctttcttgcggctgcgggccccgtacaccccttccacgggatttcgttcgcgccccccatttcctcctctactccccccgcgatatactctcccccgacctgtgtgtcctccgccctctcctaccccccgcggatacacgtgctccccacccttctattttttagcctaaataacctttttatcccgcgtgatttattttttctctcccccctccacacaccgcttttcccccc

SEQ ID NO: 4905 - DNA, 967 bp, Homo sapiens
ggtccggaattcccgggatcccgactccgagctgtccccgctcccggcgcggcgctccgctctcagccacctcacggctgccaggagtgcgcgggagtttgccccggagcgcggggaagtttcctccgaagctgcgctcctggaacagcagcacctgcaagcgcccggcagcggcccgcgaggttactttatggaattgggctcttagagaacaagaaaagactgaagttttacgggaaaacaaatcatgtggtcttcagattctgaaataaggagaaatgcagccatctgaaatggtcatgaaccccaaacaagtcttcctctctgtgctgatatttggagtagctgggctactcctcttcatgtatttgcaagtctggattgaagaacaacatacagggagagtggagaagagaagagaacaaaaagtaacttcaggatggggaccagtgaagtacttgcggcctgtacccagaatcaaaccccaagtttcacatgcctgaggatgtacgagaaaaaaaggaaaatcttctactcaattctgagagatctactaggctcttaacaaagaccagtcattcacaaggaggggatcaagctttaagtaagtccacagggtcaccaacagagaagttgattgaaaaacgtcaaggagctaagactgtttttaacaagttcagcaacatgaattggccagtggacattcaccctttaaacaaaagtttagtcaaagataataaatggaagaaaactgaggagacccaagagaaacgaaggtctttccttcaagagttttgcaagaaatacgggtgggggtgagtcatcatcagtcacatcctttttcatacagtatcccagaatctatggtagaagataaacccaaaatctttatattgtggagggaccctaagggctggccgtgttcccaattggggaaaaaaaaattctggaaggggtacctaaaagt

SEQ ID NO: 4906 - DNA, 1053 bp, Homo sapiens
gttcggatcagaccaagtcttcactcctttctgcgagccctgaggaagccttctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttaaagccggagagggctagccctgaacccgggcctcccccagctccttggctgcagccatcccgcttagcctgcctcaccaccacccctgggggtaccttcaggcctggcccagctttgagggtctggcactggagcaagggaaactggcccctggggagctccttccctgtgcccccagccttagccccaacttcctaccccaaagccttccctggccttggcccctcccctccccggtggccccatcaacctctaaggggttcctcccgtgggccaaaccagggaaacaaccccgctcgggggcgcacccccgatcggggggccacagcccggggcctctgtggggcggccagatctctctttcgggaaagacgcgcgccgcgc

SEQ ID NO: 4907 - DNA, 1060 bp, Homo sapiens
ggtccggaattcccgtgattgcgtctggagatggagatggagcggatgagacagacccattctaaggagatggagagtcgggatgaggaagcacaaggctgccgtggctcaggcttcccgggacctggctcagataaatgatctccaagctcagctagaagaagccaacaaagagaagcaggagctgcaggagaagctacaagccctccagagccaggtggagttcctggagcagtccatggtggacaagtccctggtgagcaggcaggaagctaagatacgggagctggagacacgcctggagtttgaaaggacgcaagtgaaacggctggagagcctggctagccgtctcaaggaaaacatggagaagctgactgaggagcgggatcagcgcattgcagccgagaaccgggagaaggaacagaacaagcggctacagaggcagctccgggacaccaaggaggagatgggcgagcttgccaggaaggaggccgaggcgagccgcaagaagcacgaactggagatggatctagaaagcctggaggctgctaaccagagcctgcaggctgacctaaagttggcattcaagcgcatcggggacctgcaggctgccattgaggatgagatggagagtgatgagaatgaggacctcatcaacagtgagggagactctgatgtggactcggagctggaggaccgtgttgacggggtcaagtcctgggtgtcaaaaaacaaggggaccttccaagggcagcttctgatgatggcagcttaaagaagttcagcccccacagctactggaagtcccttgccccctgatcggccagatgatgagcacgaccctctcgaccacacctccagaacgcgatactcccacaggttatctgagtgacagcgacacagaagccaagcttgacggagactacgcatgccccccggggggaaggggttggcaacccctctcacccccaggggcctgggggctgcctgggcaccccctcccccccaaaaaagtgggggggggcaccgggtcctcccccccccccgcattggttggact

SEQ ID NO: 4908 - DNA, 396 bp, Homo sapiens
gttttttcaagaagcaggattcaaggtttaacttcaaatacaaatttgaatcaacactaaattttaggagtgcataatgaaagagaagatgttcaaaagaaaacattcacaaaatgggtaaatgcacaattttctaaggtctgtgcaggccaaggttatggcctagctgagaagagggctcagaggagcctagctaaagtttggtcaaggggagcgtcttggtggagcctcactcctgttcaagtaaagaagacacattattcatccttctgaacagttttgggaagcagcatattgagaacctcttcagtgacctacaggatgggaggcgcctcctagacctcctcgaaggcctgacagggcaaaaactgccaaaaaaaaaaaaaaaaaacgcgg

SEQ ID NO: 4909 - DNA, 795 bp, Homo sapiens
ttttttttttttttttctgcctcctgtttattgagaactatgcattgaacattctgaatcattctaagcctctggagagactgtaatgatccattcatgagctggtatgaaatcagtgggaagcagaacaacagaaggaactttaaaagcaacaagcaattatgtaccatatatacactgtagcaaatattttatatttgagagtctttacagcttacatttccattccattattacaagtgatgaaaaacaaaaaattgcaagtagtatgcaaattataaatatacagtcttcccacttcactaaccaaattcctactttccagtgttacttcccaatttatgcaggaaacctcctgcaaagctgaaactgattagaaaattctttatattttaaaatagctctttctcatttttagagaagtcaaatagccaaccatcaaaattaagaataaattgaattgtcacagtccattacagttattgttgctagatccacctcatttgcagatgtccaaacttaaattcatctgttcttaaaatgctacttaaaactttggttgttttctggtttttgcagtacaatgggatgatcaggcagaaagtctggtttttttctgcagatggaaacacttgagagcttcaacaggaaatctctgctgtatttaattctctctttcttaactggagactgctgttgctgttgctcattaagaccttgagaaaaggttgcattcattcgtctacatctgctactccatttgtatgcactgagtgtgcatggatatcgttttga

SEQ ID NO: 4910 - DNA, 583 bp, Homo sapiens
agctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaacttcaatttttctgcagtggctctgagtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagatgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtgacttaagtgtgaatttggagtatgc

SEQ ID NO: 4911 - DNA, 581 bp, Homo sapiens
  misc_feature (580)..(580): n is a, c, g, or t
attgattccggctcgagcctagagaggacgtgttctctggacttagggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtnc

SEQ ID NO: 4912 - DNA, 582 bp, Homo sapiens
gatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccccttgacagtgatctcaaaccacggaaaaccacctggtgtacagagaagccaggacaatgtggaaatttgatgcatttccaagaaaactgatgtgtgtccagactttgagtgtcctctggcttcttcgactccaggctgccagtctcctatttgtggataatcccgtgggcactgggttcagttatgtgaatgggtagtggtgcctatgccaaggacctggctatggtggcttcaaacatgatggttctcctgaagaccttcttcagttgccacaaagaat

SEQ ID NO: 4913 - DNA, 582 bp, Homo sapiens
  misc_feature (526)..(526): n is a, c, g, or t
acacagtgatttctgttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtcaagttcctaacgagtcttcagaggaggcagcagggagctcagagagctgcaaagcaaccgtgcccatctgtcaagacattcctgagaagacatacaaganagtcttcctcaaagaaagaccagtcggagccgagtctatcttcacactttggcaga

SEQ ID NO: 4914 - DNA, 582 bp, Homo sapiens
  misc_feature (497)..(497): n is a, c, g, or t
aagtgaaggtggaagcggccgcggcggcagcagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcanaactggaccccacccagacctcgttcctcaagatggctgactccggaggtcagccccagctgactcagccaggcaagctgaccga

SEQ ID NO: 4915 - DNA, 583 bp, Homo sapiens
tgtcctccgagccagtcgctgacagccgcggcgccgcgagcttctcctctcctcacgaccgagagcagtcattatggcgaaccttggctgctggatgctggttctctttgtggccacatggagtgacctgggcctctgcaagaagcgcccgaagcctggaggatggaacactgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaaggggggagaacttcaccgagaccgacgttaagatgatggagcgcgtg

SEQ ID NO: 4916 - DNA, 605 bp, Homo sapiens
gtttggcctataggactctgtagggagagcctgggtcagccctgcacagcattgcacagtagaagtctttctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagca

SEQ ID NO: 4917 - DNA, 572 bp, Homo sapiens
ctttttttcctcggaacaatgagcttgttgaggtttgctgcaatccgttacttgaggagggggtggagtctgttcaggtctgtttctccttgccgaagtgtggtctttggagctaagtgaagaatgacttctgttaggttttcctctgctggtcttccttgcagcctcgaaaacctcaccagagtcgcctctgctggtctcttactgtgctgctctgtcagagatgggcaagtaagcgaactgcagagtgttgctgtgtgtgcttgtgatttgtattttatttgatgtaaacgtgaaggcagagtattttctaacactgtaattcaactaggttttgtgtctcctgcatctatttttttttcttgttgttctgaggagctgatatacttggaaatattaggtttaagatatgcagatgtccaacttatatacatagtcaagggtttagagtctggagacaggaggctggcaatttcaactaggaggcagtaaattcagggcaagaagcgaaaccctggccttaaaattccaaaagaagcatttgaacaacctcagaccagttccacaccacc

SEQ ID NO: 4918 - DNA, 582 bp, Homo sapiens
  misc_feature (555)..(555): n is a, c, g, or t
gagaggcagaatgtccacggagccagaagtcaggaggtctgcactgtcttgctgccctgccactagctggaggagagcagaccagccggagggaagctggcagacttcttggaccttcaccacctcatttctaaactggagattacggtctttggtcaaacaattagagagaggggaagcttcagtggtagatcttaagaagaatttggaatatgcagctacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagccccggttcaagagcatcgttcacgcagtgcaggctgggatatttgtggagagaatgtatagacggacatcaaacatggttggactgagctatccaccagctgttattgaggcattaaaggatgtggacaagtggtcctttgacgtcatttccctcaatgaggccagtgnggatcatgcactgaaatttattttcta

SEQ ID NO: 4919 - DNA, 583 bp, Homo sapiens
  misc_feature (563)..(563): n is a, c, g, or t
cagagccaccttctgcgtcctgctgagctctgttctctccagcacctcccaacccactagtgcctggttctcttgctccaccaggaacaagccaccatgtctcgccagtcaagtgtgtccttctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggngccgcctggactcagagctg

SEQ ID NO: 4920 - DNA, 582 bp, Homo sapiens
  misc_feature (550)..(550): n is a, c, g, or t
aacttggggcccctctcctctccagcccttctcctgtgtgcctgcctcctgccgccgccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcctccagctccatcaagggctcctccggcctggggggcggctcgtcccgcacctcctgccggctgtctggcggcctgggtgccggctcctgcaggctgggatctgctggcggcctgngcagcaccctcgggggtagcagctactccagc

SEQ ID NO: 4921 - DNA, 597 bp, Homo sapiens
ctgtggcctggcttgaaagactcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcagcaagtgtaactggtagcaagaggcagccaagaactcctaagggaaaagcccaacccctagaagacttggctggcttgaaagagctcttccagacaccaggcactgacaagcccacgactgatgagaaaactaccaaaatagcctgcaaatctcctcaaccagacccagtggacaccccagcaagcacaaagcaacggcccaagagaagcctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacc

SEQ ID NO: 4922 - DNA, 582 bp, Homo sapiens
cgtagaagaagaattcttcgcacttcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacaccaggtcacactgaggaatcaatgactgacgacaaaactgccaaagtatcctgcaaatcttcacaaccagacccatacaaaacctcaacaagctccaagcgacggctcaagacatccctggtgaaagtggacgtgaaagaagagctcctagcagtcggcaagctcacacagacatcaggagagactacgcacacacacacagagccaacaggagatagtaagagcatcacagcgtttatggagtctccaaagcagatcctggacccagcagcaagtgtaactggcagcaggaggcagctgagaactcgtaaggaaaaagcccgtgctctagaagacctgtctgact

SEQ ID NO: 4923 - DNA, 581 bp, Homo sapiens
gcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaagaattgaaaactgtgacgaacaactggaagttactggaggctcaggctgagtaagtctcgtagaaggaagacagatatgaggaag

SEQ ID NO: 4924 - DNA, 579 bp, Homo sapiens
gacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagatgaagaaaatgaaaaagaaacagcagtatccacagaagacgattcccaccataaggctgaaaaatcatcagtactaaagtcaaaagaggaaagccatgaacaggagcagtaaacatagccaaggcctaagggatcaaggaaaccaagagcaggatccaaatatt

SEQ ID NO: 4925 - DNA, 583 bp, Homo sapiens
gaggtcgccctagcccgggacccctgcgtcgggccctgagcgggcgacggggacgcgagtggccataatataattgtgataatgtaataaaatcaggaaacattacctgaagcagatgcttttgaagtcaccagaaaatagtcttctccaattccaatttaaatatggagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagttgattattatccccaaaatacc

SEQ ID NO: 4926 - DNA, 582 bp, Homo sapiens
acatgaagaaagagcttcctgcaattcaaggactgtacaaagctgaaacgcagagattttcatattatttgggagactcagaaatgagcttttaaggttgttccttgacttgcgggtcaataagcgcacaatggtgaagaaaaggctgccttctagtgacacggtgttccggtttgagactccgggcagcccaaggaaggccaacgtggaggcctcacgcagctccacagacagccccagctcggtgttcctcagctacctctctctgaatgtctaaagtgaagcggtttcctttcttcttcagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaa

SEQ ID NO: 4927 - DNA, 563 bp, Homo sapiens
  misc_feature (553)..(553): n is a, c, g, or t
attactacaggaaaaactgttctcttctgtggcacagagaaccctgcttcaaagcagaagtagcagttccggagtccagctggctaaaactcatcccagaggataatggcaacccatgccttagaaatcgctgggctgtttcttggtggtgttggaatgatggccatccttggcatgaaatgcaccaggtgcacgggggacaatgagaaggtgaaggctcacattctgctgacggctggaatcatcttcatcatcacgggcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagctacagatactcgataccttcccatcgcacaacccaaaaaagttatcacaccggaaagaagtcaccgagcgtctactccagaagtcagtatgtgtagttgngtatgttttt

SEQ ID NO: 4928 - DNA, 578 bp, Homo sapiens
actcaggaaaactgttctcttctgtggcacagagaaccctgcttcaaagcagaagtagcagttccggagtccagctggctaaaactcatcccagaggataatggcaacccatgccttagaaatcgctgggctgtttcttggtggtgttggaatggtgggcacagtggctgtcagtggcatgcctcagtggagagtgtcggccttcattgaaaacaacatcgtggtttttgaaaacttctgggaaggactgtggatgaattgcgtgaggcaggctaacatcaggatgcagtgcaaaatctatgattccctgctggctctttctccggacctacaggcagccagaggactgatgtgtgctgcttccgtgatgtccttcttggctttcatggtggtgctcatccctgtgagctgggttgccaatgccatcatcagagatttctataactcaatagtgaatgttgcccaaaaacgtgagcttggagaagctctctacttaggatggaccacggcactggtgctgattgttggaggagctctgttctgctgcgttttttgttgcaacgaaaagagcagtagct

SEQ ID NO: 4929 - DNA, 581 bp, Homo sapiens
aaaatttctgcctagtcaaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcagacaagttgttaaaagccttgaaaggctacattaaacatgaggcaagaaaaggaaatgagaatcagtttcactcttgctgcccaggctggagtgcaatgacacgatctcggctcaccgcaacctccacctcctgagttaaagcgattctcctgcctcagcctcctgagtagctgggattacaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagaatcatgaaaagcaggaaagccaggatctcagagctactgcaaaagttccttct

SEQ ID NO: 4930 - DNA, 583 bp, Homo sapiens
ctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttcagactgcagtaaccaacattgatcgccctaaaggactggcattcactgatgtggatgtcgattccatcaaaattgcttgggaaagcccacaggggcaagtttccaggcacagggtgacctactcgagccctgaggatggaatcc

SEQ ID NO: 4931 - DNA, 568 bp, Homo sapiens
agaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaag

SEQ ID NO: 4932 - DNA, 583 bp, Homo sapiens
actgcagcaagctgcgctacctcaacgcgaggggctgcgagggcatcacggaccacggtgtggagtacctcgccaagaactgcaccaaactcaaatccctggatatcggcaaatgccctttggtatccgacacgggcctggagtgcctggccctgaactgcttcaacctcaagcggctcagcctcaagtcctgcgagagcatcaccggccagggcttgcagatcgtggccgccaactgctttgacctccagacgctgaatgtccaggactgcgaggtctccgtggaggccctgcgctttgtcaaacgccactgcaagcgctgcgtcatcgagcacaccaacccggctttcttctgaagggacagagttcatccggcgttgtattcacacaaacctgaacaaagcaaatttttttaaaagcagcgtatgtaagcaccgacacccactcaaaacagctctttcttccgggaaggttattaggaatctggcctttatttttcctcatttctcatgggcaacagaggccaaagaaacgaagcaagacaaacagcagcgaggatccatcatcagaatcacagtgctct

SEQ ID NO: 4933 - DNA, 577 bp, Homo sapiens
  misc_feature (480)..(480): n is a, c, g, or t
  misc_feature (524)..(524): n is a, c, g, or t
  misc_feature (542)..(542): n is a, c, g, or t
  misc_feature (559)..(559): n is a, c, g, or t
  misc_feature (562)..(563): n is a, c, g, or t
gacacacaggcggcggctgcgggcgcagagcggagatgcagcggcttggggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttgncagacagccgtttgttctacatggctttgataattgtttgaggnaaggagatggaaacaatnttaaaatttccctcttnttnntttttttttttttt

SEQ ID NO: 4934 - DNA, 588 bp, Homo sapiens
acacatgaagaaagagcgggctgcaattcaaggactgtacaaagctgaaacgcagagattttcatattatttgggagactcagaaatgagcttttaaggttgttccttgacttgcgggtcaataagcgcacaatggtgaagaaaaggctgccttctagtgacacggtgttccggtttgagactccgggcagcccaaggaaggccaacgtggaggcctcacgcagctccacagacagccccagctcggtgttcctcagctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacaaggccaatatgcactttcacaagttgtttcttagtgtcccaacggaggaaccactgaagcaaagctttacctgtgctctacagaaagaaatacta

SEQ ID NO: 4935 - DNA, 581 bp, Homo sapiens
  misc_feature (7)..(7): n is a, c, g, or t
aacgatnacgtctgaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagttattcaatctcctgagcctaacagcaatgtagaaacggaactttttgcttttccaaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagatttaagaaaatgaaaaagaaacagcagtatccacagaagacgattcccaccataaggctgaaaaatcatcagtactaaggtcaaaagaggaaagccatgaac

SEQ ID NO: 4936 - DNA, 582 bp, Homo sapiens
  misc_feature (556)..(556): n is a, c, g, or t
cagttggagccagacagcggggtggacaagtggcgtgtgtgctgcgaccccgagggaagatgaacgggacgcggaactggtgtaccctggtggacgtgcacccagaggaccaggcggcggtgtacttgaaggggaggtctggagacaagatgattcacgagaagaatattaaccagctgaagagtgaggtccagtacatccaggaggccaggaactgcctacagaagctccgggaggatataagtagcaagcttgacaggaacctaggagattctctccatcgacaggagatacaggtggtgctagaaaagccaaatggctttagtcagagtcccacagccctgtacagcagcccacctgaggtggacacctgtataaatgaggatgttgagagcttgaggaagacggtgcaggacttgctggccaagcttcaggaggccaagcggcaacaccagtcagactgtgtggcttttgaggtcacactcagccggtaccagagggaagcagaacaaagtaatgtggcccttcagagagaggaggacagagtggagcaganagaggcagaagtcggagagctgcaga

SEQ ID NO: 4937 - DNA, 582 bp, Homo sapiens
  misc_feature (410)..(410): n is a, c, g, or t
  misc_feature (551)..(551): n is a, c, g, or t
agtgagtcggagctcggcctctccccggcacgttctcagccgctcctggttcagacccagcgagggagccgcgagcgaggctcaccgtccccggcgtgcaggatccggggctgctgagcgctcgctcccgcgtgtccggcgcttggagtccccgcggcaggagaggagtcgggacactagagctccaggggcgcctgtgggctccagggcctccggcttccccagtccccttcagctaaagccccagagacgtgctcagccccaggacctctgcggaacaagatccggattgagaagccactgcaactaccgaaatgggcagcaaaaccttgccggcgccggtgcctatccacccttccctgcagctcagctggcggccgtgggctccgggactaggagagcgggacggngacctcgggcctggggtctgcagggggcccggcctccgctgccgcgacactgcgagggagcagccagccaagagccgggcgttatattgcgattggcactttatgctgaccatcgggtacggacatttatcactggagttnttttttttttaactataaataaacggttatt

SEQ ID NO: 4938 - DNA, 582 bp, Homo sapiens
  misc_feature (22)..(22): n is a, c, g, or t
attactgttggagctacagggnaaagaaacagaggaggagactgcaagagatcattggaggccgtgggcacgctctttactccatgtgtgggacattcattgcggaataacatcggaggagaagagacggggttttgccatgctgcctagactggtcttgaactcctgggctcaaatgatctgcctgcctcagcttcccaagtttcccagagctatggggacttcccatccggcgttcctggtcttaggctgtcctctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccaga

SEQ ID NO: 4939 - DNA, 581 bp, Homo sapiens
gcagaacagggcaagagttctagccaagagctgggattgaaggatcaagaggacagtgatggtgacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcat

SEQ ID NO: 4940 - DNA, 582 bp, Homo sapiens
  misc_feature (566)..(566): n is a, c, g, or t
atattgctctggtattcatgccaaagacacaccagccctcagtcactgggagaagaacctctcataccctcggtgctccagtccccagctcactcagccacacacaccatgtgtgaagaggagaccaccgcgctcgtgtgtgacaatggctctggcctgtgcaaggcaggcttcgcaggagatgatgccccccgggctgtcttcccctccattgtgggccgccctcgccaccaggtgcgtgctcatctggataccaccaggctttgagccactaggaatctggcaccactccttctacaatgagctgcgtgtagcacctgaagagcaccccaccctgctcacagaggctcccctaaatcccaaggccaacagggaaaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttgngctggccgtgacctca

SEQ ID NO: 4941 - DNA, 583 bp, Homo sapiens
  misc_feature (516)..(516): n is a, c, g, or t
tcctcccgcgaatcgcagcttctgagaccagggttgctccgtccgtgctccgcctcgccatgacttcctacagctatcgccagtcgtcggccacgtcgtccttcggaggcctgggcggcggctccgtgcgttttgggccgggggtcgcttttcgcgcgcccagcattcacgggggctccggcggccgcggcgtatccgtgtcctccgcccgctttgtgtcctcgtcctcctcggggggctacggcggcggctacggcggcgtcctgaccgcgtccgacgggctgctggcgggcaacgagaagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaacgcccgtctggctgcagatgacttccgaaccaagtttgagacggaacaggctctgcgcatgagcngtggaggccgacatcaacggcctgcgcagggtgcctggatgagctgaccctggccaggaccgacctg

SEQ ID NO: 4942 - DNA, 587 bp, Homo sapiens
ggacaggttttaaatgagtgttttcattcctcgcctgcggtttggcgggacagcgctgcagcccatggtgtggagcgcggctgggggaccagggggagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgta

SEQ ID NO: 4943 - DNA, 579 bp, Homo sapiens
gttgctgatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagggcggtccaggcggttctagcactggatttggaaactttgaggaaattgggccattcagcgagggaccatcaagtgcaactttgcgggggttgccttgggtgattcctggatctcccctgttgattcggtgctctcctggggaccttacctgtacagcatgtctcttctcgaagacaaaggtctggcagaggtgtctaaggttgcagagcaagtactgaatgccgtaaataaggggctctacagagaggccacagagctgtgggggaaagcagaaatgatcattgaacagaacacagatggggtgaacttctataacatcttaac

SEQ ID NO: 4944 - DNA, 581 bp, Homo sapiens
atttttgctccccttcctttctccctctcccttcccggctcctagactgggtctaggcaggagcttcgccatgatgtcaggagggaaggagatgcctctgggcctcgtaccacagcctcagctctctctctgcccctccatctgagtccctcctggctcccagctccctcagggtgcaaggccaagcctccaaggaatccctccccttacctgcatggctggagccaagaagagccactccatctgagggtggctgcgtgtccacatatgaggggacagggctgaggatgaggagaaccctggggacccagaagaccgtgccttgcccggaagtcctgcctgtaggcctgaaggacttgccctaacagagcctcaacaactacctggtgattcctacttcagccccttggtgtgagcagcttctcaacatgaactacagcctccacctggccttcgtgtgtctgagtctcttcactgaaaggatgtgcatccaggggagtcagttcaacgtcgaggtcggcagaagtgacaagctttccctgcctggctttgagaacctcacagcaggatataacaaattt

SEQ ID NO: 4945 - DNA, 582 bp, Homo sapiens
agttgctttgggaagtgtttgggaccagatggattgtagggagtagggtacaatacagtctgttctcctccagctccttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaacta

SEQ ID NO: 4946 - DNA, 582 bp, Homo sapiens
  misc_feature (570)..(570): n is a, c, g, or t
ccatttcaaaaagggagacagcctctaccgcgattgtagaagagactgtggtgtgaattagggaccgggaggcgtcgaacggaggaacggttcatcttagagcctcgaggtgcataccggacccccattcgcatctaacaaggaatctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacgaactgacgagtttgtctaggaaacatttccgtcaccttgacttgtctgaactgatcctggtgggcaatccatttacatgctcctgtgacattatgtggatcaagactctccaagaggctaaatccagtccagacactcangatttgtactgc

SEQ ID NO: 4947 - DNA, 496 bp, Homo sapiens
agcacggagcgggcgctcggttgctgcgcacaaaggctgaggctccaagagctgcagggcgtgtttggggtgcgcgcgaggttgtgtgcaaggccaccatggcagagctgcaggaggtgcagatcacagaggagaagccactgttgccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaaggcatgggccacaaggccacat

SEQ ID NO: 4948 - DNA, 582 bp, Homo sapiens
  misc_feature (526)..(526): n is a, c, g, or t
cctgccgcccagacccgcacagagcgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactcaaggagctcatcaacaatgagctttcccatttcttagagtgagaaggtgctgttgagaggttgggctgcaggaacccaccatctctggacgctgcggaccatcctctacaggggctgctgtccctgccagaagtacaagcaacacaattgccagactttcctgccaccaaaaggaggaatcatcatctaataattggattgcggggggtaaggccttgggcccccaggcagtatctggacataccccacctgtacccaccagcatggacagagacagcaggaaggctattgggctctcaagccctggactatgtgccctcctgaccccatgcccctgcctggggaaaggggagcantgaggacggaagtggagaattttgtgatcctgggctcccctggccctctgtgcagc

SEQ ID NO: 4949 - DNA, 582 bp, Homo sapiens
tactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaagagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagcctaacggcagtggtcaagtagtagggaaagtgcctggccatttcactcctgtcttggcaccctctccccatccagtgcag

SEQ ID NO: 4950 - DNA, 583 bp, Homo sapiens
atttggggatgtttctgccttgctagcagtgccagagagaacttcatcattgtcacctcatcaaagactactttttcagacatctcctgtagggctagattcagagagcagcttctgatatttggaggatcttgtaacctcgtaatatggctcttaaaaacgcactagtattcccactttctgaagtttgtagaagctgctatatatttctgtgatctttagacagtgactgagtatggatcatttgaacgaggcaactcaggggaaagaacattcagaaatgtctagcaatgtgagtgatccgaagggtccaccagccaagattgcccgcctggagcagaacgggggcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctg

SEQ ID NO: 4951 - DNA, 582 bp, Homo sapiens
tccttcccttggccccgcgcgctcgctcgctcgctcctcgcctcgctctcccctttaaacgcccacttcgtatggggaaagaggacaacttgaagtcaagttgcaattaacttccgcggcagccgcagctccggcggcggcggcggcggcaggagaggcagaagccgccgcctcggaagtccgacgccggcgcgcccgcccggggagccgttcttggtttcaggcccgcactcgtcagccaccgccgcccccaacgtccatgcctgagtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaagatattgaaattgtgtattatgagcaccagtttggttaagtactttttgtggaaccagttagagctaatatctaaaaaagg

SEQ ID NO: 4952 - DNA, 582 bp, Homo sapiens
agaatttgatgagagagggatccacaaaaacatgacaaatgatgagagttcaaaccttaagagaaaaatgggcttattggagacggaggcaattgtcattaaaacaagccgatttcaaggatatattcaaaaaatcaacttcaggatctctcgtggaagaggaagaccaacacatgaaattgtcccttggaggcagcgaaatgggcctctcatcccatttgcagtcttccaaggcaggacctacacgcatctttaccagcaatacccacagttctgtggtgttacagggctttgaccagcttcgacttgaaggattgctttgtgatgtgaccctgatgccaggtgacacagatgatgctttccctgtgcatagagtcatgatggcatctgctagtgattacttcaaggctatgttcacaggtggaatgaaagaacaagatttaatgtgcattaaacttcatggtgtgagcaaagtcggtctaaggaaaattattgatttcatttatactgcaaagctttctcttaatatggacaaccttcaagacacgctggaagctgccagtttcctacagattctgccag

SEQ ID NO: 4953 - DNA, 583 bp, Homo sapiens
gtgacatcgccggtgtttgcggggggttgttgctctcggggccgtgtggagtaggtctggacctggactcacggctgcttggagcgtccgccatgaggagaagccattctttgagctgctagttgtaatttaagaagaataggccaggcatggtagctcacgcctgtaatcccagcaatttgggaggccgaggcaggtggatcacttgaggtcaggagttcgagaccagcgtggccgacgtagtgaaaccccatctcaatggctttttaactttagccattctttgagctgccgggtgcaatttaagaatactaggcccgggcgcagtggctcatgcctgtaatcccagcactttgggaggccgagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcacaagcatatccgtctgtcagaaagagctg

SEQ ID NO: 4954 - DNA, 583 bp, Homo sapiens
aaatagcctgcagacctccaccaccaggagcactggacactccaacaagcacaagaggcgggccaaaacacctttggggaaaagggatatagaggaagagctctcaggcctgaaccagctcacacagaccacacacacagacaaagtaccaggagatgaggataaaggcatcaacgtgctcagggaaactgctgaacaaaaactggacccagtagcaagagtcactggtagcaagaggcagccaagaactcctaaaggaaaagcccaacccctataagacttggctggcttgaaagagctcttccagacaccaatatgcactgacaagcccacgactcatgagaaaactaccagaaatagcgctgcactatctccacaaccagacccactgggtaccccaacaatcttcaagccacagtccaagagaagtctcatgaaagcagacgtacaggaagaatccttagcactcaggaaacgaacaccatcagtagggaaagctatggacacacccaaaccagcaggaggtgatgagaaagacatgaaagcatttatgggaactccagtgcagacattggacctgcca

SEQ ID NO: 4955 - DNA, 581 bp, Homo sapiens
atgagatggagcttctacggctcagcagtccggggctgattcatttctgcagcgtctccttgaaccgctattcactctgattttctatccctgtgtctgggccggctccacctttatcctgagtgtcagactggattataggatctcatatatgctgtcaatatataagaaggagtttggagaggacaatgacaatgcggagacatctgccagtggatctccagacactttactaccatcagctattgttcctgatatagatgaaattgcagctcaggcagaaactatgtttgcgggaagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtgcaattactggtgtctaatcaagacgtagataactacaagcaaatcaaggcagatctagaccagcttcgactgacagtagaaaagtctgagctatgggtggagaagagcagca

SEQ ID NO: 4956 - DNA, 580 bp, Homo sapiens
gcaacaccacccagtgtggagcagcccaaccaagcactgtcaggaatcctgtgaagcatctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatcgtgggaatgggacaaaaagacagctacgtgggtgactaatcacaaaacaaaagaggaatcctgaccctgaagtacccgatagaacatggcatcatcaccaactgggacgacatggaaaagatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagagagtttaccaagttgcctgatgggcaagtgatcaccatcggaaatgaacgtatccgctgcccagagaccctgttccag

SEQ ID NO: 4957 - DNA, 582 bp, Homo sapiens
attgctctggtattcatgccaaagacacaccagccctcagtcactgggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacag

SEQ ID NO: 4958 - DNA, 579 bp, Homo sapiens
  misc_feature (427)..(427): n is a, c, g, or t
gctcgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggctgagaaggcagcagatgagagtgagagaggcatgaaagtcattgagagtcgagcccaaaaagatgaagaaaaaatggaaattcaggagatccaactgaaagaggcaaagcacattgctgaagatgccgaccgcaaatatgaagnaggtggcccgtaagctggtcatcattgagagcgacctggaacgtgcagaggagcgggctgagctctcagaaggcaaatgtgccgagcttgaagaagaattgaaaactgtgacgaacaacttgaagtcactggaggctcaggctgagaagtac

SEQ ID NO: 4959 - DNA, 580 bp, Homo sapiens
  misc_feature (560)..(560): n is a, c, g, or t
gaacaccacccagtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactntcctgctcctctctgtctct

SEQ ID NO: 4960 - DNA, 584 bp, Homo sapiens
agtggacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggaagaagatatgagtgagcctcaggagaaaaaactctcagagaacactgattttttggctcctggtgttagttccttcacagattctaaccaacaagaaagtatcacaaagagagaggaaaaccaagaacaacctagaaattattc

SEQ ID NO: 4961 - DNA, 655 bp, Homo sapiens
  misc_feature (2)..(2): n is a, c, g, or t
  misc_feature (165)..(165): n is a, c, g, or t
  misc_feature (287)..(287): n is a, c, g, or t
  misc_feature (320)..(320): n is a, c, g, or t
  misc_feature (371)..(371): n is a, c, g, or t
  misc_feature (387)..(387): n is a, c, g, or t
  misc_feature (402)..(402): n is a, c, g, or t
  misc_feature (413)..(413): n is a, c, g, or t
  misc_feature (422)..(422): n is a, c, g, or t
  misc_feature (441)..(441): n is a, c, g, or t
  misc_feature (464)..(464): n is a, c, g, or t
  misc_feature (470)..(470): n is a, c, g, or t
  misc_feature (477)..(477): n is a, c, g, or t
  misc_feature (490)..(490): n is a, c, g, or t
  misc_feature (494)..(494): n is a, c, g, or t
  misc_feature (498)..(498): n is a, c, g, or t
  misc_feature (506)..(506): n is a, c, g, or t
  misc_feature (512)..(512): n is a, c, g, or t
  misc_feature (514)..(514): n is a, c, g, or t
  misc_feature (520)..(520): n is a, c, g, or t
  misc_feature (522)..(522): n is a, c, g, or t
  misc_feature (537)..(537): n is a, c, g, or t
  misc_feature (540)..(541): n is a, c, g, or t
  misc_feature (549)..(549): n is a, c, g, or t
  misc_feature (551)..(551): n is a, c, g, or t
  misc_feature (558)..(558): n is a, c, g, or t
  misc_feature (565)..(565): n is a, c, g, or t
  misc_feature (574)..(574): n is a, c, g, or t
  misc_feature (580)..(581): n is a, c, g, or t
  misc_feature (583)..(583): n is a, c, g, or t
  misc_feature (590)..(590): n is a, c, g, or t
  misc_feature (594)..(594): n is a, c, g, or t
  misc_feature (596)..(596): n is a, c, g, or t
  misc_feature (598)..(598): n is a, c, g, or t
  misc_feature (636)..(636): n is a, c, g, or t
  misc_feature (642)..(642): n is a, c, g, or t
  misc_feature (649)..(649): n is a, c, g, or t
  misc_feature (651)..(652): n is a, c, g, or t
gnagcactgcctgtaaagccctcgcatgagaggccagcctgctagggaaaatccaggaatctgcaacaaaaacgatgacagtctgaaatactctctggtgccaacctccaaattctcgtctgtcacttcagacccccactagttgacagagcagcagaatttcanctccagtagacttgaatgtgcctctgggcaaagaagcagagctaacgaggaaagggatttaaagagtttttcttgggtgtttgtcaaacttttattccctgtctgtgtgcagaggggattcnacttcaatttttctgcagtggctctgagtccanccccttacttaaagatctggaggccgagagagctcaatccattgcctatcncctcaaaattgaggancaaagaaaaaaagtncatgaaaatgnaaaatatangtaccactgaagcctgganagcaccaagaagccaagaaagcngagaantcttcanatgaggaggaaantgcntcgnaacgtcanttagcncnttccananactgaattggcggantcnngaagggtntnactgggnctataanctttccgcngccccnngnaggacgnaagnananggaacttgttttcttgaaaggctcctgcttcctttggnaacctntgctgantnnaat

SEQ ID NO: 4962 - DNA, 499 bp, Homo sapiens
ctgatctgggcccacaagagcgtatgcaaatctctaagtttacgggactctcaatgaccactatcagtcactggctggccaacgtcaagtaccagcttaggaaaacgggcgggacaaaatttctgaaaaacatggacaaaggccaccccatcttttattgcagtgactgtgcctcccagttcagaaccccttctacctacatcagtcacttagaatctcacctgggtttccaaatgaaggacatgacccgcttgtcagtggaccagcaaagcaaggtggagcaagagatctcccgggtatcgtcggctcagaggtctccagaaacaatagctgccgaagaggacacagactctaaattcaagtgacgaatgccttagtttccactttccagcctggatcccctcacactgaacccttcttcgttgcaccatcctgcttctgacattgaactcattgaactcctcctgacaccctggctctgagaagactgccaaaaaaa

SEQ ID NO: 4963 - DNA, 318 bp, Homo sapiens
  misc_feature (66)..(66): n is a, c, g, or t
  misc_feature (121)..(122): n is a, c, g, or t
  misc_feature (149)..(149): n is a, c, g, or t
  misc_feature (151)..(151): n is a, c, g, or t
  misc_feature (159)..(161): n is a, c, g, or t
  misc_feature (163)..(165): n is a, c, g, or t
  misc_feature (167)..(167): n is a, c, g, or t
  misc_feature (170)..(171): n is a, c, g, or t
  misc_feature (173)..(175): n is a, c, g, or t
  misc_feature (197)..(199): n is a, c, g, or t
  misc_feature (227)..(227): n is a, c, g, or t
  misc_feature (245)..(245): n is a, c, g, or t
  misc_feature (282)..(282): n is a, c, g, or t
  misc_feature (299)..(299): n is a, c, g, or t
tctcacagaaagttctccgctcccagacatgggtccctcggcttcctgcctcggaagcgcagcagngggcatcgtgggaaggtgaagagcttccctaaggatgacccatccaaccgcactnncctcacagccttcctgggatacaaggngnggccgggnnngnnnanggnncnnnaaaagtcaacaggcccggaccnnnaaggtgaacaagaaaggaggtggtggangctgtgaccattgtaaanacaccacccatggtggttgtgggcatttgtgggcctnggggggaaacccccttnaagggcttccggacctttt

SEQ ID NO: 4964 - DNA, 1060 bp, Homo sapiens
  misc_feature (578)..(578): n is a, c, g, or t
gcatcttgtagacctcgctggatcgaaagacagaagaaaaccaaggctgaaggggatcgtctaaaagagggtattaatattaaccgaggcctcctatgcttgggaaatgtaatcagtgctcttggagatgacaaaaagggtggctttgtgccctacagagattccaagttgactcgactgcttcaagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtacaacagctacaagtcttgttgctacaggcccatggaggtaccctgcctggatctataacggttaaaagaggaattcagccgggcgcggtggctcatgcctgtaaccccagcactttgggaggccgaggtgggcggatcacaagtgtggaaccatcagagaatctacaatccctgatggagaagaatcagtccctggtagaggagaatgaaanattaagtcgtggtctgagcgaggcagctggtcagacagcccagatgttggagaggatcattttgacagagcaagcgaatgaaaaaatgaacgccaagctagaagagctcaggcagcatgcggcctgcaaactggatcttcaaaagctagtggagactttggaaagaccaggaattgaaagaaaatgtagagataatttgtaacctgcagcaattgattacccagttatcgggatgaaactggttgctgcatggctgcagccattgatactgcgggggagcaaagaaacccaagtagaaaacagtccagaagaccaacaggtcttctgacgcttttaccactcagcatgtctctccggtcaagcgcaaatgtctaaagaagctgggtttgaatttaataaaagcgccttgccctggaaaaaagcccctgggctaggaaatatgacttccaaattgacagccaactggcggccccattcagtac

SEQ ID NO: 4965 - DNA, 1178 bp, Homo sapiens
gaggctgaggctgaggcagagaatcttccagatgataaaccccagcagccgactcgaccccaggagcagagtacaggagacaccatggggagagaccctggtgtgtccttcaaggctgttggtctacaacctgctggagatgtaaatttgccatgacttcctggaggacagcagcatggagaaagatcctagaaaaggaaagactgtgaactcctgagttcagcttgatttctgactacatcccagcaagctctggcatctgtggattaaaatccctggatctctctcagttgtgtatttgttcatcttcatatgctggcaggaacaactattaatacagatactcagaagccaataacatgacaggagctgggactggtttgaacacagggtgtgcagatggggagggggtactggccttgggcctcctatgatgcagacatggtgaatttaattcaaggaggaggagaatgttttacgcaggtggttatatgtgggaagataattttattcatggatccaaatgtttgttgagtcctttctttgtgctaaggttcttgcggggaaccagaattataacagtgagctcatctgactgttttaggatgtaccgcctagggttaacattccttggtatctttttgggggcctaatcctaaaaccttttctccatccaccgggttttcccgatgggtcatattattaataattcccttttgcacagaatttcccaagaattggggcttttttgggtccattcccacctaattgggaaatggggtttttgggatttccaattgggacccctccgagaaggggatgaccctttttggaatccttttctccccaccctttttccggggtttttttcggggatttgtgggagaaagaaaatggttagcccctttctttatttggttcgcaccccggcttaacacttttcttaatctccgcagagggaagatccaacacctttccgccggtaattttttggggagaaccccttgtaaaatctgggcgcttctcccccccgccaattaaaaaaatattttgctaaggggggtcgaaaagaaaaccaccagagaagagcgcgacgataattgtctcggggggggtatttcttatattttcccccgcgcgggcgcgcgcaaaaaaaaaaaaaacagcttcagattgtt

SEQ ID NO: 4966 - DNA, 1193 bp, Homo sapiens
  misc_feature (25)..(25): n is a, c, g, or t
  misc_feature (1126)..(1126): n is a, c, g, or t
ggtccggaattccttcagatggacngccagtgccatggattttagaacctgcattgccagttgactgcctgctttgtgctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggctctctgcgcccttgttgccaccatctggttccctgtgtgcgcccaccgtgagaccaccatcgtgagctttggctactccctgtatgcaggctggattggtgctgtgctgtgcctcgtgggtggctgtgtcatcctctgctgcgctggagatgcccaggcctttggtgaaaaccgtttctactacactgcgggctctagctccccgactcatgcgaagagtgcccacgtataagagggctgcccggctgcccacagagaagtctcggtctgttgcccaggctggagagcagtggtgcgatctcggctctctgcaacctccgccccttgggttcaagcgattcttgtgcctcagcctccccagtagctgggactacaggacattcatgctcatgacatcacatgctgagaagacagggaggccagtgtggggctggcctctaaaagaggcggcatcagggctaccattgagatgtccccacaaaaagagtgtgtgaccgccccaatgtgcagcttaatggaagactgaaccacggattgggggtgggaaccattgggacctgcctggcctatggctttgaaataacaacctctttgaaggaaatccaatattttctcctacccccatggcagaaatcttaaaaagctcttggccttttttgggcttccttgggcttgggggaaaggaaattgcaaaaacctcagcaaaatcttaccctcccatccagtgccccccttcgtctcaaatgggcaacaatttgcacaaagtgttacaacccgtgtagccagactactccgaagaaggctacccaactacttatcccgccagccccagtaccccaactagacgcggtatagccctatggtagcagagcgacggagcggngtagtatatggctcaaactgcttgttattgctaacagtgcgttcgcacttctcgcagacgcggactc

SEQ ID NO: 4967 - DNA, 908 bp, Homo sapiens
atagaggaggcggcattacccaaagccgcacagctggtaaatgggaaaagaggggtttaaagcattcaggcacatagagccttctgcagcggcccctctccagccagcacttgacaggacagatgggggctaatctggccctgctaagcagcgacatgcctctcctggagaaggcaggggcttcctggaacttgccccagccttatcagcggaggtttgccccaacacatcccagaaacgagcaaaggttcagcgccgtgcagttggcaggtgtcgggatcatcagtcatccccttgtacgtgccctggaggaggccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaacaataacccccaagaggagatgaacgagttcagcaccccgttggccggccagggccatgggggagatggacgccacaccgggtgtggcacctggacccgtgtgtctggcagagaaggagggaacacgtcacaaggccctggggggaaaagaaaccccccggggaatgtcgagggtcttgggcttcttcccccaaggaccggaaggtaagctgccaccaaacaaagggtggggctcctcccaaccaagaaaaaaatc

SEQ ID NO: 4968 - DNA, 881 bp, Homo sapiens
aggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctggaaaagaccattgatgacctggaagatgagctctatgcccagaaactgaagtacaaagccattagcgaggagctggaccacgcccctcatgacatggacctctatataattatcaccgttttctgctctggttctggatctggccccctttactcctcgggggaacccaagggccccactcctcgctctggaattccatttg

SEQ ID NO: 4969 - DNA, 543 bp, Homo sapiens
ctgccgctactactacctgcagcgccagttcactcctccagctccatgaagggcttgggtggtggctttggtggtggctttgctggtggtgatgggcttctggtgggcagtgagaaggtgaccatgcagaacctcaacgaccgcctggcctcctacctggacaaggtgcgtgctctggaggaggccaacgccgacctggaagtgaagatccgtgactggtaccagaggcagcggcctgcttagatcaaagactacagtccctacttcaagaccattgaggacctgaggaacaagattctcacagccacagtggacaatgccaatgtccttctgcagattgacaatgcccgtctggccgcggatgacttccgcaccaagtatgagacagagttgaacctgcgcatgagtgtggaagccgacatcaatggcctgcgcagggtgctggacgaactgaccctgggcagagctgacctggagatgcagattgagagcctgaaggaggagctgtgctaactgaagaagaaccacgaggaggagatgaat

SEQ ID NO: 4970 - DNA, 617 bp, Homo sapiens
tgctgtggttgatcttgagtatcccccgatgggtccctgctgcaggagcaggcaccaagactgtgaggcagaacctggagccgttgttcgagcagcacatcaacaacctcaggaggcagctggacagcatcgtgggggaacggggccgcctggactcagagctgagaaacatgcaggacctggtggaagacttcaagaacaacctctgaaagctcaaaaaagaacactagagaaattgactagggatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaaca

SEQ ID NO: 4971 - DNA, 835 bp, Homo sapiens
agccggccccaggcagcgtgtgtccgtcgcctagtctggagaactagtcctccactcacggtgagggaatggaccgacacgggtattgtaccgctgagggaaaggagcgggactccggacctccaggagtgcaaggatgatgctgaaaggaataacaaggcttatctctaggatccataagtgcaaggatgatgctgaaaggaataacaaggcttatctctaggatccataaggctttgcaagcaagactgaagtctggatggagggacaaaagtttaccttcttgggatacatcgcaacatatagcttttaagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggcgaagacattcagtgaagcttgcctgatggcaaggaaaccagccctagaacttctgcattacctgaaaaacaccagttttgcttatccagctatacgatatcctctgtatgggacagaagggaacacgaaaaacccctagtctttgcccatgttattccatttctgtgccaaaccaggactggctgcatactaccatattccagatgctccatcctttgggtggaaaaaaattggccggggattctctccggcagtcccagcctaccaacaaaaccagccgccctttggaatccc

SEQ ID NO: 4972 - DNA, 864 bp, Homo sapiens
  misc_feature (814)..(814): n is a, c, g, or t
cgtgtgtgagaggtcgcgcagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgcttgaagaattggttggttgggagaagggataccagaggcatgaagatgcttttgaaggctattgcagtaatctagacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaaaccagcatgacataacagtgcagggcaaaatattcactgggccaattcaatacaacaatctccttaaattgggttcatgatgcagtcttcctcttttaaanacaaaccaaaccaaaccaaaactatactttggaacaaaaaggggtcaaaa

SEQ ID NO: 4973 - DNA, 873 bp, Homo sapiens
  misc_feature (704)..(704): n is a, c, g, or t
ttgacttttttgtcttacattatatttttatagattttgttataaacatggtgctgggaaaggtgaagagtttgacaataagctttgactgtcttaatgacagcaatgtccctgtgtattctagtggggataccgtctcaggaagggtaaatttagaagttactggggaaatcagagtaaaatctcttaaaattcatgcaagaggacatgcgaaagtacgctggactgaatctagaaacgccggctccaatactgcctatacacagaattacactgaagaagtagagtatttcaaccataaagacatcttaattgggcacgaaagagatgatgataattccgaagaaggcttccacactattcattcaggaaggcatgaatatgcattcagcttcgagcttccacagactcaccccaagcaggcacaaaagaaaagacactctgttgctggttctgtacctcaggcccaatatccttaagtgccaaaattgaaaggaagggctataccccaggtgaatcaattcagatatttgctgagattgagaactgctcttcccgaatggtggtgccaaaggcagccatttaccaaacacaggccttctatgccaaagggaaaatgaaggaagtaaaacagcttgtggctaacttgcgtggggaatccttatcatctggaaagacagagacgtggaatggcaagttgctgnaaattcaccagtttctccctctatcctcgactgtagtataatccgcgtggaatattcactaatggtatatgtggatattcctggagctatggatttatttcttaatttgccacttgtcatcggtaccattcctctacatccatttgggtaccagaccctccagtggtac

SEQ ID NO: 4974 - DNA, 1063 bp, Homo sapiens
acgctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactcaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggccttgcagccctagtaggagctgagcctttccagcccgtgttgtacctaattaggaaagctttgattttgcttttgtgatttggaaaaattggaaaacctcctttccaaaaggctggttttaaacgggcctgcattcattcttttctggctatattaaagccctgttgtgtaagcttggactgggcccccggggaattcttgtttaacaggtaaccttaaggaagtcaaggtcctccagggaataaaggcgtggcacccggtggcagcccccgcccatggggcccggggtaagaccccctaaaccccggaagggaaacccctggacctacaggaacaattacccccccgggggccaccccctttaaaaactttccccctacacccttgtaacagaacaaaaaaggcccctttattcccacgccatctttttttgggttgcggcaaagaaatattctagcggggggccccgccttcttaaaaaattattcccctccggagggggtgcgcccaagatttcttaccgcggtttcaccccaaaccctttttctgtgtgatacaaagcgggggcgcgcccttataaggggggagctcgcggacataaataaacgcgccgagggcaccct

SEQ ID NO: 4975 - DNA, 541 bp, Homo sapiens
ccacgcgtccgatccttgcgactggtcccctgggtgatctgtcttcttctctgtccctatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaacagaaaaaaaaaaaaaaag

SEQ ID NO: 4976 - DNA, 340 bp, Homo sapiens
gtcaccgcctgaggccaagtccccagagaaggaggaagcaaaatctccagctgaggtcaagtcccccgagaaggccaagtccccagcaaaggaagaggcaaagtcaccggctgaggccaagtctccagagaaggccaagtccccagtgaaggaagaagcaaagtcaccggctgaggccaagtccccagtgaaggaagaagcaaaatctccagctgaggtcaagtccccggaaaaggccaagtctccaacgaaggaggaagcaaagtcccctgagaaggccaagtcccctgagaaggccaagtccccatagaaggaagaggccaagtcccctgagaaggcc

SEQ ID NO: 4977 - DNA, 595 bp, Homo sapiens
gctacaacaaccgccgagacctgaactttgagcgtggaggtgatatcaccctcaggtgtcctgtgatgctggtggtaggagaccaagcacctcatgaagatgcagtggttagtagggaattttggggtgagtgagggaggagggttggggtcctaaagtggtggtcagaagagtatcttgccaaggggatgtcctgtttggcacagggagatcaactttggggcactaagaatttgattcctggtaaggaggaactgggtagggagctgatagaaaagggactggggtctgggttcctgggtcccttacgggggaggcgccacagtgggcgtgacctcattcattcagcctcctgcttactccaggtggaatgtaactcaaaactggaccccacccagacctcgttcctcaaggtcagtaacctgttcctgggcccccgttcacagtcatatatgctctctacatgcagctgctaagcctgcagggcccggcatgggagcaaatggggtgaacgaagaacaaaacaaaggggctacagtgaacaagctagggaagagagaccctttgcacctctctgcatggctcatttatgtgt

SEQ ID NO: 4978 - DNA, 937 bp, Homo sapiens
agaggaggcggcattacccaaagccgcacagctggtaaatgggaaaagaggggtttaaaggtacgtgccctggaggaggccaatgctgacctggaggtgaagatccatgactggtaccagaagcagaccccagccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagccagactgaggagctgaacaaagaggtggcctccaacacagaaatgatccagaccagcaagacggagatcaccgacctgagacgcccgatgcaggagctggagatcgagctgcagtcccagctcagcatgaaagctgggctggagaactcactggccgagacagagtgccgctatgccaccccgctgcagcagatccaggggctcattgggggcctggaggcccacctgagtgaacctccaatgcagatggaggctccaacccaggagtccagaggcctgcttgacctaaagaccccggctggagcacggagatccctaattaccggagcctggttaagggcccagt

SEQ ID NO: 4979 - DNA, 958 bp, Homo sapiens
ctgcttcagaccaccagctcctctgggctcagctcttcagcccaggagtggaaatgaagaagatcactgacacccacacgccgtctggcctcaccgtgaacctgacgctctattacatgctctcctgctcgccagccccactgctcagcccctccctgagccacagggagcgagaccagatggagtcgacgctcaactatgaagatcactgcttcagcgggcacgccaccatgcacgccgagaacctgtggccggggcggctgtcctccgtccagcagatcctgcagctctctgacctgtggaggctgaccctccagaagcgtggctgcaaggggctggtgaagttccaggccgaccccgacgtgctgcacaacagctatgcattgcatggcatccgctacaagaacgaccatatcaacctggccgtgctggcggatgccgagggcaagccctacctacacgtgtccgtggagtcccgtggccagcctgtcaagatctatgcctgcaaggcaggctgcctggacgagccagtggagctgacctcggcgcccacgggtcacaccttctcggtcatggcgacaccgcccactacgccactgctctacatctccaccgacctcacacacctgcaggatctgcgggacacgctgcccctcgagcgcctccttgcccacgcagacgccatggcccaccaaggacccagggcggcccttcttcgtccgggtacagggggggcagccgaagacaccccgttgaacgctcttaccgcttcgaagctcctccacgccccacctccgtctcgggtactggatcgtacgtgcacgtcttgccggcgcttatttcatatcccgccaggtttcgcggtgacccccccgctcgccctgtcgaccgcacctcccgataggccccatgcaaagcctcgcgtcccgtgctgcgcccctcccccgccttcatgccc

SEQ ID NO: 4980 - DNA, 1400 bp, Homo sapiens
  misc_feature (742)..(742): n is a, c, g, or t
  misc_feature (764)..(764): n is a, c, g, or t
  misc_feature (867)..(867): n is a, c, g, or t
  misc_feature (1064)..(1064): n is a, c, g, or t
  misc_feature (1400)..(1400): n is a, c, g, or t
cactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccacctgaccaggacctaatcaagctgtgccaacctacagatgacgtttcaccgtgttagccagcatggcctcgatctcttgaccccatgacccgcccgtctcagcttcccaaagcgctggattacaggcgtgagccactgtctccgtgctctacttctctctcttcaaaatggggtgatactacatgccgagacttgcagtggttaaatacactgatcaaactgtgccaaaactcatactccttggccagggtccctgtgcccacatttacccaaatgcttccctcacgcccctggacactctatcagcgctccctatgtgttgttccgcacgctccaaaaattcctaaaattttttctgcccaccgtaggaacggccgtttttcgcttcacacattgcgtttgttccacctcccgttctccgaatctctcttccaacaggccctgtgcccacttgagcctcccctctcccattnttttataccgcgcaaatgacangcccccccgctgttctcctttttctcatccccctcgccctttggactcgggcactctactcccggcgatcaacatccttcgtgcgacgcgcgtcataccacangcccacgtcggccggcccgtccgggttgggccacacactcctccctccccacaacaagtacaacgttttttcaacgccctcagcaaatcgcccaataactccccccccctcttggcgcgcacccttgtgggccccttcctactcactgtcggcgccagcacttgtgtcgtcctcatacctcttcgtcgccctcgttntaccccgcggcgtcgtggccccccctcaccctccctcacatatatcactccacctcgcgctcgtggccgacgagtcccactctcatatctccgctcctcacagtacctccgcgtcttcttctgctgtgcgctctgcggtatttaacgcgcgcacatatccctctactttcgacgaggccactctttcctatctgcagaacataaggcgcctccacgagaccctaaccaaattttgctcttttggtccaatatacgcgtgctcgctgccgttatcgtcgttgtggcaactcctcggccgaacgcctgagatatttctgttctgctcctacgaccctn

SEQ ID NO: 4981 - DNA, 933 bp, Homo sapiens
  misc_feature (895)..(895): n is a, c, g, or t
tcaaccggggtccccctccagcgaccctaaagcttcccagacttccgcttcaattcctgtccgccccccacgcccacctcaacgtggagcgcagtggtctccgaggagcgccggagctgccccgcctgcccagcgggatcagcacttcgcatcaaggcccaagaaaagcaagtcctccagcgttctgagcacccgggcctgagggaaggtcctaacagcccccgggagccagtctccaacgcctcccgcagcagcccgccgctcccagaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccagggcggtgctgtctctctatgcctctggacgcacaactggcatcgtgctggactctgggagatggtgtcacccacaatgtccccatctatgagggctatgccttgccccatgccatcatgcgtcttggatctgggctggcccgagatctcactgactaccctcatgaaggatccctgaactggagcgnggggctaattcccttccggtacctactggccggagcgg

SEQ ID NO: 4982 - DNA, 983 bp, Homo sapiens
  misc_feature (685)..(685): n is a, c, g, or t
  misc_feature (733)..(733): n is a, c, g, or t
gacttgtgcgtcctggctgcgtgtctcaggcagggctttcgtgctcgcagtgtcggggtgggaaacctgtgccggatgtccgaggggctttgcagaaagcctggcagtgggcggcgtgacctctgcctgggggcggagtggctccttggggctggaaggcagttctcttgagttgggggagatcttagctggggagagggaggcgggggaagtgtgctcctgcatttcgtgacacgtacccttcggaggcgcccgcggcccccgcctgtctgagtctggggatcgtaagcaggggggcagcctggcccatggacagcgtcagtccgcctggagaaactcccctggggatcggctgtgtcccacctgctggggacggtgttggggcacagagaggcgataaactaagtgaaagcaaagagcagcgttgtcttctgccattcttttggaggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatcccgaaacaccaatgagtacaccgaggggccctactgtcngtcccaggaccctgggctcaagccctgctcctcgcccctccactcagnaaagacacggagagactccacgggtctgccttgaaccccgccccgccctcctagggctcccagcactccgcagggtccatttctttctgcacgaagacctcctctggtccaggatccccataagccaccgggtcaccctcacggggccccgggagccattaccgaagggacaagttcccaggcaggcaggtctccttctgaaaacgaaaactgcgctagggaatcatccccttctcccctccggggggcc

SEQ ID NO: 4983 - DNA, 1017 bp, Homo sapiens
  misc_feature (718)..(718): n is a, c, g, or t
  misc_feature (821)..(821): n is a, c, g, or t
  misc_feature (882)..(882): n is a, c, g, or t
  misc_feature (954)..(954): n is a, c, g, or t
gcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgatgctgaggcagatgtggcctccctgaaccgccgcattcagctggttgaggaggagctggaccgggcccaggagcgcctggctacagccctgcagaagctggaggaggccgagaaggcggctgatgagagcgagagaggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagagtaatgtggggacctagaggaggagctgaaaattgttaccaacaacttgaaatccctggaggccccaggcggacagtattccaccaaagaaagataatatngagaggagatcaaactggtgggaggagaagctgaaggaggctgagacccgagcagattttgccgagagtctgtgggcaagtggagaaaccatcgatgacctanaagatgaagtctatgccccgaaagatgagtacagggccattaacgaggaactggacacgcnactcatgacatcacctccctctgagccccacgcaaggtggcacctcaggtctctctctctctccttcatttnccccaagggggagggagaccggccgaggaaccaaaatggcaacttggccagccggctggaaac

SEQ ID NO: 4984 - DNA, 936 bp, Homo sapiens
  misc_feature (756)..(756): n is a, c, g, or t
  misc_feature (801)..(801): n is a, c, g, or t
gatgaagcccagacctgcagggttcgtggataataaactcaagcagcgagtcatccagtaccttaccagtaacaaatcgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgaacagcgtctcgctctgtcacccaggcttcagtgcactggcacaatcatggcttaccgcagtcttgacgtcccaggcccaagcgatcctcccaccgcagcctcacaggtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacgaataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctccttttggagagtgnatatgaaacggaaaggcaagctaaagaataaaggaagcaaaaggnaagaaagagatctttcagaagtagatggaggaaattgaagctgtcctacaaaagaaagctaaagcagggggttagaattcagatcttccacgtgaaagtttgaagatgtggggaggcatgatattgaccttaaaa

SEQ ID NO: 4985 - DNA, 866 bp, Homo sapiens
ccacgcgtccggcaggcggaagtaggggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaaggcagagacccgtgctgagtttgctgagagatcggtagccaagctggaaaagacaattgatgacctggaagataaactgaaatgcaccaaagaggagcacctctgtacacaaaggatgctggaccagaccctgcttgacctgaatgagatgtagaacgccccagtcccaccctgctgctgctcctccctctgacccagactccgccctgagccagccctgcggggaagctgaccctttc

SEQ ID NO: 4986 - DNA, 916 bp, Homo sapiens
gagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactgggacagctacaacaaccgccgagaactgaactttgagcggggaggtgatatcaccctccaggggccctgtgatgctggggggaaggagaaccaacccctcctggaaatgcaatgggggcatggaactcaaaactggaccccaccagacctcgttcctcagac

SEQ ID NO: 4987 - DNA, 935 bp, Homo sapiens
  misc_feature (935)..(935): n is a, c, g, or t
gtgccgaatcggcacgagggcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggcgatcattgaaggagacttggaacgcacagaggaacgagctgagctggcagagtcccgttgccgagagatggatgagcagattagactgatggaccagaacctgaagtgtctgagtgcctgctgaagaaaagtactctccaaaagaagataaatatgaggaagaaatcaagattcttactgataaactccaggaggcagagacccgtgctgagtttgctgagagatccggcagccaagctggaaaagacaattgttgacctgtaagataaactgaaatgcaccaaagaggagcacctcctgtacaccaaggatgctggacccgaccctggcttgacctgaatgagatgtagaacggcccagtcccaccctgggtgctggttcctccctctgaaccagaaatcccgcctgagggccagcctgggggaagactgaccctttacctgaggggctgaatctttaactgggaaggctggttttccccctcttcccn

SEQ ID NO: 4988 - DNA, 884 bp, Homo sapiens
  misc_feature (724)..(724): n is a, c, g, or t
  misc_feature (857)..(857): n is a, c, g, or t
  misc_feature (869)..(869): n is a, c, g, or t
  misc_feature (878)..(878): n is a, c, g, or t
ggagacgagattagtgatttggcggctccgactggcgcgggacaaacgccacggccagagtaccgggtagagagcggggacgccgacctgcgtgcgtcggtcctccaggccacgccagcgcccgagagggaccagggagactccggcccctgtcggccgccaagcccctccgcccctcacagcgcccaggtccgcggccgggccttgattttttggcggggaccgtcatggcgtcgcagccaaattcgtctgcgaagaagaaagaggagaaggggaagaacatccaggtggtggtacgacaccacagaggaaaagttatttatacccatcaacactggtaagaactgaaccacgtgaacatctccttgatcagctgaaaaggaaacagcctgagctgttaatgatgctaaactgttcagaaaacaacaaagaagagacaattccggatgtggatgtagaagaggcagttctggggcagtatactgaagaacctctaagtcaagagccatctgtagatgctggtgtggattgttcatcaattggcggggttccatttttccagcataaaaaatcacatggaaaagacaaagaaaacagaggcattaacacactggagaggtctaaagtggaagaaactacagagcacttggttacaaagagcagattacctctgcgagcccagatcaacctttaattcacttgggggttggcaattttatttttnaagaaacttaaaaataaaacctggaaccccagaacttgagccttgtgtatagattttaaaagaatatatatatcagccggggcgcggtggctcatgcctgtaatcccagcactttgggagggctgaagcgggntggattgcttgnagccccggnagtttt

SEQ ID NO: 4989 - DNA, 910 bp, Homo sapiens
gccagcggtgatggcttgaatgccaggctgggggctgggatttttcctgaggatttcacaggacagaggtgtggcttgtgaaagaccaaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaagcagaagaagctgctgctaaagcatcatcagaagtgaacctggcaaacttacctcccagctatcacaatgagaccaacacagacactaaggctggaaataataccatccatgtgcaccgagaaattcacaagataaccaacaaccagactggacaaatggtcttttcagagacagctatcacatctgtgggagacgaacaaggcagaacgagccacgcagataactggagctgcacaaaggagtctggtggaaagggaggcacgctggtggctggacgctggcctacatgctgccacatcgtgcataggatgagctgctcttgttaccgcgggatactcaccctgggcatcttttttggatcccggaccccatctgctgactgaactagcaggaaagccggctgctgcttcacatccaacctccagcactcactagctgcgtgactttgccaagttactccacctttccgaggcctccatttccctccatctggcaaaatagaaaagggaatagtaacccggcccctcctcatcgaggggagagggtttttggaaaaaacccttggggagttaaa

SEQ ID NO: 4990 - DNA, 1191 bp, Homo sapiens
atggcgctccgagtcaccaggaactcgaaaattaatgctgaaaataaggcgaagatcaacatggcaggcgcaaagcgcgttcctacggcccctgctgcaacctccaagcccggactgaggccaagaacagctcttggggacattggtaacaaagtcagtgaacaactgcaggccaaaatgcctatgaagaaggaagcaaaaccttcagctactggaaaagtcattgataaaaaactaccaaaacctcttgaaaaggtacctatgctggtgccagtgccagtgtctgagccagtgccagagccagaacctgagccagaacctgagcctgttaaagaagaaaaactttcgcctgagcctattttggttgatactgcctctccaagcccaatggaaacatctggatgtgcccctgcagaagaagacctgtgtcaggctttctctgatgtaattcttgcagtaaatgatgtggatgcagaagatggagctgatccaaacctttgtagtgaatatgtgaaagatatttatgcttatctgagacaacttgaggaagagcaagcagtcagaccaaaatacctactgggtcgggaagtcactggaaacatgagagccatcctaattgactggctagtacaggttcaaatgaaattcaggttgttgcaggagaccatgtacatgactgtctccattattgatcggttcatgcagaataattgtgtgcccaagaagatgctgcagctggttggtgtcactgccatgtttattgcaagcaaatatgaagaaatgtaccctccagaaattggtgactttgcttttgtgactgacaacacttatactaagcaccaaatcagacagatggaaatgaagattctaagagctttaaactttggtctgggtcggcctctacctttgcacttccttcggagagcatctaagattggagaggttgatgtcgagcaacatactttggccaaatacctgatggaactaactatgttggactatgacatggtgcactttcctccttctcaaattgcagcaggagctttttgcttagcactgaaaattctggataatggtgaatggactgtcaagaacaagtatgccacatcgaagcatgctaagatcagcactctaccacagctgaattctgcactagttcaagatttagccaaggctgtggcaaaggtgtag

SEQ ID NO: 4991 - DNA, 870 bp, Homo sapiens
cggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgacctctgggcctcagacaaccccctggacaggccgttggttggccaggatgagtttttcctggagcagaccaagaagaaaggagtgaagcggccagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtccgatggtgagggggagccaggccagggcgaggggcccggagctgggggatgccgagggctgtcccacgccccgcccgcctgggccacacagaagaagaagaagggaccaccaccggcgcgccgggaaaaagggccggccc

SEQ ID NO: 4992 - DNA, 1011 bp, Homo sapiens
  misc_feature (523)..(523): n is a, c, g, or t
cgtgccctggaggaggccacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcancaagacagaggaactgaaccgcgaggtggccaccaacagtgaactggtgcaaagtgccaagagtgagatctccgacctcccgcgccacatgcaaggccttggaaaaaaaagctggcagtcccactccacaaggaaaagcatccccttggagggcaaccttgccggaagacagaaaaaccggctactggggtgccacttgtccccaattccaggggcctgaattgggcaaccggtggaggaaccaacttgggcccggttttccctgggcaaaatgggacccccccaaaacccacgaaatacacaaattccctggctggaaattggaaaaaacccccgcctgggagaacaggaaaaatttgcccaccctttaccccccccccctggttgtgaagaggaaaaagaatactcccccccgtgaactctcggtaaagaaaaagaaaacccgggggaccacccccgcgccggggggcggttcacaccttgtggga

SEQ ID NO: 4993 - DNA, 891 bp, Homo sapiens
  misc_feature (628)..(628): n is a, c, g, or t
  misc_feature (889)..(889): n is a, c, g, or t
ggacgcgtgggcgcggcggtgtgaagttacagcccggccagccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcaggtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttcttcacacacccccattcggcgtagtacccagagagctcaagatgtgtggcagttttcggatggaagctcgagagcccttaagttctgagaaaatttgaagcccccagggngtgggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgcccatttttaattatattttttaaataaaaaagtaaaaaacaaaaaaaacagacccaccattggaaacaagtgaatcagtctccccataaaaagaaggggcccgttggggaccatcgncc

SEQ ID NO: 4994 - DNA, 941 bp, Homo sapiens
  misc_feature (913)..(913): n is a, c, g, or t
  misc_feature (931)..(931): n is a, c, g, or t
agtatatagcagtttgaacaaaactgacagctgtttcttcagtcttaaataaggagacaatgtaagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgcgcagaaattcatggagtatgtggcagaacaatggggagatgcatcgattgcgagaaagagagagcccaagcagggaaagacaactggaagaaccaaaaaacccgaccggagaccggagatgcctggtatggcgagccgcttcctcgaaacaccctaaccaagccggcgaaggactgggcttccccaattacacccggggcaaaagccacggtaaagcttggaaccacttaccacccaatgttccnaatgggctaccggcccanataaggtaac

SEQ ID NO: 4995 - DNA, 965 bp, Homo sapiens
  misc_feature (253)..(253): n is a, c, g, or t
  misc_feature (255)..(256): n is a, c, g, or t
  misc_feature (262)..(262): n is a, c, g, or t
  misc_feature (265)..(265): n is a, c, g, or t
  misc_feature (267)..(268): n is a, c, g, or t
  misc_feature (374)..(374): n is a, c, g, or t
  misc_feature (666)..(667): n is a, c, g, or t
  misc_feature (741)..(741): n is a, c, g, or t
  misc_feature (775)..(775): n is a, c, g, or t
  misc_feature (828)..(831): n is a, c, g, or t
  misc_feature (833)..(837): n is a, c, g, or t
  misc_feature (912)..(912): n is a, c, g, or t
aacgcagccagggaaactagctgggccaggaggggtcagacccctgaacaagtgagctgatctctcaaggaggagctggatcggtgtgagggagagcggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatggggngnnccgccntgngnnagggcggagactgcggacatgcggatgtggtggagacttcagaatagtacgaagatgaaattaaccgccgcacagctgctgagaatgagttttggggtgcctgaanaaaggatgtgggatggctggcctaacctgagccaaggggggaaccttggaaggcccaagggggtgggccctgaatgataaaaacaattttccctccgggcccccccttttgagaaacggagtttttaaaaaaaaacttggaagactccccccaaaaaattcccggaagggaaatttgggggggggggggtggcccccctggggaaaaaaagagaggggggcccccctccgtggggagcccttggggagaggggggggctctccctccccccgaggaggggaggggccgcgcnncccgcccccccccccttttggtgtggggggggagagggggggcgccaataattccccccccccccggggggggngggggggggggggaaaaaaaaaccccggtgttgnccccacccaaaccaaaaaaagtttttggggaacccacccaccccccccccccnnnngnnnnnggggggggtgggaggaaaataagggggggggggaggggacacccccccccccccgccacaaaaaaaaaaaccagnggggggggggaggggtgataggttatttttctttttttcaaacgcaaggaccg

SEQ ID NO: 4996 - DNA, 845 bp, Homo sapiens
  misc_feature (729)..(729): n is a, c, g, or t
  misc_feature (803)..(803): n is a, c, g, or t
gatgaagcccagacctgcagggttcgtggataataaactcaagcagcgagtcatccagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgacgtctcgctctgtcacccaggcttcagtgcactggcacaatcatggcttaccgcagtcttgacgtcccaggcccaagcgatcctcccaccgcagcctcacaggtagctgggattacaggaaatcctgattctgtttcaaatactcctgagatggagcaaagagaaaccacctcttcaacaccacgaataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagatagaagatctttcaggaagtagatgggagaaattgaaagctgtcctacaaaaagaaagctaaagccagggggggttagaattcccagatctccnacgtgaaattttgaagatgtggggaggcaaatgatatgacatttaaaagagggtctggcaagatgcctcatacncattggcgtcaaccccggaagttggtaccaaaccaccctggg

SEQ ID NO: 4997 - DNA, 1063 bp, Homo sapiens
cacctgccaggtggtgcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagcccagggctccacttcttctacaaggttgcatgagcccgagaagaatgccagagaaataacacaggacacaaatgatatcacatatgcagacctgaacctgcccaaggggaagaagcctgctccccaggctgcggagcccaacaaccacacggagtatgccagcattcagaccagcccgcagcccgcggtcggaggacaccctcacctatgctgacctggacatggtccccctcaaccggacccccaagcagccggcccccaagcctgagccgtcccttctccgagtacgccagcggtccaggtcccgagggaagtgaatgggaaccgtgggttttgctctagcaccccatactctaccccgcttttcttgctcccaccagggaagccccccgcggatgcatcaccaacccaaccccaatttctcccgaagggcccggttgcccgccatcattacttcagagcaaccccccgcgtatcccacacgagaattcttttctcacgcccctccccatcttcctcgcgggagccgagcccgcagaatctcccggcgtgcttagacaccaataatatgccagtcgcaccgcgacacttagcccaacacatatatccgcgccggtcgttacgcgctacccaagtgacaagagtgacaccgccggccgaaccaactcgcactagggaaggtggcgccgtccacacgcggcgctacccgccgataccatccaataccgaccgcccattcgctttgataacgagcaagttcattattaatttgcgattcacaccgccgcctcggttgttaggggtaccgcgagcgcgaccaccccgggtgtcagtgctgaaacgagcg

SEQ ID NO: 4998 - DNA, 811 bp, Homo sapiens
gggaggcgccattttcgagtgaaggacccggagccgaaacaccggtaggagcggggagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataagaacggcctgcagagataatacttctgtctatcacataagtggaaagaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacctagctatcgaatttcttaccttgggaaaatgaaatatttagaaaaaagaatcatgtttgtccaatataatattttatgaagttgcaaaaaaccgaattgcctgaaaatgggaaacctcacaaaaggaaaaaaatttccttggaaggattacccaaaggaaaattttattggaggaaaggaagcccattattcctttattccaaaattggaat

SEQ ID NO: 4999 - DNA, 946 bp, Homo sapiens
ctggaccggtccggaattcccgggatatcgtcgaccacgcgtccggcgacctttgattgacagaaagaggaagtttgtggacacagatctggctcacgattctgaagagttgtttcaggatcttagccagctgcaggaggcttggttagctgaagcacaagttcctgatgatgagcagtttgtcccagattttcagtctgataacttggtgcttcatgctccacctcccaccaagatcaaacgggagctgcacagcccctcctccgagttgtcgtcctgtagccacgagcaggctcttggtgctaagtatggagaaaagtgcctctacaactattgtgcctacgataggaagcctccctctgggttcaagccattaaccccgcccgccactcctctgtcacccacccatcagaattccctatttcccccacctcaggcaactctgcccacctcaggtctcacccctggagctggcccagttcaaggggtgggtcctgccccgactcctcactcacttccagaacctggatcacagcaacaaacatttgcggtcccccggccaccacatcagcccctgcaaatgccaaagatgatgcctgaaagccagtatccatcagaacagagatttcagcgacagctgtctgagcccagccatcccttccctcctcagtcaggagttcctggagatagtcgccccacctaccaccgggcagatgtcagagcccattgtccccgcagctccggccacccccttcagggaattcagcaggaataccatgtacccactgttatgaacatgggggtcccctgggaatgcctggttcctccagcacatggggtttccaatcacccccagggggaacaagcccggcagccccgcagatgtccgggggctgcactcccggaagtgcccttacttgaaaggtttaccccacatacataaacg

SEQ ID NO: 5000 - DNA, 762 bp, Homo sapiens
  misc_feature (634)..(634): n is a, c, g, or t
  misc_feature (713)..(713): n is a, c, g, or t
  misc_feature (716)..(717): n is a, c, g, or t
  misc_feature (726)..(726): n is a, c, g, or t
  misc_feature (735)..(738): n is a, c, g, or t
ggggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggagaggcattaaaattcactgtgcccagcacatgggtggtacactaattatgacttcccccagctctngagtagaaatgacgcctttatgcaagttggaaaggagtttgaacagtaaagagggaagtttttgcaccactccaaaaanaannaaaaaaaanaaaaaaaannnncccttgttcgggccggccctccgc

SEQ ID NO: 5001 - DNA, 931 bp, Homo sapiens
  misc_feature (871)..(871): n is a, c, g, or t
ggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaggatgttctaccggccctccagttaccagccccctctgcagaatgccaagtgtgcagcggagtcttcaggaagttttcagatccttccccaggacagctctgagaaggaacaaaatggactcagccattggtgtctttccagacccgggcaccagaaagactgggcactgtgtgcccacgcgggcccagccacagcaggttgtccgagctgtctgtggccgccagcggagacaggaagaaaggctgggagaacgtcttcaaagaccgtacacgcctgcccaggagaggctggaacctcctcctttgaactcttctacttccctaattgctggtccatagagaccaagctgaaaattagtttaaatgctaaattgagtttcaaaccacgagcctcagcccctctagaaacaggacaccgtgtaaaaatagaaactttaagtcaacttgtttttctaagctttatacagctttgctgtgaggtccagagtcctttggcaaataagtgacgtttgaagagattcaggtgtgctgggagggttcatttcggatggaactggctactcttcattataaaaaaagtcaagacagcgtaaagtaacccctgaaaagaagatgcctctgccctgaatcaagttttagcgtcagaaccaacccataattcctctgccggagatttcttccaaacctatgccagntgggaaggggttagaaagccaaggcttcatttcttttcaggggaatgggaaatcacaaag

SEQ ID NO: 5002 - DNA, 684 bp, Homo sapiens
tatggccggggagagctgcttggagagctaagctggaagggtgcttatccctgcgtagaaacgcctgccaatgctttctcatttggacccagactccagatcgggagcagtcttatagctggatcagctaccaagagaagttctaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaagactgagtctcgctctgtcacccaggctgaagggcagtggcatgatctcggctcactgcaacctccgcctcccaggttccggcaattctcctgcctcagcctcctgagtagctgggattacagggtcttgctgtgtcacccaggctggagtgcattggcatgatcaccactcactgcagccttgaactcctgggctcaagtgatccttctgcctcagcttcctgagcagctgggactacaggcccacaccaccgtgcctggctaattttgtattttttgtagagacgagagtctcactgttgtccagcc

SEQ ID NO: 5003 - DNA, 602 bp, Homo sapiens
tacccgggattcggccttatggccggggaaagctgcttggagagctaagctggaagggtgcttatccctgcgtagaaacgcctgccaatgctttctcatttggacccagactccagatcgggaggtgagaacgttgttattttgcaaggagtaggagcagtcttatagctggatcagctaccaagagaagttctaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataac

SEQ ID NO: 5004 - DNA, 659 bp, Homo sapiens
atggccggggagagctgcttggagagctaagctggaagggtgcttatccctgcgtagaaacgcctgccaatgctttctcatttggacccagactccagatcgggagtcttatagctggatcagctaccaagagaagttctaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccatacctaccaaaggatttaacactgagaaaattaagggagatatgcttcctgagagaaaggaccacgcttctcctgtttaccatgctgtctcccactctagcacatccttcagcgatgctgaccggtggaaaccagagcagtacctcgtgtatactacgctatcagtctctctctattgcccaggctggactacaatggtgcaatctcagctcactgcaacctccgcctcccccgttcaagtgattctcctgcctcagcctcccaagtagctgggattacaggtgcctgccaccatgtccagctaattttttgtatttttagt

SEQ ID NO: 5005 - DNA, 534 bp, Homo sapiens
ctcactatagggaatttggccctcgaggccagaattcggcacgaggcggcacgaggttggagcggaggcgccattgcgtggagcccatagcattgacctgacaggaagcggggccgccagacctacacgcgctaccagacgctggagctggagaaggagttccacttcaaccgctacctgacgcggcgccgccgcattgaaatcgcccacgcgctctgcctcaccgagcgccagattaagatctggttccagaaccgccgcatgaagtggaagaaagagcataaggacgaaggtccgactgccgccgcagctcccgagggcgccgtgccctctgccgccgccactgctgccgcggacaaggccgacgaggaggacgatgatgaagaagaggaagacgaggaggaatgaggggccgatccggggccctctctgcaccggacagtcggaaaagcgtctttaagagactcactggttttacttacaaaaatgggaaaaataaaagaaaatgtaaaaaacaaaaacaaaaacaaaaaa

SEQ ID NO: 5006 - DNA, 393 bp, Homo sapiens
  misc_feature (79)..(79): n is a, c, g, or t
ttttttttttttttaaactcccccgtagctatcatccagctgtaaccattttattaatatttattaacattaatattgngtcatctaactcttccacattttttgacagaatattttaacacaacttcaagatatcatgcattttacccataagtacttctgtatgcatctctgacatgaactggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagccgagctggaggactccttcaccgagcaggtgcaatccctggccaagtccatcgacgacg

SEQ ID NO: 5007 - DNA, 427 bp, Homo sapiens
ctgaagtgggagcgggccctgcgcgccgcgcgcctgccccgagatcgtgcctgtgactcgccctccccaggtaccagtacctgagacgaaccgggaacttcgagcgctccgccgggctgcaggcgggagtggacgcggtagaggacgccagcagcatcgtgttcctctgcgacctgcacatccacttcccacccaacatcctggacggcatccgcaagcactgcgtggagggcaggctggccttcgcgcccgtggtcatgcgcctgagctgcgggagctcgccccgggacccccacggttactgggaggtgaacggctttggcctttttgggatctacaagtcggactttgaccgggttggaggaatgaacacggaggagttccgagaccagtgggggggtgaagactgggagctcctggacagggt

SEQ ID NO: 5008 - DNA, 736 bp, Homo sapiens
tcctgatgtgcgcagcttcattgttggccccctatggcactgacatcggcccaggcggaggctatggggcagcagcagaaggcggcatgtatgctggcaatggcggactattgggagctgactttgctggaggtctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggtctcataatgcatgtggcacttaggtccaaggtctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaac

SEQ ID NO: 5009 - DNA, 1049 bp, Homo sapiens
  misc_feature (503)..(503): n is a, c, g, or t
  misc_feature (505)..(505): n is a, c, g, or t
  misc_feature (509)..(509): n is a, c, g, or t
gcccagcgtgcccattccagcgcccgcgtccccgcagcatgccgagcccccgcctgctggccgcgctgtgcggcgcgctgctctgcgcccccagcctcctcgtcgccctggatatctgtkccaaaaacccctgccacaacggtggtttatgcgaggagatttcccaagaagtgcgaggagatgtcttcccctcgtacacctgcacgtgcyttaagtggytaygytkggttattcayttgtgagacgaaatgtgtcgagccactgggcctggagaatgggaacattgccaactcacagatcgccgcctcgtctgtgcgtgtgaccttcttgggtttgcagyattkggtyccgtgagctggcccgcctgaaccgcgcaggcatggtcaatgcctggacacccagcagcaatgacgataacccctggatccaggtgaacctgctgcggaggatgtgggtaacaggtgtggtgacgcagggttgccagccgcttggccagtcatgantncctnaaggccttcaaggtggcctacagccttaatggacacgaattcgatttcatccatgatgttaataaaaaacacaaggagtttgtgggtaactggaacaaaaacgcggtgtcatgttaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaaccctcctatgcacggctggacaagcagggcaacttcaacgcytggttgcggggagywasgttaasatcagtggctgcaggtggacctgggctcycgaaggaggtgacaggmtcatmaccaggggccctyactttkgctctstccatttktggcayctacaagktkctwcagtatkamatacgattggattrtacamgacccagactgyacastaag

SEQ ID NO: 5010 - DNA, 955 bp, Homo sapiens
caggccaccatggcggactgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactawaaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaawaattggagttggtgttggagctggagcctacatcctggcgagaaatgctctaacaggcctcacctcttccattccggagatgatccttggacatcttttcagccaggaagagctctctggaaattctgagttgawacaaaagtacagaaawawcattacacatgcacccaacctggataacattgaattgtactggaacagctacaacaaccgccgagacctgaactttgagcgtggaggtgatatcaccctcaggtgtcctgtgatgctggtggtaggagamcaarcacctcatgaagatgcagtggtggaatgtaactcaaaactggaccccacccagacctcgttcctcaagatggctgactccggaggtcagccccagctgactcagccaggcaagctgaccgaggccttcaagtacttcctgcaagcatgggctacatggcctcawcctgcatgactcgcctgtcccggtctcgtacarcctctctgaccagtgcagmtccgttgatggcamcggtcccgctctcgcmccygtccagagarcgrtctggamtyttctysgggccc

SEQ ID NO: 5011 - DNA, 1069 bp, Homo sapiens
gggatggggactgtcgcgtggagctgccgggcgagcaccgttaggcagcctggcgcgcggcgccgccaggcgcccagtcctctgccatcgcccacgcctccctggtgccagggaacaggtatcagcgcgcctccccagcggctgggagagacgctgaatgaaraagagggaaggacggttagtcagagctgcttggagagctaagctggaagggtgcttatccctgcgtaraaacgcctgccaatgctttctcatttggacccagactccagatcgggagcagtcttatagctggatcagctaccaagagaagttgtaaaccaaraagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggarggacttgagaamtacatgatatgatcattaaaagagaaaatgttgcggcacagaaaaaraaaawgawatcatwactattatwtctgtgtggrkargkttctctggctgttttgacaatararatgttacagcgggktggctgttgccccyggatgyattaaacttgttt

SEQ ID NO: 5012 - DNA, 902 bp, Homo sapiens
ctggccaagtgcggctctgctctgcccagtcccgttccgcgaccacccggagcccgctccgccggccttgcgctgcgcgcccagggaaggcatttccagcccgcccacccaggtctcttcttcggcctctctgacatggtgccagccctactggagtcagcaggagtccagcacaacagatggtggtcagtggtgacttcggcacaggcagttcgtgaggagtggttggtggccatggagtcctgactggagtaggttaaaaagaaggaggaaaatcacaagaaagagagactggaggcagccacctctcaacaacccatgaagtgtctggagctccaccctctgctcaagaggaacggcacatgacccaggcctatgccaatcagcatttcacattcctcatggttggttcaaaggaaacgggattatgaaggttatttatgctccctgctgctccctgcagaatcccgaagctctgtttttgcactgagggcctttaatgtggaactggctcaggctggttaaagactcagtctctgagaaaacaattggactgatgcgaatgcagttttggaaaaaaactgtggaagatatatactgtgacaatccaccacatacagcctgtggccattgaactatggaaggctgttaaaagacataatctgactaaaagatggcttatgaaaatcgtcgatgaaagagaaaaaaatctggatgacaaagcatatcgtaatatcaaggaactggaaaattatgctgaaaacacacagagctctcttctttacttaacactagaaatattgggtataaaggatcttcatgcagatcatgctgcaagtcatattggaaaagcacaaggcattgtcacttkgcttgagagccacaccatatcatgggrgcag

SEQ ID NO: 5013 - DNA, 806 bp, Homo sapiens
cccctctcctctccagcccttctcctgtgtgcctgcctcctgccgccgcmaccatgaccacctccaatccgaaacgtmammttmattmmagmtamatmaagggmtmmtmmsgaatgggcgcggmggmtmgtmmmgaammtmmtgmmgcgcmtgctmtgcgcmgcgmmtgggtgamgcgmtmatgmagcgatggggtmtgmtggmggmmtgggmagmammmtmgggggtagmagmtamtmmagmtgmtaaagmtttggmtmtggtggtggmtatggmagmagmtttgggggtgttgatgggmtgmtggmtggaggtgagaaggmmammatgmagaaaataaatgaaagaatggaatmmtaaatggamaaggtgmgtgmmmtggaggaggcmaacamtgagctggaggtgaagatmmgtgamtggtamcagaggcaggmcccggggcccgcmcgtgamtacagccagtactacaggacaattgaggagctgcagaacaagatgctcacacgccaccgtggacaatgccaacatcctgctacagattgacaatgcccgtctggctgctgatgacttccgcaccaagtttgagacagagcaggccctgcgcctgagtgtggaggccgacmtccmtggcctgcgcmgggtgctggmtgagctgmccctggccacmgcwsmcctggmgcatgcacattmccacmtcmagcagcagctggsycachtsmacacmacmacmagvagrmmatsaatggwgtgsvaggcaaggtgggtggtgacatmaatgtgacmatgcaagatgmacaagggtg

SEQ ID NO: 5014 - DNA, 1039 bp, Homo sapiens
ggcggagggaccgtcggggggcgccgccgccgcctccactagcagcagcggcagcagccctagtcccgcggtgcggtcgaattggtccccagccctccgggagcgcaccacaaagcagccccaacgcctctccctgcgtccgcggctcctcagcgctcggctccgtggtcaacttcccctcgctgggctcggctggcgggcgcggagggcagcggcggaacggcgggctgtctgctcgcgctccccgcgcacaacacttcaccctctcgcctcgggtctcgggggccgctctgggatcccggccaccagcaattgtccggaaataatgcaaaaggtgtcccaaggctcctgaccagtgaacaaagatttgagaaagacagccaagctcatgttttctcctgatcaagaaaatcatccatctaaagcaccagtaaaatatggtgaactcattgtcttagggcaataagcaacaaagaccagcatagcatatcatatactttgtctcgggcccagactgtggtggttgaatatactcatgacagcaacacagatatgtttcagattggccggtcgactgaaagccccattgattttgtagtaactgacacggttcctggaagtcaaagtaattctgatacacagtcagtacaaagcactatatcaagatttgcctgcagaatcatatgtgaacggaatcctccctttacagcacggatttatgctgcaggatttgactcatcaaaaaacatctttcttggggagaaggctgccaaatggaagacatcagatggacagatggatggcttgaccactaatggtgttcttgtgatgcatccacgcaatgggttcacagaagactccagcctkgaatatggagagaatatcggkgtgtggaatgtatttagctacgtgaamcagatysgctcagcagagaggaaaatggtggaattgaaaccatcagttamaagtggctcsttattgamyytstgsgcaattgttatrgcgtwtgcgcagsctttcmaatmctacgkgagcttta

SEQ ID NO: 5015 - DNA, 925 bp, Homo sapiens
caaaaaagcaggctggtaccggtccggaattcccgggatcggctgtgctgcacagggggaggagagggaaccccaggcgcgagcgggaagaggggacctgcagccacaacttctctggtcctctgcatcccttctgtbcctccacccrttbcccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtcckkkkccckkkstkstgctkstkkgsgtgsagtgsctggggacagcggtgscctccacgggagcctcgaagagcaagaggcagkstcakcaaatggttcagccccagtccccggtggctgtcagtcaaagcaagcccggttgttatgacaatkgaaaacactatcagataaatcaacagtkkkagcggacctacctatkcaatkckttkgtttgtacttgttatggaggaagccgaggttttaactgcgagagttaacctgaagctgaagagacttgctttgacaagtacactgggaacacttaccgagtgggtgacacttatgagcgtcctaaagactccatgatctgggactgtacctgcmtcggggstgggcgagggagaataagctgtaccatcgsaaaccgctgssatgaagkgkgtgastgctacambatttttgacacctkkakkakaccacatgagactkgtkgttacatgttagagtgtgtgtkttttggtaatggaaaaggagaatggacctgsaagsssmtagstgagaagtgttttkatcatgctgctgggacttctatkttgtsggagamacgtgggaaasscyaccmmyggtggmtgmtg

SEQ ID NO: 5016 - DNA, 971 bp, Homo sapiens
ggatggctctttgcagacaccttctccaccaagagctcaggaaccgagtgaatgctgggcagggcgtcatattctctgaggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaagctatccctccctcatgcggagcaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggkggctagcagtgagtacccgcatggtatcagcctgcctctcccgcccacgccctgctgtctccaggcctatagacgtttctctccaaggcctatccccaatgttgtagcagatgctggacasacagcaccatctcc

SEQ ID NO: 5017 - DNA, 998 bp, Homo sapiens
gggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgacgactcatacacgtgcgagtgcttggagggattccggctcgctgaggatgggaaacgctgccgaagaaggatgtctgcaaatcaacccaccatggctgcgaacacatttgtgttaataatgggaattcctacatctgcaaatgctcagagggatttgttctagctgaggacggaagacggtgcaagagtatcactatgtatgctgttggggtaggaaaagccattgaggaggaactacaagagattgcctctgagcccacaaacacagcatctcttctatgccgaagacttcagcacaatggatgagataagtgaaaaactcaagaaaggcatctgtgaagctctagaagactccgatggaagacaggactctccagcaggggaactgccaaaaatggcccaacagccaacagaatctgagccagtcaccataaatatccaagacctactttcctgttctaattttgcagtgcaacamagatatctgtwtgaagaagacaatcttttacggtctacacaaaagctttcccattcaacaaaaccttcaggaagccctttggaagaaaaacacgatcaatgcaaatgtgaaaaccttataatgttccagaaccttgcgaacgaagaarwaaraaaattaacacagcgcttagaagaaatgacamagaaaatggaagccctggaaaatcgactgaga

SEQ ID NO: 5018 - DNA, 1060 bp, Homo sapiens
ccagcagaggccaacctgtgtctcttcatctccctgggaaaggtgcccccgaggtgaaagagatggcctggtggaaatcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcaggtgtcacagcctaggctcttgggagtgccttggtttgggagtcccaacagctccaccccagggagcagcccttgaatagcgccacaagagtcaggggcagcagggatgatgtgagcagctttgtggacccaggactggccctccaagacgcacaggatctgtatgcggcaggcgagaagattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcaccmaaacctccacagctactttgcagagagactctactatgccatgaagggagcagggacgcgtgatgggacctgataagaaaatcgttyaagggscgagttgattaaatctwtcaatktmmttcaragatktasgsaracctcacascatg

SEQ ID NO: 5019 - DNA, 813 bp, Homo sapiens
  misc_feature (240)..(240): n is a, c, g, or t
  misc_feature (729)..(729): n is a, c, g, or t
atcagacccaaggttgagcagaaaattgaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacanacagttggtgttggtagttcagagagttaagtgtcacacctagactggattgaaagacaccgcagaagtgttgaaagtccaaaccaggaaatttcaaagaacccggggtccttggagtgaatttgggaaagccttggttttgagaaacggaatttttttaaagattggggccataggattccaaaggttaaaagaaaaaaacgcgccttaaaaaagcagaggttttttttgaaagaaaattttcttttaaaaacgggggaaaaaaaaaagcgcctttccttgggaaggtttaatttacacaaaaaaggggcggggccctctattaccgaaaaatattttgtccccagaacgggggtttttataagggttggcgcgggttcttaaacagcggggggggggggagaaaaacaactgggaaagaggtgcccctttaaaaaaattctaaaacaaaaaagactttttctaattgcaactggggagagaacactnttgattgatgaattgaataattgaagacgaagacctcagaggagataggctgtcccaagggattatgcatcaaggatagtactt

SEQ ID NO: 5020 - DNA, 928 bp, Homo sapiens
ggagcaattgattaatagctcggcgaggggactcactgactgtkataataacactacaccagcaactcctggcttcccagcagccggaacacagacaggagagagtcagtggcaaatagacatttttcttatttcttaaaaaacagcaacttgtttgckacttttatktctgttgattttkttttcttggtgtgtgtggtggttgtttttaagtgtggagggcaaaaggagataccatcccaggctcagtccaacccctctccaaaacggcttttctgacactccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctattcatccccaagcagccacggaccaggtytcttccaatgatccagactatctsgatttttcatttastccacacaaac

SEQ ID NO: 5021 - DNA, 943 bp, Homo sapiens
ggccgacgcgagcgccgcgcttcgcttcagctgctagctggcccaagggaggcgaccgcggagggtggcgaggggcggccaggacccgcagccccggggccgggccggtccggaccgccagggagggcaggtcagtgggcagatcgcgtccgcgggattcaatctctgcccgctctgataacagtccttttccctggcgctcacttcgtgcctggcacccggctgggcgcctcaagaccgttgtctcttcgatcgcttctttggacttggcgaccatttcagagatgtcttccagaagtaccaaagatttaattaaaaaaaattcgagtccttgaggctgagaaggagaagaatgcttatcaactcacagagaaggacaaagaaatacagcgactgagagaccaactgaaggccagatatagtactaccgcattgcttgaacagctggaagagacaacgagagaaggagaaaggagggagcaggtgttgaaagccttatctgaagagaaagacgtattgaaacaacagttgtctgctgcaacctcacgaattgctgaacttgaaagcaaaaccaatacactccgtttatcacagactgtggctccaaactgcttcaactcatcaataaataatattcatgaaatggaaatacagctgaaagatgctctggagaaaratgaggagtgggtggtgtatgatgaggargcgggaagtgtatgtaaaaaggrsttttaggcaagatsttttgagttggaaaagaaasggaaasagstgsksattsastgcsagagsagasaaaaragcttkatsagaaggttatsttsaagaagagaagcagaaatgttasarcgatctsttggcaagtgcaaaaraagatcttgaggttgarcgcaarsataactsagctgagtkttgmastgagtrattksgagaaatatgagaa

SEQ ID NO: 5022 - DNA, 945 bp, Homo sapiens
gagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaacggaatatacaatttatgtcattgccctgaagaataatcagaagagcgagcccctgattggaaggaaaagacaggacaagaagctctctctcagacaacatctcatgggccccattccaggacacttytgagtacatcatttcatgtcatctkttggsaygatgragaacc

SEQ ID NO: 5023 - DNA, 955 bp, Homo sapiens
  misc_feature (10)..(10): n is a, c, g, or t
  misc_feature (12)..(12): n is a, c, g, or t
  misc_feature (16)..(16): n is a, c, g, or t
cgcggaggangntganagggtggcccaggtggggccaggctgactgaagtgagtagtgggggtgccagaccagaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgraggaaaacaggtactttacaaccttggracagtgactccaccctgaacarcaggsagctggrgccaaraamtgagamaraaagtgtggggmcscmmaaarwwawggaggggtgsscckcmwdamttttttttwaaamggt

SEQ ID NO: 5024 - DNA, 1017 bp, Homo sapiens
tgtgagctgctgcgcgctcagggaatgattgtkagaagcgggtggaggctggagtgggcagcaaagaactgacattttgaggtcagtttttcactccttggtcaagggcaggctctctccctggtcattaccaggagcctggctccgggcagcaaagaactgacatttcgaggagctctgctaagggccaggcagtatgtgagggagttcacagacaccgtcccattttcacagccctctgagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtkaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagcatcccgcttagcstgcctcamccaaaccgtgtggtactttmaccctggcmaactttgaggtctgtcatgagmatggtamtgcactgggagckctcctgtgccc

SEQ ID NO: 5025 - DNA, 1056 bp, Homo sapiens
  misc_feature (53)..(53): n is a, c, g, or t
  misc_feature (55)..(55): n is a, c, g, or t
gattccgacccctggctagagggtaggcggcgtggagcagcgcgcgcaavagngnccaggggaaggtgggcgcaggtgaggggccgaggtgtgcgcaggactttarccggttgaaaargatcaaacargcatttggarcamaagtgtctaaaaamttttaaagggccggttcaaaaaagaaaaattcccttctactgtaaaactatctggcaaaaagctggaaggcccaatagctgcaaaawmacaaaccaaaawtcccaaaaccaaaaatctaaatagcatcaacaataaaaaaaacacatctmaaaggcaatagggccctgcctagaaaagtagaatggttttaaatggcaaacataawcttcctaatactatwcmcccccytcawcatctaawaattmawmawagcttttaaacaataaaactacaccctaaaccgccctatartgaaaatcatcaatagatatgctcggctctcggacatctgggscaaramtccamctataamgargaaarccgcccarctctataccttgtgggtcamcttccaagtgcttctrtacacgtctctccctgamttctgccawaaatawctacccggctamrtaggaggcatccaagaggggggccgtgamtcctgcargggttgtaaamaaatatcaaatcaamggcctgcaaacmtggctcctcacgcacctgcyctggtttgcaaasgctcatctcctgtcctggttctcgcccacccatcatcttcgacaactggatcccactgctgtggtgsgccaacatccttggctatgcsgtctccaccttcgccatggtcaaggggtacttcttccccaccaacgccararaamtgcaaattmaaaggcaattwmwttwamaactamatgawgggsatcgrrtttaacctcggawvgggrarkggttkaaattcaaactgttcttcaatggggggccsgggatgaktgsctggkacctcatcaacctttccttcccascgaaagsgggggvcaccacamcmttttaacmatdccatggkcctggtcaactcct

SEQ ID NO: 5026 - DNA, 980 bp, Homo sapiens
atctgggagaagcaggcggctccgcgctcgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgccgaagaggccgccgccaaggtacccggggcgcgcggcacggcgtggcgcacgaatggctaactctttctctttctctctctccctccctgtctttccctctgtctctcccgctgtccctgtccttctggttctgtgcbaccactatccctccccttcgggatcacgctgcctgctgcacccccctccctccctgtaccccctggccaactcccagctggaagatgagctggtgtcactgcaaaagaaactcaagggcaccgaagatgaactggacaaatactctgaggctctcaaagatgcccaggagaagctggagctggcagagaaaaaggccaccgatgctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggcaarcacattgctgaagatgccgaccgcmaatatgaagaggtggcccgtaagctggtcatcattgagagcgactggaacgtgsaraaggascgggctga

SEQ ID NO: 5027 - DNA, 775 bp, Homo sapiens
  misc_feature (25)..(27): n is a, c, g, or t
  misc_feature (29)..(29): n is a, c, g, or t
  misc_feature (33)..(34): n is a, c, g, or t
  misc_feature (40)..(40): n is a, c, g, or t
  misc_feature (45)..(45): n is a, c, g, or t
  misc_feature (72)..(72): n is a, c, g, or t
  misc_feature (84)..(84): n is a, c, g, or t
  misc_feature (98)..(98): n is a, c, g, or t
  misc_feature (104)..(105): n is a, c, g, or t
  misc_feature (112)..(112): n is a, c, g, or t
  misc_feature (115)..(116): n is a, c, g, or t
  misc_feature (130)..(130): n is a, c, g, or t
  misc_feature (140)..(140): n is a, c, g, or t
  misc_feature (144)..(144): n is a, c, g, or t
  misc_feature (148)..(148): n is a, c, g, or t
  misc_feature (160)..(161): n is a, c, g, or t
  misc_feature (165)..(165): n is a, c, g, or t
  misc_feature (179)..(179): n is a, c, g, or t
  misc_feature (181)..(181): n is a, c, g, or t
  misc_feature (190)..(190): n is a, c, g, or t
  misc_feature (192)..(192): n is a, c, g, or t
  misc_feature (198)..(198): n is a, c, g, or t
  misc_feature (200)..(200): n is a, c, g, or t
  misc_feature (202)..(202): n is a, c, g, or t
  misc_feature (204)..(204): n is a, c, g, or t
  misc_feature (213)..(213): n is a, c, g, or t
  misc_feature (216)..(217): n is a, c, g, or t
  misc_feature (220)..(220): n is a, c, g, or t
  misc_feature (222)..(222): n is a, c, g, or t
  misc_feature (226)..(226): n is a, c, g, or t
  misc_feature (233)..(233): n is a, c, g, or t
  misc_feature (266)..(269): n is a, c, g, or t
  misc_feature (281)..(281): n is a, c, g, or t
  misc_feature (288)..(288): n is a, c, g, or t
  misc_feature (291)..(293): n is a, c, g, or t
  misc_feature (326)..(326): n is a, c, g, or t
  misc_feature (330)..(331): n is a, c, g, or t
  misc_feature (349)..(349): n is a, c, g, or t
  misc_feature (465)..(466): n is a, c, g, or t
  misc_feature (492)..(492): n is a, c, g, or t
  misc_feature (498)..(498): n is a, c, g, or t
  misc_feature (544)..(544): n is a, c, g, or t
  misc_feature (551)..(551): n is a, c, g, or t
  misc_feature (557)..(558): n is a, c, g, or t
  misc_feature (560)..(560): n is a, c, g, or t
tctctctccccatacactataattnnnantcanncccttntctcntcactacactaaccttcatcctttccntttctctctttntcaatctctttctntctttnntcatttnttnntctttctttacttncctctctttntctntttntctctccatctnntacnccacatttttcatntntttcttttntnaatccntntntntctctccantannctnanttancttcccnaatcctcctaaaccaaaaamaaataacaatatnnnnacaatcccaaanttttaanaannnctatcctcttccccaataaaaaaattacctctncttnnccctctcttctctctttnctttctttccttctattctaatcctttcccttccctatctctcccctctccttccttcccctcctcttctctctctaatcttcattattctttcttatcctcaaactcatcttccnntatcattttttcctcaattctttctnatcctntttttaaaactttawtcccttttccctcttwcccacccactcccanctccctnaccttnntnttgctccttttctggcstcgtctcctcttargctaggkcktggtdccskgttttgckgsarastcavtsttttgaaamamgatavggstctgtsastttsactstctatggsaccccaaacccraasgccsaagkatycktrcstascasgakrggggacgcaamtawaaawcttmcttccaascastgtktcaattcgrdgggatgsaggarat

SEQ ID NO: 5028 - DNA, 851 bp, Homo sapiens
  misc_feature (9)..(9): n is a, c, g, or t
  misc_feature (16)..(16): n is a, c, g, or t
  misc_feature (751)..(751): n is a, c, g, or t
  misc_feature (759)..(759): n is a, c, g, or t
  misc_feature (778)..(778): n is a, c, g, or t
  misc_feature (783)..(783): n is a, c, g, or t
  misc_feature (785)..(785): n is a, c, g, or t
  misc_feature (793)..(793): n is a, c, g, or t
  misc_feature (795)..(795): n is a, c, g, or t
  misc_feature (797)..(797): n is a, c, g, or t
  misc_feature (804)..(804): n is a, c, g, or t
  misc_feature (807)..(807): n is a, c, g, or t
  misc_feature (809)..(809): n is a, c, g, or t
  misc_feature (811)..(811): n is a, c, g, or t
ggggagtcnaactcgnggggtgtcagtatcccgggttcgtctccccactaccggttcccaccactgagtctgggggcgaaggaaggagccagagtgcaattgcagatccagaccccagagtcagaaggagtgagaactctgacccctaatcccactgcatccagccaataggagcccagccaccatggcggactgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgaatccttggacatctttttcanccaggaanagctctctggaaattctgngttgntncaaaagtncngnaatttcnttncncntgcacccaacctgggataacattgaattgtactggracag

SEQ ID NO: 5029 - DNA, 1060 bp, Homo sapiens
cttgggatatgcttttgggcaaagawgcagagctaackaggtwagggatttwwagagtttttcttgggtgtttgttaaatttttattytytgtttgtgtgttgaggggatttawttttaatttttttgcagtggctctgggtccagctccttactttwwkwtttggaaagcatgaagtttggggtttttttyytatgtttyttgggaactgtagctgcwattyygacaaatgcwagattwttatbtgattattycaaacyaactgctgawatggtwgcwccygawaacactgcaattyycagtttwagggctgaagatgaagawaatgawaaagaaacagyagtttttacagaagatgattttyaccataaggctgaaaaattwttagttytwaagttaaaagaggaaagctatgawcagttagcagaacagggcaagagttytwgctaagagctgggattgatggttttagaggacagtkatggtgacttaagtgtgattttggagtttgttccaactgawggtwcattggacataaaagatgatatgagtkagctttagtgagaaaaaactytcagagaacactgattttttggctcctggtgttagttccttcacagattctaaccaacaagaaagtatcacaaagagagaggaaaaccaagaacaacctagaaattattcacatcatcagttgaacaggagcagttaacatagccaaggcctaagggatyaaggaaaccaagagcaggatyyaaatattttcaatggagaagaggaagaagaaaaagagccaggtgaagttggtacccacaatgataaccaagaaagaaagacagaattkcccagggagcatgctaacagcaagcrggaggragacaatwcccaatctgatgatattttkggagagtctkatctaccaactcaagttagcragatgcaggaggrtgaatttgatywgggtaaccaagaacaagavgatactycaatkchgaatkggagaggaaatgcwtcgaasgtyatwagmmattcaagaaatgaatggagrgtcagagggtaa

SEQ ID NO: 5030 - DNA, 354 bp, Homo sapiens
  misc_feature (333)..(333): n is a, c, g, or t
ggggaagcccgagccggggcgggcccgagtcaaaggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcggnttcatgtggatgcccctggaa

SEQ ID NO: 5031 - DNA, 721 bp, Homo sapiens
  misc_feature (638)..(638): n is a, c, g, or t
  misc_feature (665)..(665): n is a, c, g, or t
  misc_feature (720)..(720): n is a, c, g, or t
aggtgggaaggctaaactgaggaattatgtctgacagaagggaatgacaaggctaaactgaagaattatgtctgacagaagggaagaaatgactgcagtggccttctcagaccctgtaggaaaggactctacttatccggtgaaagtgtctacctagactaagaggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctncaatggcacggtcctgtatgccctcanaatcacgacaactggtgcatgtaacatgggatctgtctaaatacccatggacacnc

SEQ ID NO: 5032 - DNA, 2968 bp, Homo sapiens
acagtagttaagaagaacgagcttgatttgtatgtactgacaagaagaatctataaggtatgtaaacagttgaaaaaaaagctacagagttttacatttgtcaagatctaacactaaacaaaattagaaacatgtgaaatccatatacacacgtagaaaaatacatataatgagccgtggatggaaactcgcaaatgtgatattaaagactagcactataagactgagtgagatttggagagtataggaaaggaggcttttagttaatatagagagatattcaaaaatttatgagtgtgatctcatgtattagttattcggttaaagaaacaaaattaaatgaaaaatacatttttaaaaaggttgcaattctgaattatgggagagaaataaaaattagcaaaacatatttgcaaagtggctcaggaggaaggagctgaaaccctaagaatgggtgagtttttttttttttcagagacaatacagaaaagaagaggcaaaggggccgagatgggatacagacctgtatcacacaggtgtgtgcacattctcatttagaactggaacaagggagtcagatttaaaattctggtgcagattccaaaggtgttctctgaggaaaagttcttttgtttggagatgccatgtgttacagcacagaaattgatcaacctggcttagagcgtcacattcttcctctgttggagcaagaggtacagaaggaattggaatttagtggaattgaagatctttttgaacagcatctgcagaatgtagttcattctcacctggctgggtagggaaggttggaaggggatggtcaataatcattcctggtcactgtgagtctggcatcaccttgtagaccacatgggtgtctcttcctgtccacatcactgtaaccccagtgtgggcacttctgctggcgagaaggcccaggttctctacacaccactgagtcagttccatctccccagcggggcaccttgaccaaagccatcagctgaaccaccttcttcctgtccctaggaaaaaaccctgatccatgggctaagaatctgaatgaaaaagactatgagttgctgtgccttgatggtaccaggaaatctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaagaaccttctgttcagagatgacacagtatgtttggccaaacttcatgacagaaacacatatgaaaaatacttaggagaagaatatgtcaaggctgttggtaacctgagaaaatgctccacctcatgtgagtaggaggaacagcatggggaagtggcaaccaaacatggtggtgagtgctgggatggtgggtgggtacaggaggggtaggctgtggcccttgggataggacaacatggacaaaatgaaatggtgagtgaacaatctaagcccggcatgtatgacaggctagactgtaggggcagatagtaaggggatacaggctcagagcactaaggtagtgaacttattgggtatagagaattccatcttatttctaagaaaaggactgggtttatgtgtacatgccattgctctgcagtaaacttttgattagagttgccttgtccaatatggtagccaccagcaagatgtgactatttaaatttaagttaattaaaattaaactaaataaaagatgtatttcttcaatcccacctagctgcatttcaagtgctcaacagccacatgtggctccatattggtcagcaaagagaatgtttgcatcatcacagaaagctctttcagacagtgctgctctagacagcttcaacaatgataggttctggtaaccataaagttgctatgcatactactcatttggaacaccagtttctgagaactgaaatagaataaaacacatctttgcagtataactatgttgggtgtaactgagtcacctgaaaaagtttggaagctggggaataacatgtggtgtagggcagttagtctttccacaggagtatgcagataagggagtcttgatccttattaaaatgctgattctcagagccttgagatactgatttagaaagtctgtgctaggtcaggtatccgcatttgaaaagctgcccccatgtaattctgacggaagcagcaatgtgcttgtctaggttcgctattgtgagaatcaagttgatatttacctaacctatatcctccacaaaagcagacagtctggctctgctcttctttcctccatccttagcccacagcacagaaactggcacattgcaggtgctttttgctatgtcagttcctcacctgcttaaagaggtcagggaggacagtcttcctgggcgactcctggcctcaggaactcagatgtgtgagcctcgcccataagaaacaaggtggaggaccctgtagggcaggaaaatcatgttaacagctttggcgtggggcactccccaggataggcacaggagctgtgcaggcaagtagaaaagagcactgggagaacggcccagttcacagaagaggaggcagcaagtctgcacactttgtactatgctgaaattgttcaatcactcgacagttcagaaataaatataggaagattttgaaaatcctacctctctgctctgctccacagcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttaaaaaaaaaaaaaaaaaa

SEQ ID NO: 5033 - DNA, 9157 bp, Homo sapiens
cataatgcattagcgttatggccatgatgttgtcatgagttttgtatgggagaaaaaaaatcaatttatcacccatttattattttttaaccttcttcatgcaagcttattttctactaaaacagttttggaattattaaaagcattgctgatacttacttcagatattatgtctaggctctaagaatggtttcgacatcctaaacagccatatgatttttaggaatctgaacagttcaaattgtaccctttaaggatgttttcaaaatgtaaaaaatatatatatatatatatattccctaaaagaatattcctgtttattcttctagggaagcaaactgttcatgatgcttaggaagtcttttcagagaatttaaaacagattgcatattaccatcattgctttaacattccaccaattttactactagtaacctgatatacactgctttattttttcctctttttttccctctattttccttttgcctccccctccctttgctttgtaactcaatagaggtgccccaactcactgacctaagctttgttgatataaccgattcaagcatcggcccgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacgggtgaattttgaaaacttctgcgtttgagacatagatggtgttgcatgctgccaccagttactccggttaaatatggatgtttcatgggggaagtcagcaattggccaaagattcagatagggtggattggggggataaggaatcaaatgcatctgctaaactgattggagaaaaacacatgcaagtattcttcagtacactctcatttaaaccacaagtagatataaagctagagaaatacagatgtctgctctgttaaatataaaatagcaaatgttcattcaatttgaagacctagaatttttcttcttaaataccaaacacgaataccaaattgcgtaagtaccaattaattataagaaatatatcaccaaaatgtaccatcatgctcttccttctaccctttgataaactctaccatgctccttctttgtagctaaaaacccatcgaaatttagggtagagtggatgggcattgttttgaggtaggagaaaagtaaacttgggagcattctaggttttgttgctgtcactaggtaaagaaacacctctttaaccacagtctggggacaagcatgcaacattttaaaggttctctgctgtgcatgttcacttgtaagtagaattcactgaatggaactgtagctctagatatctcacatggggggaagtttaggaccctcttgtctttttgtctgtgtgtatgtatttctttgtaaagtactgctatgtttctctttgctgtgtggcaacttaagcctcttcggcctgggataaaataatctgcagtggtattaataatgtacataaagtcaacatatttgaaagtagattaaaatcttttttaaatatatcaatgatggcaaaaaggttaaagggggcctaacagtactgtgtgtagtgttttatttttaacagtagtacactataacttaaaatagacttagattagactgtttgcatgattatgattctgtttcctttatgcatgaaatattgattttacctttccagctacttcgttagctttaattttaaaattacattaactgagtcttccttcttgttcgaaaccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggtacagcagtaaaatgctattttacactctgattaaatcagattctgttgtggataacctgaaagcccaacagtgaacaaagaattaaagaaactttggcaagtccattcaacggagcccttgttttttccaagaaaatacgtaagatatagatgatataatttgttctaaaacccaaataaaaagttgtttatatactacaactagagggggaacggcagagctgaggaaataaaaggattgtaaattcacaaacatattatcagtggtggaaataagtgatttttattttttcttctctttacttttctgtattttccaaattttatttaaaaggaatgtattctgttaaaagttttaaaaaggacacaatgcatgcaatcctgggttgagggcttaccttctcccacttctaatgctactctactactcagtgacattttaaagctgaaatgttaaaacagcgctaactgtaattttctctcaatgtttatacacttaccaaggtttgctacatgcataaatacccctttctgttcaagatagcgctctttaaaagggaataagcaagaagatgtgatttacatgctgctataaatgtggtaattcaattaatcagtaatacccaagtagctctaaacccctcacactctgaactaaccctttttcatacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccagtacgtaaccactgcttggtttccattttcaaagtcaaattttgttcttgggtgtctgaatgcccacgacatgtcttttgcaattacacatagggaaagtgaacttgttggttagtatatgtcttgagctgagccctttacgaacatcttttttccttctcagtgccaagcgaggaatttacagagaaagaagttgtgaaaccaccatagttagttgctgtgctttgaatttcttttgctcaaatggcctcagcgaaatcttatttgcctatagcaaatctacaaaaaattttcctagaccgtcttttctacaactggatggtaaagttgattgaagtgtgcctcatgtagctttatgtttggggcatttgaagggctatggctggaccagagtgtaatataaatgcttaatagagaggggaaaagaagagtgtaagaaccattatagggctgggctcacgcctgtaatcccagcattttgggaggctgaggcaggcggatcacgaggtcaggagttcgagaccagcctgaccaacatggtgaaaccccatctctactaaaaatacaaaaattagccagtcgcggtggcacgtgcctgtaatcccagctactcaggaggctgaggcagaagaatcacttggacccaggaggcagaagttgcagtgagccaagatcatgcctctgcaccccagcctaggtgatagagtgagactccatctcaaaaaaaaacaaaacaaaacaattataacaatttgaatctgacattgcaaatcagctttaccacttccaaggtatagaaaatccaggtctatgagactaacatcacattgtaaaaatcaaatcgtggtagaatacctttaaattaatataaatacatccccattgtggggacattttgcagggtatctgcttatctcacatacacctatgttttaataagtgatgcaacattgtatattttctaaaccaagaaaaattaagcaagtgtttaagtgatttttccttttgatagtgggttaattggacttcatcaaagaaaatggtatctgcaaaactgctttgcatgttataaaaatgcttatttcacaacttgcttttcacataacctcttaccattaatttgcctaacagacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacaggtatatggttaattgcaccaccaggtgcccatgggagcagcggctttatgccctactgaatgaattatgcttcactgggctattgattcccgtgtaagggtgaaaaagaattattaggaaagatcctctttaaagaggaatggtaagaaacaataaaacttaggtgatatttaaggaaacaagtctgattaaaagaaattttggagtatcctggcttatacacaagaccataaagcaagacatttgaagaggatactaaagttgtggattatttcctaagctctgactccctgtgattaccctcactatgtataaagaaaagaagtttggcattacagagcttacttataaaaaggaacccaaactcgggcatttcatagcagcatgattctgagcacacgtgggtaagacctttcttctctggttagatatcatatgctggtgtataattagcttaaatgattgtgatttagacacctaggaaataatcaatagggcaattgctttccataatactttatcttcttgtgctttatttctgaagcagagtagaatgctaaagatgtatcctagtgacagcataaaccctagaggtgacagtctgtattattgcttttcgcttctcttttcttcttctgttgggagccagttttcttcttacgccgcattacagagagaacgtcaaatttagcagccatatctgccatagggtccaaataaagagacaataaaaacattattctctcttttttggatggaatactgcgtgaaatggttatccatacaaagatactttatgtagaatagaaaaaggaggccgggtgcagtggctcacacatgtaatcctagtgctttgggaggctaagccgggagcactgattgaggccaggagttcatgatcagcctgggcaatgaagtgagaccccgtctctacaaaaaaatatgaaaaaattagcgaggtgtggtgacacatgcctgtagtcccagctactcaagaggctgaggtagaggatcacttgagcctacgagttcaaggctgcagtgagctatgataactccactgcactgctgcctggatgacacagagagaccgtttctaaattaattaattaacaattttaagaaagaaaaagggccattgcttatttttccatacaaaagtaaaataaatcataatggccaataagccaatgtaactttttttttaagggaaagcaaaacttgtaaaacctaaaatctcttagagttttggcatttacccaaatgttttcagtgattctgagaattggtggatataaaacacatttctcagcaaacactttcttcattttgcatcccttactgtactttcttgtactgaatctttgcttgaccagggaacccacctagcccaacaagaacaatccattctacttcttggaactcactttattttccttttcccccatttcctataagataacctctaaccaatgacaatctcgacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggcatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccacaaaaaaaaaaaaaaaaaaaaaaaaaaaaaa

SEQ ID NO: 5034 - DNA, 9521 bp, Homo sapiens
gtcctttgccaattatgtattctccttttccaagaagctgtggcataatcataaatgatacagtgcaagaggggacatattctatatgctgcccaagtcaagtccaatagacactggggaatccagcctgggaaacagtaacaacagcagcttccattagtattttccccaagatctgatgacaggctgcatccaaattaacaataaaaggaaagaagccaaacttctcttggagagaagaaggaattccccctaggtaaagtggcatcatgtgatattaaacattgactcataaaatgggtctcgggaaatgctttcaagcttgacttggaataacaatagttaaagaacagggtttctcccttagagttcatatgtgaacttgtttaccagccaactctgacatatcagctacttgaattgatgctttgttctaacgctgataattattgcctctaatcttttatatttgcttttatatttgcaataagattttgattttcttaataatcatggctctcaagttgaaaagcctgcataatctctaacttgtactaagtaaatactggcttctcagttgactactatcaattttttaattatttggagtaatatttgtaataattaactttagagaaaagcacatggaaaatctttgtgtgcatattctttagtacctaaagtgttcagaactgaaaaaaagacccatttttatgtccatttacatactgtgatttctggatagtaaaggctctgagctccttgatgtccctgtgtttcacttatattccagagttctgtatttgtttatttgctgctgatcccacaaaactaaaggaaaaaaaataagagtggctcaaggaggaaatagctagggcttagtgtaatgtgtgggtggaagataagggagtaagaattattttcaaagagagaaaaataaggacttgaggttattgagaagacttaagagtcagtggcatccctcagcacaattttaagaagtctaaaatgtgaaaaaaagtttgtacattgaaaacacggttctgatctttttttaaaaaaacattctcttggaagggaatatgagtttttaaaatcaggtaaaactctgtctgaatttagctgttatcttttactaactgtccattctcttgccatttcaggtaaacctctttgtgctgctctctgtggtttgtgtcctcttaaatctagctggatttatcctaggctgccaaggggcccagtttgtgtccagcgtgcccaggtgtgatctggtaagcagtcctaaaacatcactgtgcatctaggcagaccctggcttgtcaggtgttcctggcgagacttgcaacattcagcatcaggcaactgtcctgaagtgaaacctgaaatgggtaaagggaagtgggaaaacaaaacaaagagctgcctgctgattatttcacccaagttgtcgattactttttccaaagcagggaccagccagcaaaacactggaaccatagtgatataatgcatcattagttagtgaatggatggatcagatgtccacaatcaatcagtctctgactgtcctcatctaaaaagaaataaaatggatattgccagaatacaggtcaacagtcttttatctgaaacctttggaggccaggtgtgtgtcagcatttagagtttttccagttttagaagattaaatattttgcatatactatttattatgtagcatgccagtggagtctgggacagcaggctgttatcatgacttctggttttcagagctttttggatttcagcattgtgagtaagaggttgtggacttgtaccatctctgaacttaaaagaaaataaattttattatggtaaaatacacatagcatgaaatttaccatcttaaccatttttaagtctacagttcagtagaggtaagtatattcacattgttgacaaccaatctctagaactcttttcatattgtaaaactgaaagtctatgcatattgaacagcaacagctccccatcctccagcccctggcaatcaccatttcacattccgtttctatgaatttgagtatcctaggtacctcatacaagtaggataatatgctgtttgtctttttgtgactggattatttcacttagcatcatctcctcaaggttcatcatgttgtagcatgtgttagaattcccttcctttttaagactatataatattccattgtatatacatgataccttttgtttctccatttatctgtgatggatatttaggttggcccccactcttggttattgtgaataacattgcaacgaacatgggcctgcaaacatgtctctgagatcctggttttaattcttttggatatataaccagaagtgatcatttggtaattctattttaaattttttgaggaaactttgtatggtttttcatagcaactgcaccatttaatatttccatcaacagtgcacacgggttccaatttctgcacatcttcactgacacttgttattttctgcttttttttttaaagtggccattctaatgggtataaggtgatacctcatttggttttgatttgcattttccttatgattagtgatgttgatagtctcttcatatgcctgctggctatttgtatgtcttcattaaaggaagaatgtctatacaagtcttttgcacattttaaaattgagtttttttttttgttattgagttatagaagttctttatatattctgtatatcagaatatatataccacaaaaccaacactgtgattatttctgatgttataattataaaagtttgggcaagccatgaaaagtataaggcagaacttaaatatcatttgaattcccactatccctggataacaatttggccatgtgttaagcatctctttatgcacaaaaacagacataatcaacaggatcatgttgtaagtgttgttttcctttggggaaattactgacaaatgaaacctttttgggcaaggagttgctcttctcttctctttcccactctgcccatacctgtcaccccaaatccttagtaacaggctggggaattatatttcataatgttttcatggtcatgtaatcttacataaatatgtatggagtggggtcgttcatgatttttttttaaatgaggtatattgtatgtacttccctgcatcctgtttttatcacttaaagatgtatcacttagagatagattaaatacagactaacacccttaatttcttttaccaagttagttccttattttgttattgcctgttgtggcttgggttttgaccagtagacacagtgctgccattaatatcattctgtatatcctcagggagattttagtcctaagcggagtaggttcccaggacaaggaattgttctcagcagtatcttttctcctgcttatctcatttattattacaaattcaaccattttattgttctatccatcgcttttaaattggggtagaagttacagtgaaaaacacaaatcttaagtgtgcagttcattataagttttgaccaatgtatacattcattttgacaaatgtatacactcatgttatactccaaacaatttctatactccaaacaaaatattgtttgttgtactccaaacaatatttctgtcaccctaaaaagttctttagtgtctcttttcaggcagtctctactctctcataggcaaccactgttcctgtttctttcaccatgggttagttttgcatgtccttgaacttcatgtagatggagtcacacggtttgaaagtttttgtgtctgacttattttgcccagtgtaatgttgttgaaattcatccatatttttatattgtatctgttgtttgttccttttttcaggacactatttcattttataaaaataccagaatttttttgtttttttgttctcttgttgatggacagttaggttgtttccagtttgggggtattatgaacaaagctgctgtgagcattattgttttggggaggcagttttcatttctcttgagtgaatacctaggcacggagctgctggatgatgcggtgctaaagagttttccaaagtggttggggaagtgagtatttttaatttaaaatggatagtcagttccttcattaaagggcttaaactcaccagtgactggtgaatttctaccagtggctctccacgtctccaccagcaaagagagtttctctctttttaaagttgtgccagtctgatgaagccagagtgagagcttgctgtcactctaatttgtagttccctgagtgcttaagatggcatcatcattttttaaaaagctctccagaaaattcaaatgtacaggcagggttaagaatgctgctattgaaaggtgacagggggaagacaaagatctgacctcttcaggcagtagcaccaagaatgcagggtggatgttcattatttaggatcagggagacttctacaaatttgtttgtggataggctaaagtgactgatgagaagtgagaataagtttttagaaatattgggcagagatgggattaagaatggaggtgaaggtattagattctgcaaggatcaggaataggggagaaggaacgcacagtgcacagttgcctggaatcattttgcacagtgcctgaggtttctttgtatccagtgggaaaattaattggtattcgtgatcatttgtataatgagtaaactttcaaatagggttgtttaaagggactgaatttcacccatctggaaaattttgccatccagactggctcactccagaggtgccaggtagctgaagtttctgaagagctggacatctatgttatatggtgtgtgcagcccacataggcctggtttcccacttaactaaacgctttgtatcaagaatggacttgtttgggaagggaatattttgtaagatgatgcctagtattgtctgagagagatagagctttcaggttaagatcttgaggcttgcaccaagtgcaaaaaatgaaaatcagagtgcattgtgttggggaaaaaaaagtgagtttggttccttttggggaagagtgggactcatgtacacgagcagaatggaggctgatacttcatctcatttagctgcttgtttgttagtactaaacaggattagtatgaaaacaggaagttctcagctggagactttaaaggagaaaggaggaatattaaaattccctttgttttgtgaaagccactgaaatttaggttttggttgttaccatgctataccctagcccatcctgactgatagaggcattgcctgacacagaaccctgccatcatctcattctacaggattggtgctccatggtagagccagggtattttttcttaataattaaagtatttttttttacctttcctctgttaaggtggacttaggtgaaggcaagatttgcttctgttgtgaagaatttcaaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgttttactcgtgcacaccccggatgaaccgcaggatggttggtcctgatgttattcccctgccacacatctacggagctcgaatcaaaggtgtggaagtgttctgtcctctggatcccccgccgccatatgaagctgtggtgagccagatggaccaggagcagggatcttcattccaaatgtcagaaggatcagaagctgctgtgatcccattggatctgggctgcacacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctccatccttctgaggagagaggtgatgtcattccccaagctcttcgcagggctgtgtgcttatttgcctaaaggagccaggtgaaggcaggtggctctggccagctcaggaccctgcagtttaagtggtcatttgaaggagcttatgaggtcttgggaaagtaaaatattctacgtccatgttaggaatatatatctaccatgtcttttaaggatggtagggtttttttgtttttttttaaagtcattgtcatcaaaagaatttggttgtacatgatactatgctaggtactacatgaagacaattatgcaaacctagttctgatttctagatgctgcaatcctataggaatatgcattgtcttaaaaaaagtcaaaaggatttttgtataatccctcttttataatttgttatatttttactatgtatgagtagatgattgaattattgaaatctgaccttgtttttagaactttggatagaatgaagtacacgcacccacacaattcacctctctctctgtgttgagtttgtgtatagatgttacctgaataattaaaaattaaaataataacactgacttttttctgaatatatgaatacctgaacatctctaaatatctcttcattgtagaaaattataaaaaataaagaaactaaaggaagaaaattaaaacctcctgtaactccaccagcaccagcttcttcttgtgaagtagtctagcagagttgacctctgctgttctaaaacacctatgcaaataaaactttgataatcctccaccctgctctctctaaggtcctgtcttgagcccttgcagtctcggttctggctctctgacagtgtgtgttatttgccacagctctggactgaccatgtgcgagccagagagaacattcctcttgtctctacagcagcttctaagtggagaggaagtcctgccgcctggtactgagcgtgtctctgaaacacagtggccgggcagcctggcttctgattcccaagacctgccttcactgtgggtctcctacaccctacctggcaagttgaggactccagcctcaacgggaacttagctgtttgcacagcttagggaaatctttccagaaccccttctcattctgcagacctgcgggggcaagaacagcagctgctggagccctccattgtggaaggcgccaggttgccttcaagtggaagagtggagaccctgactctgtcctcacacgagtgtctttggcgagtgcttctggaagactcttgctgtctgtgacgtgcatatggctgcctgagaggacagtctcgaatcctggtttagagctccccacacctgcctttctccagaggaaagggggtgctccccttcttccacctgctctctcgccccctgcttcttgtcttctttgaatttctaaattgctgcttatcaggccttcatagactgaagatgccaatgttgtgtatgctgaaggctgctggctgacttctggacacataatgaccagatctgagttttgcttcacacacttcacagtgcagaagcattgctggtctttacacccttgctgatataggcagccatggaaattagagcctgcagtggatttcccaggctctctgttgacttccagaatgatgtgtactttttctgcacctaaatttctcttttggtaatagctatagatctacctcatatccatggtgtgagcatcaataacacaagtcagtacaacgtccttgaggacgtttgggacaaaggtatagtcaaagtgatcagaacattacattcatctgacaagtcttgtctctcttcagccccttcctctcttaattgactacttcatcctcgctccttggaacatcctttcattggtcagccacatttttcctgcttggcccatccatccccatctatttgtcataccccatgaaacttaacctcattatggtttgcattctggattctcctctccaccatctggctttaccttgggggtggtgtcgtacatgacacaatgacgtgtttcgggccatatcctattggaactggacttcagggaataaccttgtgttgttttccctccttctgcaagatgaaaagcaggatgtgcatggctatcagcatttgtcagatgctttccatgttgagttttgtggtctgtgctttcaggtacaggcatatgttcaaaaggggctggccaatgggtacatgttgtttgtttctgcccacagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaagctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgggccactgggaaaaaaaaaaaaaaaaaaaaaaaaa

SEQ ID NO: 5035 - DNA, 2566 bp, Homo sapiens
ggacagagcagcagaatttcaactccagtagacttgaatgtgcctctgggcaaagaagcagagctaacgaggaaagggatttaaagagtttttcttgggtgtttgtcaaacttttattccctgtctgtgtgcagaggggattcaacttcaatttttctgcagtggctctgagtccagccccttacttaaagatctggaaagcatgaagactgggctttttttcctatgtctcttgggaactgcagctgcaatcccgacaaatgcaagattattatctgatcattccaaaccagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtgacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacacgctggttatctaaatgagaagcagagaaataaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatcccaaaaaaaaaaac

SEQ ID NO: 5036 - DNA, 1966 bp, Homo sapiens
agctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggtgaggtggctggggcagaaggtcaaagatgctgaggagtgggtggcagagccctggggctgggcaatggctgaggccgtgggagagagcagagcaggtgcaccgggattagtcaccttagagggcttccctgtctgcagagccctgatccttggggtccagtgtgcagggcagactcctctttgtaccacactgcttctctgtacacaaggaacctcccaggggcctgcagaggctccctctacctaccctgcctccctcatgagggtgggggataagtaaggaaatcttgtcccatttcaaactctcaaagctgaacatctacatagaagcttggaaattagaggggaacttttgggggcataggcctaataattagattttattttggagagtccttggtctaatgggggagatagagtctgatggtggaggcaatactgagcagatgaataaaaatcatttagagggtcagatagagcagagggagaacaaaggaggggtccttgtgggaagtggggtccccttgtgggggaaggcttgggagtgagaggtcaggatgggtccagatgcgcacatccacatcccctttttccataggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcatggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggaggcagccgccccatctgccccacagtctccggcctctccagcctcagccccctgcttcagtcccttccccatgcttccttgcctgatgacaataaagcttgttgactcaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaaa

SEQ ID NO: 5037 - DNA, 2382 bp, Homo sapiens
tccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaggggggggcgcaaaaatggctggggcaattatagaaaacatgagcaccaagaagctgtgcattgttggtgggattctgctcgtgttccaaatcatcgcctttctggtgggaggcttgattggagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcatcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtaggaggctgcagcgcccggctgggacggtctctccataccccagcccctctaactagagtggggagcatgccagagagagctcaatgtacaaatgaatgcctcatggctcttagctgtggtttcttggaccagcggcatggacatttgtcagtttgccttctgacggtagcttttggaggaagattcctgcagccactaatgcattgtgtatgataacaaaaactctggtatgacacattttctgtgatcattgttaattagtgacatagtaacatctgtagcagctggttagtaaacctcatgtgggggtggggtgggggtgtattccttgggggatggtttgggccgaatggggagtggaatatttgacatttttcctgttttaaattctaggatagattttaacatcctttgcggtcccagtccaaggtaggctggtgtcatagtcttctcactcctaatccatgaccactgtttttttcctatttatatcaccaggtagcctactgagttaatatttaagttgtcaatagataagtgtccctgttttgtggcataatataactgaatttcatgagaagatttattccaccaggggtatttcagctttgaaaccaaatctgtgtatctaatactaaccaatctgttggatgtgggttttaaaaaatgtttgctaaactacccaagtaagatttactgtattaaatggccttcgggtctgaaaagcttttttaaaaaaaaaaaaaaaaaaaaaaaaaaaaaaaagaaaaaaaaaaaaaaaaaaa

SEQ ID NO: 5038 - DNA, 2740 bp, Homo sapiens
gggctgtaaccttgaactttcccagcgcggtgacacattctccccgctctccctcccgcccgcccgctcgccctcctgcgccctcccgcgcccccctccccgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcgacaagcacggccagcgcgctcggactgcaagagggttaaaagtgtagattggatttcacccctggaactctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcattcaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccacgtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagcctaacggcagtggtcaagtagtagggaaagtgcctggccatttcactcctgtcttggcaccctctccccatcccagtgcagtgcgacctgtgaccctgagcatgacagatactaaacccatcactacatccactgaagcctacacagcctcaggcacatctcaagccaatcgatatgtgggactaagcccaagagacccatccttcctacatcagcaacagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaatttttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagagatgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcaaaaaaaaaaaaaaaaaa

SEQ ID NO: 5039 - DNA, 4371 bp, Homo sapiens
agacacagagagacaaaggcaaggaggactgtctgggagccacgcgggcgatacagtttccgaggcacgccgcgtcccgcctagcctgttgaacaggtagacatgagcgacccaagctgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcctagagtttgaacggctgaatgttgcacttcagagaacattggcaaagcacaaaataaaagaaagcaggaaatctttggaaagagaagactttgaaaaaacaattgcagagcaagcagttgcagcagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaagaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtatgtactcacttcagtacttcagctcttcaagaaaaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaggtttttgaatagaaattacattctttgacaccctcagttctttcaaactttcaactctgcattttattgcattttctcatttaactgttagtatatgtttgaatataggctgactttttttctctattgcacttccttctttttttctttttagaaaataagcaattaggggttagatgcaatatgaatataaaatagttctgtaaataccaaatattatttttagttctggaagttaaaaatactctccatagtaacgtgtgttataataataaatatttcttttgtttgacttttttaaaattctacaatggtaaaagctattttaatccatgttagcaatttaattcctattaattcattttactatcataatagcaaagtattcagaataaaagaggtttatatcttctattaaaatgcagtaatactattcaaatctaatttagctggaagcaacatgggagtaaagtaatcatccaggggacccaccataaaggacattggtaaaacatttacacacgtaaacacacgtgcaggcacacttggaacaatatggacccacttcagcagacatcttctattgccatgctgagctgtttaaagttttaagaagaaaatctaagtatggaagtagaaaataagacttgttcttttggtggatatctcatttttcttgagtatttgtgctgaacattttggtgtatgtctatgaactaagaatcaagtttttgtctcattaaatatacatatatgaagtgtttttattctacttgaaatatcttgacttaaaaaaaacgactgttagtattgatgaagcaaatgaggcagtgactacattatggaaatgtctaagtattttttccggaacttcaactttttctttttgttttacataaacatttaagcagctaggaacttttagttttaattaggtcagttgaagttctctggtgaactaaaaaatctacattttggttggggataaagatttgattttaaaaacagcttgaatttaaagcaagaaaaagatgaacgttatagttttaaaatcaatattagcagagccatagataggctgagctcttatttggggttctgagaaataactcagtttaaaacttctttaactgcctcccttagtacccaggctagcccatggtgacatcagggatattcattactgattggcctctagtattccaagggtactactatagatattacaatgatgctgtttactaagtgataaccccgtatcttacaggactgactttgactcaataaaccactcagcctattattggaaagtgccataggccttgagaaagtatagttacatcctcacaaatatatgaagttaagtcactacttacaaggaaaaaaaatgtaaatacatttttctttctggaaccgaactcttattatggggaaataatagaaataaagaaaatgtaaaagcatgaaatggaatgtagtcttgatcaaacatttcagcagacctcaatttgcttacaatctgtactcaaaaagtttataattcaatcagaattcaaaaagtattttgtgtgtttgtgatgtattagcatatacacaaaacaaatgaggggaatgtatataatcttggtgaaaagttgtatgggagttttttgtacgattcctgcaacttttctataaacgtggcattatatctaaataaaaaattaccaaaaaacaaaaaaaaaaaaaaaaaaa

SEQ ID NO: 5040 - DNA, 511 bp, Homo sapiens
  misc_feature (446)..(446): n is a, c, g, or t
ttttttgcttgatatgaggggttccgtgactgaggttctgagctgctgttgatgtgctatacctccttcaattctcagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagagctgccacctacagtctgggtggagaactacccaggctattatagacagttatgtctgaaaaaatatctttacactcacctgggccattggcaaccccaggccacacctaagggtcatgaaaaccaggaatccaacttacaagggatgtgaaggacctcttcaaggagaactacaaaccactgctcaatgaaataaaanaggatacaaacaaatggaagaacattccatgctcatggataggaagaatcaatatcgtgaaaatg

SEQ ID NO: 5041 - DNA, 920 bp, Homo sapiens
  misc_feature (13)..(14): n is a, c, g, or t
  misc_feature (800)..(800): n is a, c, g, or t
aaggcttggtacnncggtccggaattcctcgggatgccacgccaacagtcagaggtcgcgcaggcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcgcgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatagtaaatatccccattttcctctgcaacacatatcctaccttgtctataccgctaactctccctgtgtgaggatagctgcagcagctctaaccactgcaaatcatgtttttctccattaactcttttctttgatttcatctcagtcctcagaatttaaatataataagccagccttcctcaagaatgccagacagtggacagagaagcatgcaagacagaaacaaaaggctgatngagaagagatgcttgataatctaccagaggctggtgactccagagtacacaactcaacaccgaaaaaggaaggccagtcagctagtaggcatagaaaagaatttcatcctgatgttttag

SEQ ID NO: 5042 - DNA, 580 bp, Homo sapiens
ccgtgagcacttttcatttcctgccgctggtgctgttggataccttacggcaagctgccgtccctgcccacccacctgaggacaggaacctccaactctgccttgccagaactgaccagtgtgtctgacagatggatatagaagacttagatcactacgagatgaaagcagagcccattagtgggaaaaagttggaggatgaaggaattgaaaaagaaaatttggcaatattagagaaattaggaagactgaaagacaagagcatttaactgcaaactgttgtcgttgtcaactgggttgtcttcctgaagtatgaatccggtatgtattgtgtggaggagcattacgtactgaacttctcacaaaacagggctgaagcagtgcctactcgacagaaccggtcatcgtacaaagaaatgccacgtgactcaaaggcaaagccagagtgcagcttggagcaaagaagatgatgtctcactctgtcacccaagatggagtgcaatggcacgatctcagctcactgcaacctctgcctcccaggttcaagcaattatcctgcctcagccacccgagtagctga

SEQ ID NO: 5043 - DNA, 575 bp, Homo sapiens
  misc_feature (146)..(146): n is a, c, g, or t
aaacgtacaggcgacagcaacagcagcagcaccagcgcttacttcagaaacagacctgatacaggctccatcttcatatgggaacagctccccacctgtgaacaaaatgaacagcattgtcagtttcttagcgagggtgggctgtncatcatgtctggactatgtgacgacccaggggctgaccaccatctatcagatggagcattactccatgggtgatctggcgaggctgaaaatccctgggcaatgtcgacatgcgatctggaagggcatcctggaccaccggcggctgcacgaattgtgctccccttctgatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagcccccttaaagcactcct

SEQ ID NO: 5044 - DNA, 582 bp, Homo sapiens
ttcggcacgaggctcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttgctgtctttttggaaacaatgtcactctggctaacaaatttgagtgctgcagtgtgccacgaaaaatcaatgtcagcccaacaacttacagggaagaatttaccagaggaaaactagctggtcatcgagcacttttcaaagattgcagttttatggactggcagcaagtgttaacacggtcagaggagccacgtgtcatctagcatcagaagaacctttattttcactgtcgccttgacaacatgtagtatacagcctgagtcaataaaatctaccattttgttatcacttatccacctttaaccggaaaataaaccaatc

SEQ ID NO: 5045 - DNA, 599 bp, Homo sapiens
ggcacgagggagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccaaatcactttttggtttctaagaatttcttgatactcttatagcctgccttcaattttgatcctttattctttctatttgtcaggtgcaca

SEQ ID NO: 5046 - DNA, 624 bp, Homo sapiens
acctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccatcggtgactacaagaacgccctgctgagcctggtgggcagcgacccctgaggcacagaagaacaagagcaaagaccatgaagccagagtctccaggactcctcactcaacctcggccatggacgcagacagatgcctcagcatgaagggcttggggacttgtggatcattccttcctccctgcaggagcttcccaagctggtcacagagtctcctgggcacagccggagagctggctgggagcccttttgttttagaacacacatccttcatcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctga

SEQ ID NO: 5047 - DNA, 498 bp, Homo sapiens
actgccagtgtgaaatcttcagagaagaatttctctttagctctttgcaagaaggtagagataaaggtgtgggaaggacttgtgaaatacatattcgaggaaaaactatgcacaaggccgtgcatttaaaaataaactccctaaggctggggtgaaacctgctacggtctgcgcaagttgactgttaatgaatttgattctcgggtacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcatcatatctccaggaaacaggaaagcccctgga

SEQ ID NO: 5048 - DNA, 367 bp, Homo sapiens
gcctactggacacaacttggggcccctctcctctccagcccttctcctgtgtgcctgcctcctacctggacaaggtgcgtgccctggaggaggccaacactgagctggaggtgaagatccgtgactggtaccagaggcaggccccggggcccgcccgtgactacagccagtaagacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccct

SEQ ID NO: 5049 - DNA, 585 bp, Homo sapiens
agatccagtccggcccgcagcgcaactcggtccagtcggggtgggtgaggggcggcggcgggggaggggacgactctgctgagctcagcctctcttggtggatgtggggcggggcgctcgagtaggacccgacgccaaggggagggggctgacctgtgcttggtccaccccaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttc

SEQ ID NO: 5050 - DNA, 345 bp, Homo sapiens
tctaaatacagagcttacaaaaccaaaaagaaatatgcaacctatagagcttcagctattataattcagagatggtatcgaggtattaaaattacaaaccatcagcataaggagtatcttaatttgaagaagacagcaattaaaatccaatctgtttatagaggtattagagttagaagacatattcaacacactaattcagtcattctatcgaatgcacagggccaaagttgattatgaaacaaagaaaactgcaattgtggttatacagaattattataggttgtatgttagagtaaaaaaaaaaaaaaaaaaaaaaaaaaaagtactctgcgttgttaccac

SEQ ID NO: 5051 - DNA, 644 bp, Homo sapiens
  misc_feature (602)..(602): n is a, c, g, or t
caggccagactcgggagccgggcgccagcacccgccagagctctgagccccgaactgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaaaaaaatcaatgtgggaattggggagataaangatatcccggtggtggggatccccaaaatggaggcttcacca

SEQ ID NO: 5052 - DNA, 789 bp, Homo sapiens
gggaacaccacccagtgtggagcagcccagccaagcactgtcaggaatcttgtgaagcatcatcaccaactgggacgacatgggaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcgggaaatgaaacgtttccgctgcccagagaccctgttccagccatccttcatcggggatgggagtctgctgggcatcccattgaaaaccaccctacaaacaggcattcatgaaaagtgttggattatttgaaccatccagggaaggggacccttctattggccttacacaaatggtcccctaatccaggggggggccacccat

SEQ ID NO: 5053 - DNA, 829 bp, Homo sapiens
ggtccgcaaagccacacagcaggccgagcagctcagcaacgagctggccacagagcgcagcacggcccagaagaatgagagtgcccggcagcagctcgagcggcagaacaaggagctccggagcaagctccacgagatggagggggccgtcaagtccaagttcaaatccaccatcgcggcgctggaggccaagattgcacagctagaggagcaggtcgagcaggaggccggagagaaacaggcggccaccaagtcgctgaagcagaaagacaagaagctgaaggaaatcttgctgcaggtggaggacgagcgcaagatggccgagcagtacaaggagcaggcagagaaaggcaatgccagggtcaagcagctcaagaggcagctggaggaggcagaggaggagtcccagcgcatcaacgccaaccgcaggaagctgcagcgggagctggatgaggccacggagagcaatgaggccatgggccgcgaggtgaacgcactcaagagcaagctcaggcgaggaaacgagacctctttcgttccttctagaaggtctggaggacgtagagttattgaaaatgcagatggttctgaggaggaaacggacactcgagacgcaaaacttcaatggaaaccaaggccagtgaaataagcaacctttctacaaatttttgcccccccggcaggaaaaccccgtcaaatcattatataagctgaatattataaacatggtcgggcccgccctttggcccttcgaaggaaaccttttctagaaacatttccccttttggggggccgggggggccccccgtttaggggttaaaacggcaat

SEQ ID NO: 5054 - DNA, 846 bp, Homo sapiens
tctagcgaggtgacagcgtagaaccagattggtgcctaccatggctggggatacacagtgatggatttgtgacttgctcctctgaaagctggcccaagggtgtacagcatatgaatgtgggggagtttacactacacacgctcttggctattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagatcagctcccgttacggcaactttgacatttttagagatgaactaaaagtcgtttttgaagatgtccttccagaaacccaaaactgaagatatagtaaccagtggcagaaaagcaaaaaccatttgtcaagggtctttgtaataaactgaaatcctgcctcttgaataggccaaaggctgggaagaaacctcttaccctaaaactgttttaccagcacaatattatgggggttgcgccctgtagcccacccgaaaaaacctggggggagcaaaaaaaatattggggggcccttcttttggggaaacagcttgtaaaaaaaaagcctatttttggcacacgaaacctgtaaaaatttcccttaaaataaatatgggggaaaaaaaaaaaaa

SEQ ID NO: 5055 - DNA, 795 bp, Homo sapiens
  misc_feature (492)..(493): n is a, c, g, or t
gggggttaatggaacatttacaggatgcaaagcactgtgctaggcaccaggagaatgcagaaagggcacatccccttccttcaaggagtttacagctttctcagaagcagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagatgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtgacttaagtgtgaatttggagtatgcaccaactgaaggtacattggacaaaaaaannaaaaaaaaaaaaaaaaaaaaacatgtcggccgcctccgcccctcgagaaagctttctaaaccattcgttttggcgcgccgggccccggtaggtaaagtgaaacatggcccatagccttgtttcccaaagaaaatcccggggtcaatgcactaggggcttgggaatttccccccccaataaaaaaacccccccgggcggggacaacccggaaacggttttctggaaaacaaaattccccgaaatggggagatttctcctaaaagggtcccttttacccgtgggaatttctatttcccacacaa

SEQ ID NO: 5056 - DNA, 626 bp, Homo sapiens
  misc_feature (348)..(348): n is a, c, g, or t
ggggcgcatgcatttttccttccacagaaaacatacaaccatgtttctgccaacgtagttgaccaagataacctgttttttaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatccctggtgggcaatccatttacatgctcctgtgacattatgtggnatcagactctccaagaggctaaatccagtccagacactcaggatttgtactgcctgaaatgaaagcagcaagaatattcccctgggcaaaacctgcagataccccaattggggggtttgcccatccggcaaaatctgggcccgcaccttaacctcacttgggggaaaggaaagggaaaattcctatccccattttacccctgggaaaggggggggcaagggggtgaatcccggggtttccccaaaaaaagggtaattttgggggaaaatttttttttg

SEQ ID NO: 5057 - DNA, 754 bp, Homo sapiens
ggggaacaccacccagtgtggagcagcccagccaagcactgtcaggaatcctgctcacggaggcacccctgaaccccaaggccaaccgggagaaaatgactcaaattatgtttgagactttcaatgtcccagccatgtatgtggctatcttgtctttgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgccccagagaccctggttccagccatccttcatcgggatggagtctgctggcatccatgaaacccccttacacagcatcattgaagtgtgatattgacatccgggaaggacctcctttgctaacaatggtcctatcaggggggcaccacctatgtacccctggcatttccccaaccgaatgcaaaaaggaaaatcatgggccctaagcaccccactcacccttgaaggattcaagaatcattgg

SEQ ID NO: 5058 - DNA, 820 bp, Homo sapiens
gggcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgagtgatctcctgaaatgcttggatgacattgaaaaaaaattagccagcctacctgagcccagagatgaaaggaaaataaagatgaactaatgacttatcggtatatggacgacttcttactcatgttagcccattcattttcatcaaaacatcttcccacatcagtgttcactctctatagaattttttggcatatttgtccaaaaaatgttttttttccggttattaattttacaccttttttattttgctttcatttctccggttggagttccctcaaaccttttaaaaaagggaaataaaataaatttatttcaccttacccctcctaaaattaaatatcctaaggtgggaacggtccccctaaataaaataaatggaggttatccccctccccaaatttggttttccaaaatccccacaagaaaccccctgagggaaatttttgtaaagaaaaacacaaaaatgtttttgcaacccaaatttttcccacaacaatttacccttaag

SEQ ID NO: 5059 - DNA, 876 bp, Homo sapiens
  misc_feature (760)..(760): n is a, c, g, or t
ggatgaaaaagaaacagcagtatccacagaagacgattcccaccataaggctgaaaaatcatcagtactaaagtcaaaagaggaaagccatgatggtaataccacgcccagaaatcatggagttgatgatgatggcgatgatgatggcgatgatggcggcactgatggccccaggcacagtgcaagtgattgctacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtataggcaacatgagggtgcatgctgtggattcttgcatgagcttccagtgtaaaagaggccacatctgtaaagcagaccaacagggaaaaaccttcacctgggtcctgccaggatcccagttgaccttgtcctcccaaacaaaaaccccctttgaatccaaggattggtcggctactggaacaaatcagaacccctaccggcccaatcttccctggtccaatcctatttccgcctaaccacaaatggcaggcacttgcggaggcgggattcccaaaagaagggggcgaatctaaaccttcccaggctggggaatttatttttaggcgaagccctgggcaaacatccttatttctcctcacctcttgtaccggggcgacttctgngcaagatggagttttcaccatgtttttccctcttccaccgagcatttaaggaactaaccggggttccccaccagaaattgattccctccccattggccccggctttctttaatcca

SEQ ID NO: 5060 - DNA, 730 bp, Homo sapiens
gggagtgtgaaatcttcagagaagaatttctctttagttctttgcaagaaggtagagataaagagtcttgttatgtcgcccaggatggagtgtagtggtacaatctcggctcactgcagcctccgcctcttcctgggttcaagtgattctcctgcctcagccttctgagtggatgggactacaggtgcacaccaccatgcctggctgatttttgtacttttggtagagacggggtttcgccatgctggccaggctggtcttgaactcctggcctcaagtgatctgcccaccttggcctcctaaattgctgggattgcaggtgtgagccaccatgcacagccaaaatatataacactttggaatcaaaagggatggatttatgtctccattcttgccactactagcaggaagactgcttgaaaatagcactcagttttcccagatagaaactgaggataatgattaaaggctattattccaagcaaggacactttttcaaaaatggcaatggtatcagaattcctcaagcaagcctgggtttattgaaaatgaagagcaggaatatgttcaaactgtgaagtcattcaaaggtggtcccggatcagcggtgagcccctatcctaccttcaatccatcctcggatgtcgctgcctttgcttaggccataagggttaaaggtgtggatgtagccaccatcattgacatttctaactaagcgaaaccattgcaa

SEQ ID NO: 5061 - DNA, 884 bp, Homo sapiens
accggaccgaaggatagaaactccatctgagggtggctgcgtgtccacatacgaggggacagggctgaggatgaggagaaccctggggacccagaagaccgtgccttgcctggaagtcctgcctgtaggcctgaaggacttgccctaacagagcctcaacaactacctggtgattcctacttcagccccttggtgtgagcagcttctcaacatgaactacagcctcccaagtagccgggaccacaggcgcccgccaccacgcccggctaattttttgtatttttagtagagacagggtttcaccatgttagccaggatggtctcgatctcctgacctcatgatctgcctgcctcagtctcccaaagtgctgagattacaggcgtgagccaccgtgcctggcctgctgcagagtttttaacgggctctaataagttacttccacgtgaaattccaagaaggagtggtagcacttcccaaacgttttaaaccatggaatcttctttcataagcgttttgtgggacaatcatttcataaaaaacatttcggtgacaacaaatatagactagcccctgagacctaaacttttaatatttaatttatgccatctatctgatcactaactctcaaagggtctgtggttccagatgagttctatgaccatgttctttgccacccacccacccttactctcccaagatcatatcagccacaggtcccagtagaagatatgaaaaaggtcatggacttttcatcaatgtactcatcatttgtcagcaaatatgtccagggctacatttttaggtctaaaaaatcacaaagaactttattttattttcttttttcatttttttttgtttttatattataatttttatttatact

SEQ ID NO: 5062 - DNA, 883 bp, Homo sapiens
ccggagagcaggcgtcgggacgcagcaaagagaggagaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggaagaccaagcacctcatggaagatgcagttggtggaaatgtaacctcaaaaactgggaccccaccccagaaaccttcgtttccttcaaggaatgg

SEQ ID NO: 5063 - DNA, 1023 bp, Homo sapiens
  misc_feature (630)..(630): n is a, c, g, or t
gaccggaccgaaggagtggaaagcactcccgctcctccgcccgaccgcgcgctcgccccgccgctcctgctgcagccccagggcccctcgccgccgccaagatggacgccatcaagaagaagatgcagacgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgccgaagaggccgccgccaaggctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctgnaacgtgcagaggagcgggctgagctctcagaaggcaaatgtgccgagcttgaagaagaattgaaaactgtgacgaacaaattgaagtcactggaggctcaggctgagaagtactcgcagaaggaagacagatatgaggaagagatcaaggtcctttccgacaagctgaaagaggctgagactcgggctgagtttgccgagaggtcagtaactaaaatggaagaaaacattgatgacttaaaaagacgagctgtacgctccgaaaactgaagtacaaagccctcagcgaaggagctgggaccacgctctctcacgaaatggacttccataataagttttctttgccttcactttcctccaaagaatcccctccgttcaaagctgggaagttcca

SEQ ID NO: 5064 - DNA, 593 bp, Homo sapiens
cgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatgaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccaaactgcacacttttacttagaggacagtacatcccctagagttatattcacaccttcaacaccta

SEQ ID NO: 5065 - DNA, 560 bp, Homo sapiens
atatcgaattcgtatcggccattatggccggggacacaaccaagggagaaaactattctgtcaaagagacggtgccaaaaggcaaaaacaaaggagaatgtggaagatggccgagcaagtatctatcaatctgtcgttaccaacaccagcaaagaaatgtcctgtttcagtgactttccaatgcctgaagattttccaaacttcctgcataattctaaacttctggaatatttcaggatttttgctaaaaaatttgatctgctaaaatatattcagttccaggtatggagaggttcaaaggccaatatttccatagccgccaatacaagcatccagatggatttgagggaaaacgcatcctggtgattggaatgggaaacttgggctcagatattgctgttgagctgagtaagaatgctgctcaggtttttatcagcaccaggcatggcacctgggtcatgagccgtatctctgatcactggctgatggctatccttgggactcagtgttccacacccggtttcgttctatgctccgcaatgtactgccacgaacagccg

SEQ ID NO: 5066 - DNA, 515 bp, Homo sapiens
gtatcggccattatggccggggagtgtgaaatcttcagcagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtgaatgaagacttggctgattcagatgccagggccttgtgtgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacatcgagaaatgcctcacagctatcgtgaagtgcgccacaagca

SEQ ID NO: 5067 - DNA, 736 bp, Homo sapiens
gctgatatcgaattcgtatcggcattatggccggggagtcaaggagtgagggacagggaatgaacatgccatggcacagggcaggacctgctgaaagacagacaggcccagcagcgtagagaagcggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggacatgatgtggagt

SEQ ID NO: 5068 - DNA, 735 bp, Homo sapiens
  misc_feature (292)..(292): n is a, c, g, or t
  misc_feature (681)..(681): n is a, c, g, or t
  misc_feature (703)..(703): n is a, c, g, or t
cctctgggggttttatattgctctggtattcatgccaaagacacaccagccctcagtcactggggagaagaacctctcataccctcggtgctccagtccccagctcactcagccacatacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagatctggcaccactccttctacaatgagctgcgtgtagcacctngaagagcaccccaccctgctcacagaggctcccctaaatcccaaggccaacagggagaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggncacagcagcttcctcttcctcnctggagaagagctatgagctgccagatgggca

SEQ ID NO: 5069 - DNA, 879 bp, Homo sapiens
gtggaggtgaagagttaatggctccgcgcgcaggcactgccctctgaactggaacaaaatgcaacttccggttggagtcactcggccaggcgccggcgacctgaggggagagggaacgcagctgaaagcgtgaactgtgagatgcttttgacaagttataataagggagagatggtagtaaaggaagtgaagaagcgacgtgaaattgaaggaaaagaaaatgacctgccttcttaccgcggttggaatacacacccaaacgagagacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagcagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccaccttagcaaacttaatataccagacactgcaactgcccatttggaagcccttttcctaatcaagacagtgactcgg

SEQ ID NO: 5070 - DNA, 875 bp, Homo sapiens
ctctagcgaggtgacagcgtagaaccagagacgggggtgggcgccgagcagcgccgcgccggctgctgagctcgcggggccgggccgtgagaacgcgcggggcgcgccggggccgctggtctcccacggccagggcgcctgggccccagagcccatcagccgcgtgcagcgctgcggcctccagcgcgccggcaggcaagcgagcgggcgcagctgggggatgcctggaccccggaggcagcagggctggaggcggtggcgggcttcagggcaacttcacccggccggctgcggcgtggacatcccagttaccagtgtccttgaattgatagtggcttctgtttgtcagtctcatataagaactacagctcatcaggaggagatcgcagcagggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcaaagaacattggcaaagcacaaaataaaagaaagcaggaaatctttggaaagagaagactttggaaaaaacaattggcagagcaagcagtttgcaggcaggaagttccagtgggaggtttattcaaaagaatcttcttggggtggaagagggtttttttaaaattatggtttaccgaagggaagaatggaaaaacctttccttttgggggggtggggttgggaaaggcccacccccctttaaaagaaaattgttgtcttaaaaccatga

SEQ ID NO: 5071 - DNA, 721 bp, Homo sapiens
  misc_feature (557)..(557): n is a, c, g, or t
  misc_feature (657)..(657): n is a, c, g, or t
ggcagcactgtttgcttcccagctagacctgtgtgagaggtgtctggaaatcatgcatggtgtatttgggactatatcaacctattctcctctcattaagcatccctaacccccagtcacaccttcctcttacatactgttccccaatggaggcccctggcataggggacagccctgggcatcttcctttggtgtctggctgttttgtcaactctcatccactggtggctcagagccataaggtgggttgattacacaatgccttgtacatgatatagaggcatcaagcaagtaaaatttgacagaaattttaaaatatgaagatgtatagctttcccaagatgatggtaaaacccaggttagtcatcagtaaccttctctattattattattttttagaaacttggaatactgtcgtcatggctaagagaacaaatctgataaattgtgtaacctagtctcttctctacatggtgatgcatttcagcaattataaattaaaataaatgaccaaaagtaaacttaaagcatgagatatttgctatttcattcattgngcacatatcaaattataattttgattttaatggtcacccatgtatttatttgtttgccagcaagtaaaaaaataccctaacaaaacctgatgtggtgggnagggcatgtcagtaagtggtgtgttcatgttgttgttcatattggcctttcaggagttgcaact

SEQ ID NO: 5072 - DNA, 563 bp, Homo sapiens
tggagctgggggcggaagcatgaggctaacggcttggcttcagtgaacgcaccgggatgtgcaggccgggagagcgaaccagacggacagtaaggtttggaggaagggggatcgttggaagtagcaggaagtggagagaatctggcaataggcgagaaaccgaaagaatcagaaagaagtctatgtgagtagctgaaagcattgggtgaccagaaagaaggtcgctgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagttatcgacgtatccggaatgtgggatcagaggctggtgaagttggccctgttgcagcatctgcgggccttctatggtattaaggtgaagggtgtccgtgggcagt

SEQ ID NO: 5073 - DNA, 483 bp, Homo sapiens
ggctcagatgaatgcggctgttaagacctgcaataatccagaatggctactctgatctatgttgataaggaaaatggagaaccaggcacccgtgtggttgctaaggatgggctgaagctggggtctggaccttgtaagtatacaaggctgcagtcggatacacctggtattgtggacgtggcctggagctggacgagacatttagtgtactttttgggcaattggagtcgtttgttattggtcctttttcatttttaatatcttaatgagatgatttaaggaagttacatgaatctctgctattaggcctatcatagccatgccactaccaaaagtggggggtgggtttgggggtgagaggtcaagtttatatacacagtatttaagttgtacaggtattttgctgctggaatattcttatggtaagactttttcttcagcaatcaaagccttagatgggagatctcaagtttcaacaccacg

SEQ ID NO: 5074 - DNA, 431 bp, Homo sapiens
gatgcctctggccaaataaacccctttcttctttatctcggtgtctgaggagttttgtctgcggcttgtcttgctacatttcttggttccctgaccaggaagcgagcaaaacttagagagtaacctcaccaaccttattaagaggaacacagaactggagacccttttggctaaactcatccaaacctgtcaacatgttgaagtcaatgcatcacgtcaagaagccaaattgacagaggagtgtgatcttctcattgagatcattcagcaaagacgacagattattggaaccaagatcaaagaagggaaggtgatgaggcttcgcaaactggctcagcagattgcaaactgcaaacagtgcattgagcggtcagcatcactcatctcccaagcggaacactctctgaaggagaatgatcatgcgcgtttcc

SEQ ID NO: 5075 - DNA, 741 bp, Homo sapiens
cccacgcgtccgcccacgcgtccgcaacggctcgcggagcggctacgcggagtgacatcgccggtgtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacaaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacactgcctcagtgcccagcttagaagagctgaaccagttcaggcaacatgtgacaactttgagggaaacaaagctggaaatgcagaaatcacaaaatgaagcagtgtgtgaggggctgcgtactcaaatccgagagctctgggacaggttgcaaatacctgaagaagaaa

SEQ ID NO: 5076 - DNA, 626 bp, Homo sapiens
tgggggctcctgtcccggggaccgccgaggaaatggagagcatgggcaggggactcagcatgggaagctggagagcttgatagagttaccagatttagcagataaatatacaggacgctcaattaaatttggattttagtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggccagcacgcctgcacaccaagccgtcccaggcacccgcc

SEQ ID NO: 5077 - DNA, 557 bp, Homo sapiens
ctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacaaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacatcaaaaaaaaaa

SEQ ID NO: 5078 - DNA, 677 bp, Homo sapiens
ggagatctccaggtggaaagagtactttacagcactggaggtggtatttggaaagggggtttcaacccaatgacactatcagtcctgctgtttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgtaaaattattttcataattggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaagggggaagagttcggacgcaggattggagacccacagttggtgatctgtatggactgctcggcaaacacca

SEQ ID NO: 5079 - DNA, 566 bp, Homo sapiens
ggcgcagagccgcgcagagacgccgcgccttataaggcggcctcggggagcccgggccacgctatataagggccggtttgctttataaagccgggctggtggcgtggggggcggcagggccagggccagctggcccagaagtatgaccaccagcgggagcaggagctgagagagtggatcgagggggtgacaggccgtcgcatcggcaacaacttcatggacggcctcaaagatggcatcattctttgcgaattcatcaataagctgcagccaggctccgtgaagaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgca

SEQ ID NO: 5080 - DNA, 622 bp, Homo sapiens
agtgctgggctataattatgtttttattaaatttggagggaagtttttgcagcctttcgcctagcgtggccttcaggttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaaagttacatgtctggatactggctactggctactgtattggtcagcacagctttgaacagcgatgtcttccacattgttgtctccagcctggttcttccctccgaagctgtccattggacatcctcacctgatccctgctagtgtccctgtgcagattagaaaaaggcaacacctctggacttgctcccttagcccttggctgtgcattgcacaaaacaccatctaca

SEQ ID NO: 5081 - DNA, 741 bp, Homo sapiens
agggagcggcgccgcacccggccggaggcggagggcagagcgcgcgcccagttgcccgggcaccaaatcggagcgcggcgtgcgggagggcccagagcaggactggaaatgtcctggccgcgccgcctcctgctcagatacctgttcccggccctcctgcttcacgctgtgaagtaaggtcaggcccagagttcatcacaaggtcctacagattctaccacaataacaccttcaaggcctaccaattttattatggcagcaaccggtgcacaaatcccacttatactctcatcatccggggcaagatccgcctccgccaggcctcctggatcatccgagggggcacggaagccgactaccagctgcacaacgtccaggtgatctgccacacagaggcggtggccgagaagctcggccagcaggtgaaccgcacatgcccgggcttcctcgcagacgggggtccctgggtgcaggacgtggcctatgacctctggcgagaggagaacggctgtgagtgcaccaaggccgtgaactttgccatgcatgaacttcagctcatccgggtggagaagcagtaccttcaccacaacctcgaccacctggtcgaggagctcttccttggtgacattcacactgatgccacccagaaggatgttctaccggccctccagttaccagccccctctgcagaatgccaagaaccacgaccatgcctgcatcgcctgtcggatcatctatcgg

SEQ ID NO: 5082 - DNA, 505 bp, Homo sapiens
ggtcatcaagactgacatgttccagactggtgacctctttgaaggcaaagacatggcagcagtgcagaggaccctgatggctttgggcagcttggcagtgaccaagaatgatgggcactattttttagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagcctcagcccaacttcttacccgaaagcatcactgccttggcccctccctcccggctgcccccatcacctctactgtcttctccctgggctaagcaggggagaagcgggctgggggtagcctggatgtgggccaagtccactgtcctccttggcggcaaaag

SEQ ID NO: 5083 - DNA, 624 bp, Homo sapiens
cccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggacccc

SEQ ID NO: 5084 - DNA, 603 bp, Homo sapiens
  misc_feature (581)..(581): n is a, c, g, or t
cggggcgacagagagggaggaggcgcgcggggacggggacgcccaggaggacccactcgcgggtcccgctccgctccggcagcagcatggggaaaggacgcgcgggccgagttggcaccacagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattagggaatgacagtgcctctgccaatatcaccatcgtggaatcaaacgagatcatcactggtatgccagcctcaactgaaggagcatatgtgtcttcagctacatctacatccaccactgggacaagccatcttgtaaaatgtgcggagaaggagaaaactttctgtgtgaatggaggggagtgcttcatggtgaaagacctttcnaacccctcgagatacttgtgca

SEQ ID NO: 5085 - DNA, 451 bp, Homo sapiens
  misc_feature (3)..(3): n is a, c, g, or t
  misc_feature (10)..(10): n is a, c, g, or t
  misc_feature (36)..(36): n is a, c, g, or t
gcnggattcncccttggagtttaacctacactcaanggatgcatgaaaaaaagaaatgaaatgatttttttagctactttaaaaaataaagccttgcctccccgattgaaagagatgaaaaaccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgctacatctacatccaccactgggacaagccatcttgtaaaatgtgcggagaaggagaaaa

SEQ ID NO: 5086 - DNA, 555 bp, Homo sapiens
tctgaacctttcctttggaaaactaatgactccacctatcattcccttggcatctagagaagctacattaggtggcacagctctttctgctcagcttctgctccagagcttcatcttcaggaaccacctaagtatttttttccccagtaggagttcagtctgctcattatacctaattgcaaaggagctatattcagagcaagaataataatttcagattttttaactggacttcaaagagcaggaaagtatgcagattcctaaacacataagcattgaagatattacagctacatccacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcat

SEQ ID NO: 5087 - DNA, 1487 bp, Homo sapiens
gtctggcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccactcagaggctgagaatggtgtggaggagaaaaagaaagcctgcaggtcgccaacagcccaatcccctaccccatctgtggaggcggactccccagaccagaagaaaatcattagcctatgtacaaggccaatatgcactttcacaagttgtttcttagtgtcccaacggaggaaccactgaagcaaagctttacctgtgctctacagaaagaaatactataccaaggaaagctctttgtatcagaaaactggatttgttttcattccaaagtctttggaaaagacacaaagatctctattccagctttctcggtaaccctaataaagaaaaccaaaactgctcttctagtgccaaacgccctgatcatagcaacagtcacagacaggtacatatttgtctccttactctccagagattcaacttacaaactactaaaatctgtgtgtggacacttagaaaatacaagtgttggtaacagtcccaatccatcttctgctgaaaacagtttccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgtctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatattcttatattctatgcaattgttgtctgtgcactaatcatctcgaccttctacatgagatacagaattaatactctggaggagcagctggggttactaacctccattgtggacacccataatactgaacaggcagcaccatctggcctgaggtcacaagtacaattcaatgtggaggttctctgtcaagagcttacagctaacatagtgaaattagaaaagatacaaaataacttacagaagttgcttgagaatggtgactgatcgaccagattgcttagggacatcggaatacctcctgtttccctttgaagaaggtgcttcctgaggcgttttgtttgagtgcaccctgctggtcagaggtgcaagcagatgagaatccagacattgcatgtggaggtctccagctcaggaaagtgaggagggaaatacttttggttcttgtgcaataagaagttgaccttga

SEQ ID NO: 5088 - DNA, 423 bp, Homo sapiens
  misc_feature (2)..(2): n is a, c, g, or t
  misc_feature (400)..(400): n is a, c, g, or t
  misc_feature (404)..(405): n is a, c, g, or t
gnctatagggcgaattggagctccccgcggtggcggccgaggtacaaagctgaaacgcagagattttcatattatttgggagactcagaaatgagcttttaaggttgttccttgacttgcgggtcaataagcgcacaatggtgaagaaaaggctgccttctagtgacacggtgttccggtttgagactccgggcagcccaaggaaggccaacgtggaggcctcacgcagctccacagacagccccagaccagaagaaaatcattagcctatggtcaaaatccagttttgatggtgcctctttagcaagtgataagaacgactgtaaaacagaaagcaaaaatgaccctaagactgaaagaaaaaagtcttcatcttccagccagtacctgcccgggcggncgcnntagaactagtggatcccc

SEQ ID NO: 5089 - DNA, 772 bp, Homo sapiens
  misc_feature (772)..(772): n is a, c, g, or t
ggatcttcattaatgagaagacattcataaccagactgaagatggcaaactaattgttgaaggaatgctggacattttctggggagtaaaacgacctatacagctaaaaatacaagatgagaagccattctcttcttttactagtatgaagtcatcagacgtcttctccagcaaaggaatgacacgctggggggaatttgacgatctctatcgtattagtgagctggacaggacccagattcctatgtctgaaaaaaggaattcccaggaagcaacaccctgaagccacatgcaaaggatgaaccagactccccagtgctctatagaaccatgagtgaagcagctctggtgagaaaaaggatgaagcctctgatgatggacagaaaagaaagacagaaaaatagagcctctattaatggacacttctataaccatgaaattgaaaatagtccccaggattttgctcttcacattatttttgcaacaggagaacaaagacgactaaagaagacagacattccgctactgcagaggctcctacagggaccttctgaaaagaatgctcgcattttcctcatggataaagatgcagaagaaattagcagtgatgtggctcagtacattaactttcacttttctctcttggaatccattcttcaaagattaaatgaagaagagaaaagagagattcaaagaatagtaacaaaattcaataaagaaaaggcgattatactgaaagtcttcaaaatatactagtaataaaaacgagccn

SEQ ID NO: 5090 - DNA, 1432 bp, Homo sapiens
atcgaccccgcgtctgggctctgagaacaagagcttgaggggaagactgttaaccccatccacgccaccagaattagctctttcccttttggtttgcaagcactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagatgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtgacttaagtgtgaatttggagtatgcaccaactgaaggtacattggacataaaagaagatatgagtgagcctcaggagaaaaaactctcagagaacactgattttttggctcctggtgtttagttccttcacagattctaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatga

SEQ ID NO: 5091 - DNA, 392 bp, Homo sapiens
gtctgccaggacctcagggtccacctggacctcaaggaccaagtggtctgtccattcaaggaatgcccggaatgccaggggaaaaaggagagaaaggagatactggccttccaggtccacagggtatcccaggaggcgttggttcaccaggacgtgatggctcaccaggccacaggggccttccgggaaaggatggatcctcgggacctccaggaccaccagggccaataggcattcctggcacccctggagtcccagggatcacaggaggcatgggaccgcaaggcgccctgggaccacctggtgtcctggagcaaagggggacgaggagagcggggtacctccagtctcaggccatggtgagatcagtggcgcgtcaagtatcctacaag

SEQ ID NO: 5092 - DNA, 586 bp, Homo sapiens
cgacaggagaaggatgtgtctacctccagacatacttttaatacaatatgtctcccataataggacaagtggcctttgctttaggagtgcagactctgcctcaaacttgtgatgaacccaaagcccacaccagcttcaaatctccctaagtgtcagttacacagggagccgctctgcctccaacatggcgatcgttgatgtgaagatggctctggcttcattcccctgaagccaacagtgaaaatgcttgaaagatctaaccatgtgagccggacagaagtcagcagcaaccatgtcttgatttaccttgataaggggcaaatcagacactgagcttgtcttcacggtctgcaagatgtcccagtaagagatctgaaaccagccatagtgaaagctatgattactacgagacggatgagttgcaattgctgagtacaatgctccttgcagcaaagatcttggaaatgcttgaagaccacaaggctgaaaaggctttgctggagtctgtctcagagctcccagaagaacgtgttttggatcttaaagactgatgaataacacttttttgggcaaaaaaaaaaaaaaa

SEQ ID NO: 5093 - DNA, 463 bp, Homo sapiens
  misc_feature (31)..(31): n is a, c, g, or t
gaacaccacccagtgtggagcagcccagccnagcactgtcaggaatcctgtgaagcagctccagctatgtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatccctcatcctcccttgagaagagttacgagttgcctgatgggcaagtgatcaccatcggaaatgaacggtttccgctgccagagacccctgttccagccatcctttcattcggga

SEQ ID NO: 5094 - DNA, 1657 bp, Homo sapiens
tagctcagctcctattcctgggaagcctggaacggggacttttgaaaataactgcagcggcattcgggttagggtccgtgctctccgcctgcgccaggacagggtgaagtggtcggggcgagcagagggtgcgaagggctttgaccagcttcgacttgaaggattgctttgtgatgtgaccctgatgccaggtgacacagatgatgctttccctgtgcatagagtcatgatggcatctgctagtgattacttcaaggctatgttcacagacaactgtgttgaagttggacggattgccaacacctacaatctaaccgaagtggataaatacgttaacagtttcgtcttgaagaattttcctgcattgctgagcacaggggagttcttgaaactcccttttgagcgtcttgccttcgtgctttccagtaatagccttaagcactgtactgaacttgagctctttaaggctacctgtcgttggcttcgcctggaagagcctcggatggactttgctgcaaaattaatgaagaacatacgatttccactgatgacaccacaggagctcattaattacgtgcaaacggtggatttcatgagaactgacaatacttgtgtgaatttgcttttggaagccagcaattaccaaatgatgccatatatgcagccagttatgcagtcagacaggactgccattaggtctgacaccactcacttggttacactaggaggagtgctgaggcagcagctggttgtcagtaaggaattgcgcatgtatgatgaaaaggcccatgagtggaaatcgttagcccccatggatgccccaaggtaccagcatggcatcgccgtcattggaaattttctctatgtggttggcggacagagtaattatgatacaaaaggaaaaacggcagttgatacagtcttcagatttgatcctcgatacaataaatggatgcaagttgcatctttaaatgaaaagcgcaccttcttccacctaagtgccctcaaaggatatctgtatgcagttggtgggcgaaatgcagcaggtgaactgcccacagtagaatgttacaatccaagaacaaatgaatggacctatgttgccaaaatgagtgagccccactatggccatgctggaactgtgtatggaggagtgatgtatatttcaggaggaattactcatgatactttccaaaaggagctcatgtgctttgaccctgatactgacaaatggatccagaaggcgccaatgaccactgtcagaggtctgcattgcatgtgtacagtgggagaaaggctctatgtcattggtggcaatcacttcagaggaacaagtgattatgatgatgtcctaagctgtgaatactattcacctatccttgaccagtggaccccaattgctgccatgttaagagggcagagtgatgttggggtcgctgtcttcgaaaataaaatctatgtggttggggggtattcttggaataatcgttgtatggtagagatagtgcagaaatatgatccagataaagatgaatggcataaggtttttgatctgccagaatcccttggtggcattcgtgcttgcacactcacagtttttccaccagaagaaaccacaccatcaccttctagagagtcccctctttctgcaccttaa

SEQ ID NO: 5095 - DNA, 4956 bp, Homo sapiens
agtctcaaatatagaaaccaaaaattgatgtgtagtgttaatgtgcttacagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacaggttttaaaagcggatctagaaaagaaaaagcaatccatgggcaaactgtattcacttaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaaaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccacggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggaaattgatcgggaattgcagaagaagaaagaggagctgaatgcagtgcgtaggcaagctgagggcttgtctgaggatggggccgcaatgccagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaag

SEQ ID NO: 5096 - DNA, 1500 bp, Homo sapiens
gaggtaatacagattttcattgaagacaacttaaccttgagtttacctgtccagttccgacagtcagtcctaagagaactctttaagaaagctcaacaggggaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggtatgtattggaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccagatcaaagccatcggccagacagagttgaatgcaagcaatccagaagaagtgttacagctggcagcgcagagaaggaaaaaaaagtttctccaagcaatggcaaaactttacttttaa

SEQ ID NO: 5097 - DNA, 6283 bp, Homo sapiens
aatttggttgatcttgcaggcagtgaaagagctgctcaaacaggcgctgcagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagaggaaagcattgaagacccaaaacaaatgaagcagactctgtttgatgctgaaactgtagcccttgatgccaagagagaatcagcctttcttagaagtgaaaatctggagctgaaggagaaaatgaaagaacttgcaactacatacaagcaaatggaaaatgatattcagttatatcaaagccagttggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctacgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaagaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaagatccaagaacttcagaaaaaagaacttcaactgcttagagtgaaagaagatgtcaatatgagtcataaaaaaattaatgaaatggaacagttgaagaagcaatttgaggcccaaaacttatctatgcaaagtgtgagaatggataacttccagttgactaagaaacttcatgaaagccttgaagaaataagaattgtagctaaagaaagagatgagctaaggaggataaaagaatctctcaaaatggaaagggaccaattcatagcaaccttaagggaaatgatagctagacaggaccgacagaaccaccaagtaaaacctgaaaaaaggttactaagtgatggacaacagcaccttacggaaagcctgagagaaaagtgctctagaataaaatatgtgttaagctatgttacaaaaataaaagaagaacaacatgaatccatcaataaatttgaaatggattttattgatgaagtggaaaagcaaaaggaattgctaattaaaatacagcaccttcaacaagattgtgatgtaccatccagagaattaagggatctcaaattgaaccagaatatggatctacatattgaggccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcagaatcagtgctacaaaagccactgtagaatatcaaaaggaagttataaggctattgagagaaaatctcagaagaagtcaacaggcccaagatacctcagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtag

SEQ ID NO: 5098 - DNA, 6816 bp, Homo sapiens
atgcttaggggtccggggcccgggctgctgctgctggccgtcctgtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagaactggatgctcccactaacctccagtttgtcaatgaaactgattctactgtcctggtgagatggactccacctcgggcccagataacaggataccgactgaccgtgggccttacccgaagaggccagcccaggcagtacaatgtgggtccctctgtctccaagtaccccctgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagaggtgccccaactcactgacctaagctttgttgatataaccgattcaagcatcggcctgaggtggaccccgctaaactcttccaccattattgggtaccgcatcacagtagttgcggcaggagaaggtatccctatttttgaagattttgtggactcctcagtaggatactacacagtcacagggctggagccgggcattgactatgatatcagcgttatcactctcattaatggcggcgagagtgcccctactacactgacacaacaaacggctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaa

SEQ ID NO: 5099 - DNA, 1389 bp, Homo sapiens
ggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattagatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaag

SEQ ID NO: 5100 - DNA, 2361 bp, Homo sapiens
agagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgaccgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccacatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataagaaaacgtgcacaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgacgactcatacacgtgcgagtgcttggagggattccggctcgctgaggatgggaaacgctgccgaaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacaggaagccctttggaagaaaaacacgatcaatgcaaatgtgaaaaccttataatgttccagaaccttgcaaacgaagaagtaagaaaattaacacagcgctatatccttttcttgcattatgcttctgtatggaatgcaaagaatattatcaaaacttcacacactctat

SEQ ID NO: 5101 - DNA, 2904 bp, Homo sapiens
atggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccaaacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccaaagagggaaggtgaactagatatggagaagagccaagaggagatggatcaagcattagcagaaagcagcgaagaacaggaagatgcactgaatatctcctcaatgtctttacttgcaccattggcacaaacagttggtgtgagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccaggctattactccaaagcgactcctcacatctataaccacatcatggccagtccaggaggtcttagtgctgtgcgaaccagcaacttcgcccttgttggatcttacacattatcattgtcttcagtaggaaatactaagtttgttctggacaagaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaa

SEQ ID NO: 5102 - DNA, 3656 bp, Homo sapiens
gtggaaaaactaaccagctgaatctgcagaacactgcaactaaagcaattattcaaggccttatgccagaccagaattacacagttcaaattattgcatacaataaagataaagaaagcaagccagctcaaggccaattcagaaaagtgaaatttgtctgtcaaactccagcaattgctgacattgtaatcctggtcgatggttcatggagtattggaagattcaacttcagactggttcggcatttcttggaaaacctggttacagcattcgatgtgggctcagagaagacacgaattggtataatttctattattagcagtagcagtcttgcacagtatagtggtgaccccagaatagaatggcacttgaatgcatttagcacaaaagatgaagtgattgaagctgtccgaaacctcccatataaaggaggaaatacactaacaggtcttgctttgaactacatttttgaaaatagcttcaaaccagaagcaggatcaaggactggagtatccaaaattggcattttaatcacagatggaaaatcccaagatgacattattccaccatctagaaatcttcgtgagtctggtgtagaactgtttgccataggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttgaagtcgatcctattactaccttccctctgaagggcttgacacctctcacagagtatactattgctattttctccatctatgatgaaggacagtcagagcctctgactggagtttttaccaccgaggaagttccagcccagcaatacttagaaattgatgaggtgacgacagacagttttagggtgacctggcatcccctctcagctgatgaagggctacacaaattgatgtggattccagtctatggggggaagactgaggaggttgtcctgaaagaagagcaggactcacatgttattgaaggcctggagcccggtacggagtatgaagtttcactattggccgtacttgatgatggaagcgagagtgaggtggtgactgctgtcgggaccacacttttccagacgggaatcagaaacctagttgtaggtgatgaaactacttctagcctgcgggtaaaatgggacatttctgacagcgatgtgcagcagtttagggtgacctacatgacagctcaaggggaccctgaggaagaagtcataggaacggttatggtgcctggaagccagaacaacctccttctgaagcctctgcttcctgatactgaatacaaagtcacagtgactcccatctacacggatggcgaaggcgtcagcgtctccgctcctggaaaaaccttaccatcctcggggccccagaacttgcgggtgtccgaggaatggtataaccggttgcgcattacgtgggaccccccatcttccccggtgaaaggctatagaattgtctacaaacctgtcagtgttcctggtccaacactggaaacgtttgtgggagctgacattaacaccatccttatcacaaacctcctcagcggaatggactacaatgtgaagatatttgcctcccaggcctcaggcttcagcgacgccctgacaggcatggtgaaaacattgttcttgggtgttaccaatctccaagccaaacatgttgaaatgaccagcttgtgtgcccactggcaggtacatcgccatgccacagcctatagggttgttatagaatccctccaggataggcaaaagcaagaatccactgtgggtggagggacaaccaggcattgcttctatggacttcagcctgattctgaatataaaatcagtgtttatacaaagctccaggagattgaaggacctagtgtgagcataatggaaaaaacactatgtaaggcggccaaggctgacctggtatttatggtggatggatcctggagcattggagatgaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccagtcacatggccaggtacactgccatcctcaaccagattcccagccactcctcatccatccggactgtccaagggcctcctggggagcctgggaggccaggctcacctggagcccctggtgaacaaggacccccaggcacaccaggcttccccggaaatgcaggcgtgccagggaccccaggagaacgag

SEQ ID NO: 5103 - DNA, 630 bp, Homo sapiens
atggcgcagaagggccaactcagtgacgatgagaagttcctctttgtggacaaaaacttcatcaacagcccagtggcccaggctgactgggccgccaagagactcgtctgggtcccctcggagaagcagggcttcgaggcagccagcattaaggaggagaagggggatgaggtggttgtggagctggtggagaatggcaagaaggtcacggttgggaaagatgacatccagaagatgaacccacccaagttctccaaggtggaggacatggcggagctgacgtgcctcaacgaagcctccgtgctacacaacctgagggagcggtacttctcagggctaatatatgtgagtattgcaggcagccagacgtactctggcctcttctgcgtggtggtcaacccctataaacacctgcccatctactcggagaagatcgtcgacatgtacaagggcaagaagaggcacgagatgccgcctcacatctacgccatcgcagacacggcctaccggagcatgcttcaagttcttgccaggaatgtggagtttggcaggcactgtgagggaccaggagttactgtggctgaaaaagggaaaaagcaaaaggaacatctgtgtttgcagcctgggagg

SEQ ID NO: 5104 - DNA, 855 bp, Homo sapiens
atggaaactgcagccgaggaaaatactgaacaaagccaagagagaaaaggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgatccacttcctcatgatactgtcttctaactgggcttacttaaaggatgcgagcaaaatgcaggcttaccaggatatcaaagcaaaggaagaacaggaactgcaagatatccagtctcggtcaaaagaacaactcaattcttacacataa

SEQ ID NO: 5105 - DNA, 1419 bp, Homo sapiens
gtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagcatgccaaggcaaaggcttccattgcaaatcgggtgttgcattccaagccagtatcaatgcaatggtgaggtggactgcattacaggggaagatgaagttggctgtgcagggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataa

SEQ ID NO: 5106 - DNA, 699 bp, Homo sapiens
atggccaagaaccgcagggacagaaacagttggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccagcttttcactgagtatggcagactggcaatggaggaaacattcctgaagccatttcagagtctgatatttcttgttcgagactggagtttcccatacgaattttcatatggagccgatggtggtgccaaattcttggaaaaacgcctcaaggtctcagggaaccagcatgaagaactacagaacgtcagaaaacacatccattcctgtttcaccaacatttcctgttttctgctacctcatcctggcttaaaagtagctaccaatccaaactttgatggaaaattgaaagaaatagatgatgaattcatcaaaaacttgaaaatactgattccttggctacttagtcccgagagcctagatattaaagagatcaatgggaataaaatcacctgccggggtctggtggagtacttcaag

SEQ ID NO: 5107 - DNA, 2265 bp, Homo sapiens
atgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagccattccaactactgattttggatatgcttctatagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaacagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtacaaaaccagaaatccctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaagggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtctga

SEQ ID NO: 5108 - DNA, 1461 bp, Homo sapiens
atggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccgtatccttccttgatgggctcaggcccgttgtttcctttactggacacgaccagatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggcgatctgggtgtccatagtggggaagaactccagctcaccaccactatcacccatgtggacggacccactgagatctacaagttgacccgcaaggaggcccaggagtag

SEQ ID NO: 5109 - DNA, 1154 bp, Homo sapiens
atggcatattcttggcaaacggatccaaatcctaatgaatcacacgaaaagcagtatgaacaccaagaatttctctttgtaaatcaaccccattcttctagccaagtcagtctgggttttgatcagatagtagatgagatcagtggcaaaattccacactacgagagtgaaattgatgaaaacaccttttttgtgcccactgcaccaaaatgggactcaacagggcattcattaaatgaagcacaccaaatatccttgaatgaattcacttctaaaagccgtgaactctcctggcatcaagttagcaaagcaccagcaattggttttagtccttctgtgttaccaaaacctcaaaatacgaataaagaatgctcctggggaagcataggaaaacatcatggtgctgatgattccagattcagtattttagctctatcattcacaagtttggataaaattaatctagagaaagaattagaaaatgaaaatcataactaccatataggatttgaaagtagcattcctccaacaaattcatccttctcaagtgacttcatgccgaaagaagagaataaaaggagtggacatgtgaacattgtggaaccatctttgatgcttttgaaaggctctcttcaacccggaatgtgggaaactaattatcttgtcaaagatctaattgcagaaattctgcatttttgcacaaatgaccagctactccccaaagatcatattctaagtgtatgtggctctgaagaatttttacaaaacgaccactgtttggggagccacaaaatgtttcaaaaagataaatctgttattcagctccacctgcagaaaagtagggaagctccaggaaagctatctcgaaagattgtaagatgtgaatcttgttatctacaggaaaacgtgtataatattattgaagaagttaaaaaaatatgcagtgttctagggtgtgtggaaaccaaacaaattacagatgcagtaaatgaactaagtctaattcttcagagaaaaggagagattgattttccagctactgggtgggagtatatgaaacctgattctgaagagaatagaagtaatcttgaagagccactaaaggagtgtataaaacatattgccagactttcacagaaacagactcccctact

SEQ ID NO: 5110 - DNA, 3021 bp, Homo sapiens
atgcagtttgtatcctgggccacactgctaacgctcctggtgcgggacctggccgagatggggagcccagacgccgcggcggccgtgcgcaaggacaggctgcacccgaggcaagtgaaattattagagaccctgagcgaatacgaaatcgtgtctcccatccgagtgaacgctctcggagaaccctttcccacgaactttctatttaatctcaccgccaatgccggatttatcgctccactgttcactgtcaccctcctcgggacgcccggggtgaatcagaccaagttttattccgaagaggaagcggaactcaagcactgtttctacaaaggctatgtcaataccaactccgagcacacggccgtcatcagcctctgctcaggaatgctgggcacattccggtctcatgatggggattattttattgaaccactacagtctatggatgaacaagaagatgaagaggaacaaaacaaaccccacatcatttataggcgcagcgccccccagagagagccctcaacaggaaggcatgcatgtgacacctcaggcctggctgaactgggaaccatttgtgatccctatagaagctgttctattagtgaagatagtggattgagtacagcttttacgatcgcccatgagctgggccatgtgtttaacatgcctcatgatgacaacaacaaatgtaaagaagaaggagttaagagtccccagcatgtcatggctccaacactgaacttctacaccaacccctggatgtggtcaaagtgtagtcgaaaatatatcactgagtttttagacactggttatggcgagtgtttgcttaacgaacctgaatccagaccctaccctttgcctgtccaactgccaggcatcctttacaacgtgaataaacaatgtgaattgatttttggaccaggttctcaggtgtgcccatatatgcactgcaagtatggattttgtgttcccaaagaaatggatgtccccgtgacagatggatcctggggaagttggagtccctttggaacctgctccagaacatgtggagggggcatcaaaacagccattcgagagtgcaacagaccagaaccaaaaaatggtggaaaatactgtgtaggacgtagaatgaaatttaagtcctgcaacacggagccatgtctcaagcagaagcgagacttccgagatgaacagtgtgctcactttgacgggaagcattttaacatcaacggtctgcttcccaatgtgcgctgggtccctaaatacagtggaagttacaatactgtggtccgaattccagctggtgctaccaatattgatgtgcggcagcacagtttctcaggggaaacagacgatgacaactacttagctttatcaagcagtaaaggtgaattcttgctaaatggaaactttgttgtcacaatggccaaaagggaaattcgcattgggaatgctgtggtagagtacagtgggtccgagactgccgtagaaagaattaactcaacagatcgcattgagcaagaacttttgcttcaggggaacggaaacgaaaacttgtttgcaccagggaatctgatcagcttactgtttctgatcaaagatgcgatcggctgccccagcctggacacattactgaaccctgtgtgcttggtcacctgtggaaaagggcataagcaccgccaggtctggtgtcagtttggtgaagatcgattaaatgatagaatgtgtgaccctgagaccaagccaacatctatgcagacttgtcagcagccggaatgtgcatcctggcaggcgggtccctggggacagtgcagtgtcacttgtggacagggataccagctaagagcagtgaaatgcatcattgggacttatatgtcagtggtagatgacaatgactgtaatgcagcaactagaccaactgatacccagtgctcagccacttgtgggaaaggtacccggatgagatacgtcagctgccgagatgagaatggctctgtggctgacgagagtgcctgtgctaccctgcctagaccagtggcaaaggaagaatgttctgtgacaccctgtgggcaatggaaggccttggactggagctcttgctctgtgacctgtgggcaaggtagggcaacccggcaagtgatgtgtgtcaactacagtgaccacgtgatcgatcggagtgagtgtgaccaggattatatcccagaaactgaccaggactgttccatgtcaccatgccctcaaaggaccccagacagtggcttagctcagcaccccttccaaaatgaggactatcgtccccggagcgccagccccagccgcacccatgtgctcggtggaaaccagtggagaactggcccctggggagcagatgaaaatggatacaccgcaaacgactgtgtggagagaataaaacctgatgagcaaagagcctgtgaatccggcccttgtcctcagtgggcttatggcaactggggagagtgctctgtgtcctgtggccgaggcgtacagcagaggcatgtgggctgtcagatcggaacacacaaaatagccagagagaccgagtgcaacccatacaccagaccggagtcggaacgcgactgccaaggcccacggtgtcccctctacacttggagggcagaggaatggcaagaatgcaccaagacctgcggcgaaggctccaggtaccgcaaggtggtgtgtgtggatgacaacaaaaacgaggtgcatggggcacgctgtgacgtgagcaagcggccggtggaccgtgaaagctgtagtttgcaaccctgcgagtatgtctggatcacaggagaatggtcagagtgctcagtgacctgtggaaaaggctacaaacaaaggcttgtctcgtgcagcgagatttacaccgggaaggagaattatgaatacagctaccaaaccaccatcaactgcccaggcacgcagccccccagtgttcacccctgttacctgagggactgccctgtctcggccacctggagagttggcaactgggggagc

SEQ ID NO: 5111 - DNA, 1555 bp, Homo sapiens
gctgctaaaaaatgcagaaaatgaagcttattttaaaagctggtatcagaagctactagctgctctccaattctgtgcaggtaaagccttgaatgatgagttttccaaggagcagaaacttatcaaaattctgggagatattggggaaagagtcaagtctgccagtgaccatcaaagacaggaggtactgaagaaagaaattggcagactagaagagttctttcaagatgtaaatacttgtcatcttcctctgaaccctgccctatgtataaaagggattgatcacgatgcatgttcatattttacatctaatgctttgccattgaagattactttcatcaatgctaatctgatgggcaaaaacatcagcattatttttaaggctggagatgatcttcgtcaggatatgcttgttctgcagcttattcaagtgatggacaatatttggctgcaggaaggcttggatatgcaaatgatcatttatagatgtctatccacaggaaaagaccaaggattggtgcagatggtacctgatgctgtgaccctagcaaagattcatcgccattctggactgataggaccattgaaagaaaatacaattaaaaagtggttcagtcagcacaaccacttaaaggcagattatgaaaaggccttgaggaactttttctactcctgtgctggctggtgtgtggtaacattcatcctgggagtatgtgaccgtcacaatgataatatcatgctgacaaagtcgggccacatgtttcatattgactttggaaaattcttaggtcatgcacaaacatttggagggataaaaagggaccgagctcctttcatttttacttcagagatggaatactttattacagagggtgggaaaaacccacagcattttcaagattttgtggaactttgctgtcgtgcttataatattatcagaaagcacagccaactgctcttgaacctgctggaaatgatgctgtatgcaggactgcctgagctaagtggaattcaagacctgaaatatgtgtataataatcttcgtccacaagacacagacctggaagcaacaagtcattttaccaagaaaataaaggaaagtctggagtgtttccctgttaaattgaataacttgatccacacacttgcacaaatgtcagccataagccctgccaaatctacttcacagacttttcctcaggaatcctgtttgctgagtacaactaggtcgattgaaagagcaacaattttagggttcagcaagaaatccagtaatcatctcccagatggctctgcgcccagtgcacatgttgaattttatcttttaccatatcccagtgaagttcgtaggaggaaaacaaaatctgttccaaaatgtacggaccccacttacaatgaaattgtagtatatgatgaagtcacagagctccaaggacatgtcttaatgcttattgtgaagagtaaaactgtatttgtgggagcaattaacatccgactctgtagtgtcccactcgataaagaaaaatggtatccattaggaaccagtataatttga

SEQ ID NO: 5112 - DNA, 3405 bp, Homo sapiens
atgcagcggatattcaactcctttgtttacactgagaaaatctcaaatggagaaagtgaagtacagcagctagccaaaaaaatccgagagaagttcaaccgttacttggatgtggtcaatcggaacaagcaagttgtagaagcatcctatacggctcacctaacctctcccctaactgcaattcaagactgctgtactatcccaccttccatgatggaattcgatgggaactttaataccaatgtgtctagaacaattagttgtgatcgactttctactactgttaatagccgggccttcaatccaggacgagacttaaattcagttcttgcagacaacctgaaatccaaccctggaattaagtggcaatatttcagttcagaagaaggaattttcactgttttcccagcacacaagttccggtgtaagggcagctacgaacaccgcagtagacccatctacgtctctacagtccggccgcagtcaaagcacatagtagtgattctggaccacggggcttcagtcacagacactcagcttcagattgccaaggacgctgctcaggtcatcctcagcgccatcgatgaacatgacaagatttctgtgttaactgtggcagataccgtccggacttgctcactagaccagtgctataagaccttcttgtctccagccaccagtgagacaaaaaggaaaatgtccacctttgttagcagcgtgaagtcttcagacagtcctacccagcacgcagtgggattccaaaaggcatttcagctgattcgaagtacaaacaataacacaaagttccaagcaaatacagacatggtcatcatttacctgtcagctggcattacatcaaaggactcttcggaagaagataaaaaagcgactctccaagtcatcaatgaagaaaatagctttctaaacaactctgtaatgattctcacctatgccctcatgaacgatggggtgactggtttgaaagagctggcttttctgagggatctagctgaacagaattcagggaagtacggtgtgccagaccggacggccttgcctgtgattaagggcagcatgatggtgctgaatcagttgagcaacctggagaccacagtgggcaggttctacacaaaccttcccaaccggatgattgatgaagccgtcttcagcctgcccttctctgatgagatgggagatggatatacacttatgcacccatctcttaccaggccatatttattgtcagagcccccacttcatactgacatcatacattatgaaaatattccaaaatttgaattagttcggcaaaatatcctaagcctccctctgggcagccagattatcgcagtccctgtgaactcatccctgtcttggcacataaacaagctgagagaaactggaaaggaagcctacaatgttagctatgcctggaagatggtacaagacacttcctttattctgtgtattgtggtgatacaaccagaaatacctgtgaaacaactgaagaacctcaacactgttcccagcagcaagctgctgtaccaccggctggatctccttggccagcccagtgcttgcctccacttcaaacagctggcaaccctagaaagtcccaccatcatgctgtctgctggcagcttttcctccccctatgagcacctcagccagccagagacaaagcgcatggtagagcactacaccgcctatctcagcgacaacacccgcctcattgctaacccgggcctcaaattctctgtcagaaatgaagtaatggctaccagccacgtcacagatgaatggatgacacaaatggaaatgagtagcctgaacacttacattgtccgccgttacatagcaacacccaatggcgtcctcagaatttatcctggttccctcatggacaaagcatttgatcccactaggagacaatggtatctccatgcagtagctaatccagggttgatttctttgactggtccttacttagatgttggaggagctggttatgttgtgacaatcagtcacacaattcattcatccagtacacagctgtcttctgggcacactgtggctgtgatgggcattgacttcacactcagatacttctacaaagttctgatggacctattacctgtctgtaaccaagatggtggcaacaaaataaggtgcttcataatggaggacaggggttatctggtggcgcacccgactctcatcgaccccaaaggacatgcacctgtggagcagcagcacatcacccacaaggagcccctggtagcaaatgatatcctcaaccaccccaactttgtaaagaaaaacctgtgcaacagcttcagtgacagaacggtccagaggttttataaattcaacaccagccttgcgggggatttgacgaaccttgtgcatggcagccactgttccaaatacagattagcaaggatcccaggaaccaacgcgtttgttggcattgtcaacgaaacctgcgactctcttgccttctgtgcctgcagcatggtggaccgactctgtctcaactgtcaccgaatggaacaaaatgaatgtgaatgtccttgtgagtgccctctagaggtcaatgagtgcactggcaacctcaccaatgcagagaaccgaaaccccagctgcgaggtccaccaggagccggtgacatacacagctattgaccctggcctgcaagatgctcttcaccagtgtgtcaacagcaggtgcagtcagaggctggaaagtggggactgttttggggtgctggattgtgaatggtgcatggtggacagtgatggaaagactcacctggacaaaccctactgtgccccccagaaagaatgcttcggggggattgtgggagccaaaagtccctacgttgatgacatgggagcaataggtgatgaggtgatcacattaaacatgattaaaagcgcccctgtgggtcctgtggctggagggatcatgggatgcatcatggtcttggtcctggcggtgtatgcctaccgccaccagattcatcgccggagccatcagcatatgtctcctcttgctgcccaagtcagcaacactcggtttatagctgcggtcatcgaacgacatgcacacagtccagaaagaaggcgccgctactggggtcgatcaggaacagaaagtgatcatggttacagcaccatgagcccacaggaggacagtgaaaatcctccatgcaacaatgaccccttgtcagccggggtcgatgtgggaaaccatgatgaggacttagacctggataccccccctcagactgctgccctactaagtcacaagttccaccactaccggtcacaccaccctacacttcatcatagccaccacttacaggcggccgtcacggtacacactgtcgatgcagaatgctaa

SEQ ID NO: 5113 - DNA, 803 bp, Homo sapiens
gtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagggtattggaactgatgagtttactctgaaccgaataatggtgtccagatcagaaattgaccttttggacattcgaacagagttcaagaagcattatggctattccctatattcagcaattaaa

SEQ ID NO: 5114 - DNA, 764 bp, Homo sapiens
agtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatag

SEQ ID NO: 5115 - DNA, 1932 bp, Homo sapiens
actaaaatccacggagtcgggtttgtgaaaatccatgccccctggaacgtgctgtgcagagaggccgagtttctgaaactgaagatgccgacgaagaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagagactgacaaagtgaagctgacatggagagatcggttcccagcctacctcactaacttggtctccatcatcttcatgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtag

SEQ ID NO: 5116 - DNA, 1603 bp, Homo sapiens
ggatatcagtatgaacaacattactcagttgccagaagatgcatttaagaactttccttttctagaagagctacaattggcgggcaacgacctttcttttatccacccaaaggccttgtctgggttgaaagaactcaaagttctgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagtatccctgactttgcatttaccaacctttcaagcctggtagttctaggatttcatagtaattctatttctgttatccctgatggagcatttgatggtaatccactcttaagaactatagatgtaagtttcaatgaattaacttcctttcctacggaaggcctgaatgggctaaatcaactgaaacttgtgggcaacttcaagctgaaagaagccttagcagcaaaagactttgttaacctcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactga

SEQ ID NO: 5117 - DNA, 1839 bp, Homo sapiens
atgctcataccaaagccaccaccaaagacagacatcttgaagagtctagatactatggatgatccagacaccgtgggaagcatacctgttttcaaaactgagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgtgcccggtgcaaggacttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagtagacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagcggccgtctaa

SEQ ID NO: 5118 - DNA, 2693 bp, Homo sapiens
agtaaagaaaagattgaaaaactaaaactccaagctgaatccttctgccagcgtttggggaaataccggatgccctttgcctgggcacccataagcttatcaagcttcttcaatgtctccacccttgagagggaggtaactgatgtggactctgtggttggcttgctaagactggagatttctacagctccagagatcatcaattgctgtctgactcctgaaatgctgcccgtgaaaccctttcctgaaaaccggacacgcccgcacaaagagattttggaatttccaacacgagaagtatatgtccctcacactgtgtacaggtctcctgacttttatgaagaagtgaaaattaagctccccgctaagctcacagtaaatcaccacctcctgttcaccttctaccatatcagctgtcagcagaagcaaggagcctccgtggaaactctcctgggatattcagaaaatgaacaggcggaaaagatgaacatcagcctggctttcttcttgtatgaccttctctccctcatggatcggggctttgtgtttaacctcatcagacattattgcagccagctgtcagccaagctcagtaaccttccaacgctcatttccatgaggctagagttcctgagaatcctctgtagccatgagcattacctcaatctgaaccttttttttatgaatgctgatactgctccaacatctccttgtccttccatatcttcccagaactcaagctcctgctccagcttccaggaccagaagatcgccagcatgttcgatctgacttccgagtaccgccagcagcacttcctcaccgggctcctcttcacagaactggctgctgccctggatgccgaaggggaaggaatcagcaaagtacaaaggaaagctgtcagtgcaattcacagtctgctaagttctcacgacctggacccacgctgtgtcaaaccagaggtgaaggtcaaaatcgccgccctttacctacctttagttggcatcattttggatgctttgccacagctctgtgactttacagttgcagatactcgcagataccgcaccagtggctcggatgaagaacaagaaggagccggtgccattaaccagaatgtggctctggccatagcagggaataatttcaatttgaaaacaagtggaatagtgctgtcttccttgccctataagcagtacaacatgctgaacgcggacactactcgcaacctcatgatctgcttcctctggatcatgaaaaatgctgatcagagcctcattaggaagtggattgctgacctgccatcaacgcagctcaacaggattttagatctacttttcatctgtgtgttatgttttgagtataagggaaaacagagttctgacaaagtcagtacccaagtcctgcagaagtcaagggatgtcaaggcccggctggaagaggctttgctccgtggggaaggggccagaggggagatgatgcgccgccgggctccagggaacgaccgatttccaggcctaaatgaaaatttgagatggaagaaagagcagacacattggcggcaagctaatgagaagctagataaaacaaaggccgagttagatcaagaagccttgatcagtggcaatctggctacagaagcacatttaatcatcctggatatgcaggaaaacattatccagaattttgcaagagtaaagatgcaagtaaccatgtccctggcatctttggtgggaagagcaccagactttaatgaagagcacctgagaagatccttgaggacaattttggcctattcagaagaggacacagccatgcagatgactccttttcccacccagaacatggcagagaaacacaccaagaagaagtgctacacggaggctgccatgtgcctggtgcacgccgctgcgttagtggctgagtatctgagcatgctggaggaccacagctacctgcccgtgggcagtgtcagcttccaggcattttatggtcaatgttttggtgcagaatttgtggaagtgattaaagactccactcctgtggacaaaaccaagttggatcctaacaaggcctacatacagatcacttttgtggagccctactttgatgagtatgagatgaaagacagggtcacatactttgagaagaatttcaacctccggaggttcatgtacaccaccccgttcaccctggaggggcggcctcggggagagctgcatgagcagtacagaaggaacacagtcctgaccactatgcacgccttcccctacatcaagaccaggatcagcgtcatccagaaggaggagtttgttttgacaccgattgaagttgccattgaagacatgaagaagaagaccctgcagttagcagttgccattaaccaggagccgcctgatgcaaagatgcttcagatgggaccactggaagtaccccaagggtttttggctgaaattcctgctgatccaaaactctatcgacatcacaacaagttgaggttatgctttaaggaattcatcatgagatgtggtgaagctgtagagaaaaacaagcgtctcatcacggcagaccagagggaatatcagcaggaactcaaaaagaactataacaagctaaaagagaacctcaggccaatgatcgagcggaaaattccagaactgtacaagccaatattcagagttgagagtcaaaagag

SEQ ID NO: 5119 - DNA, 2016 bp, Homo sapiens
atggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacaatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaa

SEQ ID NO: 5120 - DNA, 4491 bp, Homo sapiens
atgctgtcctggcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagaggcgctgcggcgcgaggcgctcgggttggagcagctgcgcgcgcggctggaggacgcgctgctgcggatgcgcgaggagtacgggatacaggccgaggagcggcagagagtgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagaattcagaaacaaatcctatcactataccgactcactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcactgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagccccaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgcttcaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggaggtaagtgcgggaggtgacctaagtcaggcagcgagcccgaccggagccagccggtctgtgaggcatgtcacgctgggtcccggtcaaagtccactgtccagagaagtcatcttcctaggccctgcccctgcctgtccagaggcatggggctcgccagaacctggcccagcagagtcttctgcagatatggacggatcagggaggcacagcacatttggctgcagacaatttcatgctgaaaaggagattatttttcagggccccatttctgctgcagggaaggttggtgattattttgcaacagaagagtcagtgggtacccagacttctgtcaggcaactccagttaggccctaaagaagggttcagtgggcaaatccagttcacagctccactttcagacaaggtggagttgggtgtcataggagattctgtacacatggaagggttgccagggagcagcacatccatcaggcacatcagcattgggcctcagaggcatcagaccacccagcagatagtttaccatgggctggttccccaactgggggaatctggtgactcagagagcactgtgcacggagagggctcagcagatgtgcaccaggccactcacagtcatacctcgggtagacaaaccgttatgactgaaaagagcaccttccaaagtgtcgtttctgaatctccccaggaggatagtgcagaggacacatcaggggcagaaatgacatcgggtgttagcagatcctttaggcacattcgactaggtcctacagaaacggaaacctctgaacacattgccatccgtggacccgtgtccagaacatttgtgcttgctggttcagcggactcccctgagctaggcaagttagcagacagcagcagaacgctaaggcacattgcaccagggcccaaagaaacttcgtttacctttcagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaa

SEQ ID NO: 5121 - DNA, 1057 bp, Homo sapiens
atggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatg

SEQ ID NO: 5122 - DNA, 1535 bp, Homo sapiens
ggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttgtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaa

SEQ ID NO: 5123 - DNA, 909 bp, Homo sapiens
ggtggtgattccactgaagcaactgccaaaccaaagagaagtttttatgctgccagggatttgtacaagtaccgacaccagtacccaaacttcaaagatatccgatatcaaaatgacttgagcaatcttcgtttttataagaataaaattccattcaagccagatggtgtttacattgaagaagttctaagtaaatggaaaggagattatgaaaaactggagcacaaccacacttacattcaatggtcccagcacaactatttaagaatcactcgtattcttaaaagccttggtgagcttggatatgaaagttttaaatctcctcttgtaaaatttattcttcatgaagctcttgtggagaatactattcccaatattaagcagagtgctctagagtattttgtttatacaattagagacagaagagaaaggagaaagctcctgcggttcgcccagaaacactacacgccttcagagaactttatctggggaccgcctcgaaaagaacagtcggagggaagcaaagcccagaaaatgtcttcccctctcgcctccagtcataacagtcaaacttctatgcacaaaaaagccaaggactccaaaaattcctcctcagctgttcatttaaatagcaaaacagctgaagacaaaaaagtggcaccaaaagagcctgtggaagagacagacaggcccagcccagagcccagcaatgaagctgccaagccaagaaatacagagaaggacagtaatgctgagaacatgaattctcaacctgagaaaacagttactactcccacagaaaaaaaggagagtgtatctcctgagaataacgaagaaggtggaaatgataaccaagacaatgaaaatcctggaaatacaaattgccatgatgttgtactagtacagtga

SEQ ID NO: 5124 - DNA, 1930 bp, Homo sapiens
cataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccaaagggggagttgggcccttcagtgatccagtgaaaatatttatccctgcacacggttgggtagattatgccccctcttcaactccggcgcctggcaatgcagatcctgtgctcatcatctttggctgcttttgtggatttattttgattgggttggttttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagtgtgagttatcagtgatgaatcccattcttctagggttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtga

SEQ ID NO: 5125 - DNA, 6807 bp, Homo sapiens
atgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctggtaagtgccaccagatacatctatatattaactcaataaatgaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccgaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaa

SEQ ID NO: 5126 - DNA, 967 bp, Homo sapiens
ttataatggagaatgggatctagctcaaaaagcactggatgatattatatacagagcccagctagaattatatccagagccattgctggttgctaatgcaataaaggcttcattgcctcatggtcccatgaaatctaataaggaaggtacaaggtgtattcaagttgaaatcacaccaacttcctctcgaatatcaagaaatgcagtaaccagcatgtcaataaggggtcataggtggaaaagacatgagcaacctgacaacaataatgatgctactgaattgggcatccttgtcattcctgagattagtgtcacaaatgtggccggagagagaaccgggaatggggaaaaaggcagaacactaggagagattgatgctcagcatatacagggaaatacagaattaacaggtcaagaagaactgatggagatatctgaagttgacgagggattttattccagggctgcgtctagtaccagccagtcgggtttatcaaacagtagtcacaattgtagtaacaagccaagtataggaaagaaccacagacggtcaggaggaagcaaaactggaggaaaagaaaaagaaactacaggggaatcttgcaaagatcactttgctcgaaaacaaactcagagagcccaaagtgagaatcttgagcttctctctttgaagagacttactttaacaaccagccaatccctacctaagcctagtagccatggtttggctaagaccgcagcgactgtatttagtaaatcctttgaacaagtcagtggtgtcacagtcccacataacccgtcatctgctgttggttgtggggctgggacagatgccaataggttttccgcttgtagtctccaagaagaaaagcttatttacgtttcagaaagaactgaacttccaatgaagcatcaatcaggtcagcagagacctcctagtattagcattactctgtccacagattaa

SEQ ID NO: 5127 - DNA, 1196 bp, Homo sapiens
acaaatgcaagattattatctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatgattcttgcatgagcttccagtgtaaaagaggccacatctgtaaggcagaccaacagggaaaacctcactgtgtctgccaggatccagtgacttgtcctccaacaaaaccccttgatcaagtcaagaaaatttacctggatgaaaagaggcttttggctggggaccatcccattgaccttctcttaagggactttaagaaaaactaccacatgtatgtgtatcctgtgcactggcagtttagtgaacttgaccaacaccctatggatag

SEQ ID NO: 5128 - DNA, 1268 bp, Homo sapiens
gtctctggggaacaagactcatggaggaaagcagcactaaccgagagaaataccttaaaagtgttttacgggaactggtcacatacctcctttttctcatagtcttgtgcatcttgacctacggcatgatgagctccaatgtgtactactacacccggatgatgtcacagctcttcctagacacccccgtgtccaaaacggagaaaactaactttaaaactctgtcttccatggaagacttctggaagttcacagaaggctccttattggatgggctgtactggaagatgcagcccagcaaccagactgaagctgacaaccgaagtttcatcttctatgagaacctgctgttaggggttccacgaatacggcaactccgagtcagaaatggatcctgctctatcccccaggacttgagagatgaaattaaagagtgctatgatgtctactctgtcagtagtgaagatagggctccctttgggccccgaaatggaaccgccttcactcaattccgtatcattttgggcgatatcaactttgcagagattgaggaagctaatcgagttttgggaccaatttatttcactacatttgtgttctttatgttcttcattcttttgaatatgtttttggctatcatcaatgatacttactctgaagtgaaatctgacttggcacagcagaaagctgaaatggaactctcagatcttatcagaaaggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatga

SEQ ID NO: 5129 - DNA, 2298 bp, Homo sapiens
atgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccatcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctcctggctggaatagggcaacctgtgaagaaatcagtgagccagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtaactgggagcatgagcactgacgaacacaaacatgcctctgttttattttacctgtaccttaccttgtaccagacaggatctaaggtgcataaggcaaatccaatacgcaagtaccagggtctggagataaagtcaagtgaccagcctctgactgtgcctgtatctcccaaattctccactcgattccactgctaa

SEQ ID NO: 5130 - DNA, 1429 bp, Homo sapiens
gtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaaggaacaatgaaggtgaaccctagtctcaggattgctagtctcaagatggtaccactgtaattctacctggaaaaggaggtgttttcattcctacagatatttttcataagataaatacccacagtgtatagtaatgaacctggataataaatatcttccagcaaatattttacttagaagacgattatattttttaaattttgagattaattgaatatatacaaacagaaaattaggtacaaatttattatgtttatggctcttatacaactatcaaggtaaaggaaatttaccaattaaatacaaagtagtaaaattcaaaatcacaataattaataatgttctgctgctacaaaatgagatgttgggtttaataatagaaggaagtagcactgttgaaatagaattaaatgggtcttgaattcatttgtgattggaatcagaagtcgcgagttctgaaagggtaaggtttactgcaacattgctaataaataatttcaagatgaaatatacaaagatgagatccaagctctaacatttacttgcaacatgaatatggtactgtgttcttctccgtcccccatcctcattccccctcctcctcctgcttgctggttggtcttcctttggaaattcatgatgccatatcagatggttttagaattctgcactttaataatgtaatgcatatgccatatataatatcccagagggatctgctataatattgcataatcgaattcatatttctgcagcaaaatgtgtggatactctcacaaggcaggataaatagagactatatatactgggccaggtgtggtgactcatgcctagaatcccagcactttgggaggccagggcaggagggatcacttgaggccaggaatttgagaccagcctgggcaacatagtgagacctcatctcttaaaaaaaaaaa

SEQ ID NO: 5131 - DNA, 1209 bp, Homo sapiens
atggagcccgccggcccggcccccggccgcctcgggccgctgctctgcctgctgctcgccgcgtcctgcgcctggtcaggagtggcgggtgaggaggagctgcaggtgattcagcctgacaagtccgtgttggttgcagctggagagacagccactctgcgctgcactgcgacctctctgatccctgtggggcccatccagtggttcagaggagctggaccaggccgggaattaatctacaatcaaaaagaaggccacttcccccgggtaacaactgtttcagacctcacaaagagaaacaacatggacttttccatccgcatcggtaacatcaccccagcagatgccggcacctactactgtgtgaagttccggaaagggagccccgatgacgtggagtttaagtctggagcaggcactgagctgtctgtgcgcgccaaaccctctgcccccgtggtatcgggccctgcggcgagggccacacctcagcacacagtgagcttcacctgcgagtcccacggcttctcacccagagacatcaccctgaaatggttcaaaaatgggaatgagctctcagacttccagaccaacgtggaccccgtaggagacagtgtgtcctacagcatccacagcacagccaaggtggtgctgacccgcgaggacgttcactctcaagtcatctgcgaggtggcccacgtcaccttgcagggggaccctcttcgtgggactgccaacttgtctgagaccatccgaggggatgatgtgaagctcacctgccaggtggagcatgacgggcagccagcggtcagcaaaagccatgacctgaaggtctcagcccacccgaaggagcagggctcaaataccgccgctgagaacactggatctaatgaacggaacatctatattgtggtgggtgtggtgtgcaccttgctggtggccctactgatggcggccctctacctcgtccgaatcagacagaagaaagacctgaacctgcccaaggggaagaagcctgctccccaggctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtga

SEQ ID NO: 5132 - DNA, 633 bp, Homo sapiens
atgggcgctgcccactccgcgtctgaggaggtgcgggagctcgagggcaagaccggcttctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtaaagtatgctcctctggcccgcccggggctcctggtggtcgaggagctgctgtcgggaaaccctcacatcgagaaggagtccgctcgctccatcgccgacggggccatgatggaggcggccagcgtgtgcatggggcagatgatctggcaggggatcgacattgagaccaagatgcacgtccgcttccttaacatggaaaccatggccctctgccactga

SEQ ID NO: 5133 - DNA, 1037 bp, Homo sapiens
gagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccggggatggcctctgcctccaccacaatgcatactaccaccattgcaggtgagttctcatcacagagcctcaccataatggaaactgccgtgatgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggcgaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagca

SEQ ID NO: 5134 - DNA, 6489 bp, Homo sapiens
gctagtaaagaaatccttttggctttttcacgagatttcctaagtggtgaaggtgacctttcccgtcaccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcagattgctttggaaaatagcgtttgcttttcagggatattggagaagatattccactagacaaagatttctgaaattgaaatattattcaatcatcctgcaatctaggataagaatgataattgctgttacatcttataaacgatatctttgggctacagttacaattcagaggcattggcgtgcttatttaagaagaaaacaagatcaacaaagatatgaaatgctaaaatcatcaactcttataatccaatctatgttcagaaaatggaagcaacgtaaaatgcaatcacaagtaaaagctacagtaatattgcaaagagcttttagagaatggcatttaagaaaacaagctaaagaagaaaattctgctattatcatacaatcatggtatagaatgcataaagaattacggaaatatatttatattagatcttgtgttgttatcattcagaaaagatttcggtgctttcaagcccaaaagttatataaaagaagaaaagagtccatactaaccatccagaagtactacaaagcatatctgaaaggaaagattgagcgcaccaactatttgcagaaacgagctgcagccattcaattacaagctgcttttaggagactgaaagctcataatttatgtagacaaattagagctgcttgtgttattcagtcatactggagaatgagacaagacagagttcgatttttaaaccttaagaagactattatcaaatttcaggcacatgtaagaaaacatcaacaacgacagaaatataagaagatgaagaaagcagctgttataattcagactcatttccgagcttatatttttgccatgaaagttctagcatcttaccagaaaacacgctctgctgtcattgtgctgcagtctgcatatagagggatgcaagccaggaaaatgtatattcacatcctcacatctgttataaagattcaatcatattatcgtgcttatgtttctaaaaaggaatttttgagcctaaaaaatgctacaataaaattgcagtcaactgttaagatgaaacaaacacgtaaacaatatttgcatttaagagcagctgcactatttatccagcaatgttaccgttccaaaaaaatagctgcacaaaagagagaagagtatatgcagatgcgggaatcttgtatcaaactgcaagcatttgttagaggataccttgtccgaaagcagatgaggttacaaagaaaagctgttatttcactacagtcttatttcagaatgagaaaggctcggcagtattatctgaaaatgtataaagcaattattgtcattcagaattactatcatgcatacaaagcacaggtcaatcagaggaagaacttcttgcaagtcaaaaaagcagctacttgcttgcaagcagcttacagaggttataaagtacgccagctaatcaaacaacaatctatagctgctcttaaaattcagtctgcttttagaggctataataaaagggtaaaatatcaatctgtgcttcaatctataataaagattcagagatggtacagggcgtacaagactcttcatgatacaagaacacattttttgaagacaaaggcagctgtgatttccctccagtctgcttatcgtggctggaaggttcggaaacagattagaagggaacatcaagctgccttgaagattcagtctgcttttagaatggccaaggcccagaaacagtttagattgtttaaaacagcagcattagtcatccagcaaaatttcagagcatggactgcaggaaggaagcaatgtatggagtatattgaactccgtcatgcggtactggtgcttcaatctatgtggaagggaaaaacactgagaagacagcttcaaaggcaacataaatgtgctatcatcatacagtcatactatagaatgcatgtgcaacaaaagaagtggaaaatcatgaaaaaagctgctcttctgattcaaaagtattatagggcttacagtattggaagagaacagaatcatttatatttgaaaacaaaagcagctgtagtaactttacagtcagcttatcgtggtatgaaagtgagaaaaagaataaaggattgcaacaaagcagcagtcactatacagtctaaatacagagcttacaaaaccaaaaagaaatatgcaacctatagagcttcagctattataattcagagatggtatcgaggtattaaaattacaaaccatcagcataaggagtatcttaatttgaagaagacagcaattaaaatccaatctgtttatagaggtattagagttagaagacatattcaacacatgcacagggcagccacttttattaaagccatgtttaaaatgcatcagtcaagaataagttaccatacaatgagaaaagcagctattgttattcaagtaagatgtagagcatattatcaaggtaaaatgcagcgtgaaaagtacctgacaattttgaaagctgttaaagtccttcaggcaagttttagaggagtaagagttagacggactcttagaaagatgcagactgcagcaacactcattcagtcaaactacagaagatacagacagcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgtacagaacatatattacatttcagacttggaaacatgcttcaattctaattcagcaacattatcgaacatatagagctgcaaaattgcaaagagaaaattatatcagacaatggcattctgctgtggttattcaggctgcatataaaggaatgaaagcaagacaacttttaagggaaaaacacaaagcttctatcgtaatacaaagcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccaccttagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcagagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattag

SEQ ID NO: 5135 - DNA, 2847 bp, Homo sapiens
atgggagcggaaaggaggctgctgtcgattaaggaggcctttcggctggcgcagcagccgcaccagaaccaggcgaagctggtggtggcgctgagccgcacctaccgcacgatggatgataagacagtttttcatgaggagttcattcattaccttaaatatgttatggtggtctataaacgtgaaccagctgtggagagggtaatagaatttgcagcaaagtttgttacctcatttcaccaatcagatatggaagatgatgaggaagaggaagatggtggccttttaaattatttgtttacttttctcttaaagtctcatgaagcaaacagcaatgcagtgagatttagagtgtgcctgctcataaacaagcttttgggaagtatgccagaaaatgctcagattgatgatgatgtgtttgataaaattaataaagccatgcttattagattgaaagataagattccaaatgtgagaatacaggcagttctggcgctttcacgacttcaggatcccaaggatgatgaatgcccagtggttaatgcatatgctactttgattgaaaatgattcaaatccagaagttagacgggcagtgttatcatgtattgcaccatcagcaaagactttgccaaaaattgtagggcgcaccaaggatgtgaaagaggctgtcagaaagctggcttatcaggttttagctgaaaaggttcatatgagagctatgtccattgctcagagagtaatgctccttcaacaaggtcttaatgacagatcagacgctgtgaaacaagctatgcagaagcatcttcttcaaggctggttacggttctctgaaggaaatatcttagagttgctccatcggttggatgtagaaaattcttctgaagtggcagtctctgttctcaatgccttgttttcaataactcctctcagtgaactggtgggactctgtaaaaacaatgatggcaggaaattgattccagtggaaacattaactcctgaaattgctttgtattggtgtgccctttgtgaatatttgaaatcaaaaggagatgaaggtgaagaatttttagagcagattttgccagagcctgtagtatatgcagactatttattgagttacatccagagcattccagttgttaatgaagaacacagaggtgatttttcctatattggaaatttgatgacaaaagaattcataggtcaacaattgattctaattattaagtctttggataccagtgaagaaggaggaagaaaaaaactgctggctgttttacaggagattcttattttacccacaatcccaatatccctggtttcttttcttgttgaaagactactccacatcattatagatgataataagagaacacaaattgttacagaaattatctcagagattcgggcgcccattgttactgttggtgttaataacgatccagctgatgtaagaaagaaagaactcaagatggctgaaataaaagttaagcttatcgaagccaaagaagctttggaaaattgcattaccttacaggattttaatcgggcatcagaattaaaagaagaaataaaagcattagaagatgccagaataaaccttttgaaagagacagagcaacttgaaattaaagaagtccacatagagaaggtacagaatgatgctgaaacattgcagaaatgtcttattttatgctatgaactgttgaagcagatgtccatttcaacaggcttaagtgcaaccatgaatggaatcatcgaatctttggttttgcaaattgatgatgtcacaataaaaataagtgctttaaaggcaatctttgaccaactgatgacgttcgggattgaaccatttaaaactaaaaaaatcaaaacacttcattgtgaaggtacagaaataaacagtgatgatgagcaagaatcaaaagaagttgaagagactgctacagctaagaatgttctgaaactcctttctgatttcttagatagtgaggtatctgaacttaggactggagctgcagaaggactagccaagctgatgttctctgggcttttggtcagcagcaggattctttctcgtcttattttgttatggtacaatcctgtgactgaagaggatgttcaacttcgacattgcctaggcgtgttcttccccgtgtttgcttatgcaagcaggactaatcaggaatgctttgaagaagcttttcttccaaccctgcaaacactggccaatgcccctgcatcttctcctttagctgaaattgatatcacaaatgttgctgagttacttgtagatttgacaagaccaagtggattaaatcctcaggccaagacttcccaagattatcaggccttaacagtacatgacaatttggctatgaaaatttgcaatgagatcttaacaagtccgtgctcgccagaaattcgagtctatacaaaagccttgagttctttagaactcagtagccatcttgcaaaagatcttctggttctattgaatgagattctggagcaagtaaaagataggacatgtctgagagctttggagaaaatcaagattcagttagaaaaaggaaataaagaatttggtgaccaagctgaagcagcacaggatgccaccttgactacaactactttccaaaatgaagatggacagagaaaagtgacagtttcagctaggacgaacaggaggtgtcagactgctgaagccgactctgaaagtgatcatgaagttccagaaccagaatcagaaatgaagatgagactaccaagacgagccaaaaccgcagcactagaaaaaagtaaacttaaccttgcccaatttctcaatgaagatctaagttag

SEQ ID NO: 5136 - DNA, 1477 bp, Homo sapiens
ggcccccgcggccggggcagtcccgcagccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggaggaaagaccggcagagaccaatgccaatgtggacaactcggcgtccccctcggtggcccagctggccgggcggtttagggagcaggcggctgcagccaaggagacaccagccagtaaaccaacccgaaggaaaccgccctgttccctccccctgttcccccccaaggtagacctgggccagaatggtgaggagaaatcaccacccaatgcgagccaccctcctaaattcaaggtcaagagctcgcctctgattgagaagcttcaggccaatttaacctttgacccagctgctctactgcctggggcctcacccaagagtcctggactcaaggctatggtgtcgccatttcacagcccaccttctacccccagcagccctggtgtgcgatctaggcccagcgaggcagaggaggtgcctgtcagcttcgaccagccccctgaaggcagtcatctgccctgttacaacaaggtgcggacgaggggctcaataaaaaggcgccctccctccaggcgattccgaaggtcacagtcagactgtggagaacttggagatttcagggcggtggagtcatctcagcagaacggtgctaaggaagaggatggggatgaagtgttgccatccaagagcaaggccccaggatcccctttgtccagtgagggagcagcgggagagggagtgagaaccctgggacctgctgaaaagcctcctctgaggaggtcacccagcaggacagagaagcaggaggaggacagggccacagaggaagccaagaacggtgaaaaggccaggcggagttcagaggaggtggacggccagcacccggcccaagaggaggtcccggaatcgccccagacctctggcccagaggcagaaaataggtgtgggagccccagggaggaaaagccagctggagaggaagcagagatggaaaaggctacagaggtgaagggggagagggtgcaaaatgaagaggtgggacctgaacatgacagccaagaaacaaagaagctggaggagggagctgcagtgaaggagaccccccacagtccccctggaggagtgaagggcggagatgtccccaagcaggaaaaaggcaaggaaaaacaacaggagggggcagtgctcgagccaggctgcagcccccagaccggccctgcccagctggagaccagcagtgaggtccagagcgagccagcagtccccaagccggaggtagcagcaacagttgtagcagcagcagacgaagccattgcagaggcagaatatgctgagtgtctggagtcagcctga

SEQ ID NO: 5137 - DNA, 411 bp, Homo sapiens
atggcagctcagcggctgggcaagcgcgtgctgagcaagctgcagtctccatcgcgggcccgcgggccagggggcagtcccggggggctgcagaagcggcacgcgcgcgtcaccgtcaagtatgaccggcgggagctgcagcggcggctggacgtggagaagtggatcgacgggcgcctggaggagctgtaccgcggcatggaggcagacatgcccgatgagatcaacattgatgaattgttggagttagagagtgaagaggagagaagccggaaaatccaggacttcatccaggagctgctggcaaagcttcaaggcctccacaggcagcccggcctccgccagccaagcccctcccacgacggcagcctcagccccctccaggaccgggcccggactgctcacccctga

SEQ ID NO: 5138 - DNA, 9043 bp, Homo sapiens
gattgacccaggaggcttcagtggacctcaagaacactggcagagaggaattcctcacagccttcctgcagaactatcagctggcctacagcaaggcctacccccgcctccttatctccagtctgtcagagagccccgcttcagtctccatcctcagccaggcagacaacacctcaaagaaggtcacagtgaggcccggggagtcggtcatggtcaacatcagtgccaaggctgagatgataggcagcaagatcttccagcatgcggtggtgatccattctgactatgccatctctgtgcaggcactaaatgccaagcctgacacagcggagctgacactgctgcggcccatccaggccctaggcaccgagtattttgtgctcacaccccccggcacctcagccaggaatgtcaaggagtttgccgtggtggccggtgccgcaggtgcctcggtcagtgtcacgctgaaggggtcagtgacattcaatggcaagttctatccagcaggcgatgtcctaagagtgactctacagccctacaatgtggcccagctacagagctcagtggatctctcggggtcaaaggtcacagctagtagccccgtggctgtcctctctggccacagctgtgcgcagaaacatacgacctgcaaccatgtggttgagcagctgctacccacgtctgcctggggcacccactatgtagtacccacgctggcctcccaatctcgctatgatttggccttcgttgtggccagccaggccacaaagctgacctacaaccatgggggtatcactggctcccgtgggctccaggcaggtgatgtggtagagtttgaggtccggccatcctggccactctacctgtctgcaaatgtgggcatccaggtcctgttgtttggcacaggtgccataaggaatgaagtgacttatgacccctacctggtcctgatcccagatgtggcggcctactgcccagcctatgtggtcaagagtgtaccaggctgtgagggcgtggccctggtagtggcacagacgaaggctatcagcgggctgaccatagatgggcatgcagtgggggccaagctcacctgggaggctgtgccaggcagtgagttctcgtatgctgaagtggagctcggcacagctgacatgatccacacggccgaggccaccaccaacttgggactgctcaccttcgggctggccaaggctataggctacgcaacagctgctgattgcggccggactgtactgtccccagtggagccctcctgcgaaggcatgcagtgcgcagccgggcagcgctgccaggtggtaggcgggaaggccgggtgtgtggcggagtccaccgctgtctgccgcgcccagggcgacccccattacaccaccttcgacggccgtcgctacgacatgatgggcacctgttcgtacacgatggtggagctgtgcagcgaggacgacaccctgcccgccttcagcgtggaggccaagaacgagcaccggggcagccgccgcgtctcctacgtgggcctcgtcactgtgcgcgcctacagccactctgtgtcgctgacccgcggtgaagttggcttcgtcctggttgacaaccagcgctcgcgcctgccagtctccctgagtgagggtcgcctgcgtgtgtaccagagcggaccacgggccgtggtggagctggtctttgggctggtggtcacttatgactgggactgccagctggcactcagcctgcctgcacgcttccaagaccaggtgtgcgggctgtgtggcaactataatggtgacccagcagacgacttcctcacgcctgacggggctctggctcctgacgctgtggagttcgcaagtagctggaagctggatgatggggactacctgtgtgaggatggctgccagaacaactgtcccgcctgcaccccaggccaggcccaacactatgagggcgaccgactctgtggcatgctgaccaagctcgatggccccttcgctgtctgccatgacaccctggaccccaggcccttcctggagcagtgtgtatatgacctgtgtgtggtcggtggggagcggctcagcctgtgccgtggcctcagcgcctatgcccaggcctgtctggagcttggcatctcggttggggactggagatcaccagccaactgccccctgtcctgccctgccaacagccgctatgagctctgcggccctgcttgcccgacctcctgcaacggggctgcggcgccgtccaactgctccgggcgcccctgcgtggagggctgcgtgtgcctcccaggcttcgtggccagcggcggcgcctgcgtgccggcctcgtcgtgtggctgcaccttccagggtctccagctcgctccgggccaggaagtgtgggcggacgagttgtgccaaaggcgctgcacctgcaacggcgccacccatcaggtcacctgccgcgacaagcagagctgcccggcgggtgagcgctgcagcgtccagaacggcctcctgggctgctaccccgatcgcttcgggacctgccaggggtccggggacccacactatgtgagcttcgacggccggcgcttcgacttcatgggcacctgcacgtacctgctggtcggctcatgcggccagaacgcagcgctgcctgccttccgggtgctggtggaaaacgagcatcggggcagccagactgtgagctacacgcgcgccgtgcgggtggaggcccgcggggtgaaggtggccgtgcgccgggagtaccccgggcaagtgctggtggatgacgtccttcagtatctgcccttccaagcagcagatgggcaggtgcaggtgttccgacagggcagggatgccgtcgtgcgcacggactttggcctgactgtcacttatgactggaatgcacgagtgactgccaaggtgcccagcagctatgctgaggccctgtgtggactctgtgggaacttcaacggggacccagctgatgacctggctctgcggggtgggggtcaagctgccaatgcactggcctttgggaacagctggcaagaagagacgaggcccggctgtggagcaactgaaccgggtgactgtcccaagctggactccctggtggcccagcagctgcagagcaagaatgagtgtggaatccttgccgaccccaaggggcccttccgggagtgccatagcaagctggacccccagggtgccgtgcgcgactgtgtctatgaccgctgcctgctgccaggccagtctgggccactgtgtgacgcactggccacctatgctgctgcatgccaggctgctggagccacagtgcacccctggaggagtgaagaactttgcccactgagctgcccaccccacagccactatgaggcgtgttcctacggctgcccgctgtcctgtggagacctcccagtgcccgggggctgtggctcagaatgccatgagggctgcgtgtgcgatgagggctttgcgctcagtggtgagtcctgcctgcccctggcctcctgtggctgcgtacaccagggcacctaccacccaccaggccagaccttctaccctggccccggatgtgattccctttgccactgccaggagggcggcctggtgtcctgtgagtcctccagctgcggaccgcacgaggcctgccagccatccggtggcagcttgggctgtgtggccgtgggctctagcacctgccaggcgtcaggagacccccactacaccaccttcgatggccgccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcggatgtgtggcctgtgtgggaactacaacggcgaccccaaggatgacttccagaagcccaatggctcacaggcaggcaacgccaatgagttcggcaactcctgggaggaggtgaacggtgtggacatgaagctgcccctggtgctggccaacggccagatccgtgcctcccagcatggttcagatgttgtgattgagaccgacttcggcctgcgtgtggcctacgaccttgtgtactatgtgcgggtcaccgtccccggaaactactaccagcagatgtgtggcctgtgtgggaactacaacggcgaccccaaggatgacttccagaagcccaatggctcacaggcaggcaacgccaatgagttcggcaactcctgggaggaggtggtgcccgactctccctgcctgccgcccaccccttgcccgccggggagcgaggactgtatccccagccacaagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacctggtggatccccagggtcccttgaaagattgcatctttgatctctgcctgggtggtgggaacctgagcattctctgcagcaacatccatgcctacgtgagtgcttgccaggcggctggaggccacgtggagccctggaggactgaaactttctgtcgtgaccatggagtgccctccgaacagtcactacgagctctgtgcggacacctgctccctgggctgctcagctctcagtgcccctccacagtgccaggatggggctctgatcggcaccccctccttgcagccatggagtgccctccgaacagtcactacgagctctgtgcggacacctgctccctgggctgctcagctctcagtgcccctccacagtgccaggatgggtgtgctgagggctgccagtgtgactccggcttcctctacaatggccaagcctgcgtgcccatccagcaatgcggctgctaccacaatggtgtctactatgaggatgggtgtgctgagggctgccagtgtgactccggcttcctctacaatggccaagcctgcgtgcccatccagcaatgcggctgctaccacaatggtgtctactatgaggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccatgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtcgacggcgtgttcgtggctctgcctttccagctggactcgctcctgcacgcacacctgagcggcgccgacgtggtggtgaccacaacctcagggctctcgctggctttcgatggggacagcttcgtgcgcctgcgcgtgccggcggcgtacgcggcctctctctgtggcttatgcgggaactacaaccaggaccccgcagacgacctgaaggcggtgggcgggaagcccgctggatggcaggtgggcggggcccagggctgcggggaatgtgtgtccaagccatgcccgtcgccgtgcaccccagagcagcaagagtccttcggcggcccggacgcctgcggcgtgatctccgccaccgacggcccgctggcaccctgccacggccttgtgccgcccgcgcagtacttccagggctgcttgctggacgcctgccaagttcagggccatcctggaggcctctgtcctgcagtggctacctacgtggcagcctgtcaggccgctggggcccagctcggcgagtggaggcggccggacttctgtcccttgcagtgccctgcccacagccactatgagctctgcggtgactcctgccctgtgagctgcccgagcctctcagcacccgagggctgtgagtcggcctgccgtgaaggctgtgtctgcgatgctggcttcgtactcagtggtgacacctgcgtacccgtgggccagtgtggctgcctccatgatggccgctactacccactgggcgaggtcttctacccgggccctgagtgtgagcggcgctgtgagtgtgggccaggtggccatgtcacctgccaggagggcgcagcctgtgggccccatgaggagtgccggttagaggatggtgtccaggcctgtcatgccacaggctgtggccgctgcctggccaacgggggcatccactacatcacccttgatggccgtgtctacgacctgcatggctcctgctcctatgtcttggcccaagtctgccacccaaagcctggggacgaggacttttccatcgtgcttgagaagaatgcagctggagatctccaacgcctcctggttactgtggctggccaggttgtgagcctagctcaggggcagcaggtcaccgtggacggcgaggctgtggccctgcctgtggctgtgggccgcgtgcgggtgaccgccgagggccgaaacatggttctgcagacgaccaaggggctgcggcttctctttgatggcgatgcccacctcctcatgtccatccccagccccttccgtggacggctctgtggcctctgtgggaacttcaatggcaactggagtgacgactttgtcctgcccaatggctcagcagcgtccagtgtggagaccttcggggctgcatggcgggcgcccggctcctccaagggctgtggcgagggctgcgggccccaaggctgcccagtgtgcttggcagaggagactgcaccctatgagagcaacgaggcctgcgggcagctccggaacccccagggccccttcgcgacctgccaggcggtgctgagtccctctgagtacttccgccaatgcgtatacgacctgtgcgcgcaaaagggtgacaaagccttcctgtgccgcagcctggcagcctacacggcggcctgtcaggcagctggcgtggccgtgaagccctggaggacagacagcttctgcccgctccattgccccgcccacagccactactccatctgcactcgcacctgccagggatcctgtgcggctctctccggcctcacgggctgcaccacccgctgttttgagggctgtgagtgcgacgaccgcttcctgctttcccagggtgtctgcatccctgtccaagattgtggctgcacccataatggccgatacttgccggtaaactcctccctgctgacctcagactgcagcgagcgctgttcctgttcctcaagctctggcctgacatgccaggccgctggctgcccaccaggccgtgtatgtgaggtcaaggctgaagcccggaactgctgggccacccgtggtctctgtgtcctgtctgtgggtgccaacctcaccacctttgatggggcccgtggtgccaccacctctcctggtgtctatgagctctcttcccgctgcccaggactacagaataccatcccctggtaccgtgtagttgccgaagtccagatctgccatggcaaaacggaggctgtgggccaggtccacatcttcttccaggatgggatggtgacgttgactccaaacaagggtgtgtgggtgaatggtctccgagtggatctcccagctgagaagttagcatctgtgtccgtgagtcgtacacctgatggctccctgctagtccgccagaaggcaggggtccaggtgtggcttggagccaatgggaaggtggctgtgattgtcagcaatgaccatgctgggaaactgtgtggggcctgtggaaactttgacggggaccagaccaatgattggcatgactcccaggagaagccagcgatggagaaatggagagcgcaggacttctccccatg

SEQ ID NO: 5139 - DNA, 1005 bp, Homo sapiens
tcagcaaatcacatgaacagttccctgctgtctttatatcggaaaggaaatcctgattctgtttcaaatactcctgagatggagcaaagagaaaccacctcttcaacaccacgaataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacagtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattg

SEQ ID NO: 5140 - DNA, 1203 bp, Homo sapiens
atgtacgcggcggcggggccgtacgcgggcgcgcccaactacagcgccttcctgccctacgccgcggatctcagcctcttctcgcagatgggctcgcagtatgaactgaaggacaaccctggggtgcaccccgccaccttcgcagcccacacggcgccggcttattacccctacggccagttccaatacggggaccccgggcggcccaagaacgccacccgcgagagcaccagcacgctcaaggcctggctcaacgagcaccgcaagaatccctaccccaccaagggcgagaagatcatgctggccatcatcaccaagatgaccctcacgcaggtctccacctggttcgccaacgcgcgccggcgcctcaagaaggagaacaaggtgacatggggagcgcgcagcaaggaccaggaagatggagcgctcttcggcagcgacaccgagggcgacccggagaaggccgaggacgacgaggagatcgacctggaaagcatcgacattgacaagatcgacgagcacgatggcgaccagagcaacgaggatgacgaggacaaggccgaggctccgcacgcgcccgcagccccttctgctcttgcccgggaccaaggctcgccgctggcagcagccgacgttctcaagccccaggactcgcccttgggcctggcaaaggaggccccagagccgggcagcacgcgcctgctgagccccggcgctgcagcgggcggcctgcagggtgcgccgcacggcaagcccaagatctgccacggactgtacacctgccacatcggcaagttctccaactggaccaacagcgcattcctcgcacagggctccctgctcaacatgcgctccttcctgggcgttggcgctccccacgccgcgccccatggccctcaccttcctgcacctccaccaccgcagccgccggtcgctattgccccgggggcactcaacggagacaaggcctcggtccgcagcagccccacgctcccagagagagacctcgtccccaggccagattcgccggcacagcagttaaagtcgcccttccagccgactggtgtaaaggacaaatatgacaacgacgtcaaggactcgcatccgtcgctttctgcagaaaggggcttcttcggtcccgagctcgcgtccaggtggccaggcctctgccggcggctccagtggctgcgattatcgggttcg

SEQ ID NO: 5141 - DNA, 2442 bp, Homo sapiens
agacatactctcaggtggatgcgagaaatatccagctgttgcagcaacttcatcccactcgaaatccagctgagtcacactcacaggtggaatggagggcttcgagaggccatggggcaaggtgacccttccttatcatctaattacagaccttctcaagatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggtgaggaaatccaaattggtcacatccccagggaagatgtagactatcacctgtacccacacggtccgggactcaatccaaatgcctctacaggacaagaagctctctctcagacaaccatctcatgggccccattccaggacacttctgagtacatcatttcatgtcatcctgttggcactgatgaagaacccttacag

SEQ ID NO: 5142 - DNA, 272 bp, Homo sapiens
catggctcctgattgcacttcgtggtggaaagattgaagttcagcttaagaatgaacatacatccaaaatcacaactggaggtgacgttattaataatggtctatggaatgatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaa

SEQ ID NO: 5143 - DNA, 2739 bp, Homo sapiens
atggggctcccagcgctcgagttcagcgactgctgcctcgatagtccgcacttccgagagacgctcaagtcgcacgaagcagagctggacaagaccaacaaattcatcaaggagctcatcaaggacgggaagtcactcataagcgcgctcaagacaaaagctcaaaaaactcctattttatatggtttgaaaagataccgctgtgcactgaaatgtttgacacagactttaccgtgggcgacttacccagcagatcatcagccacaccacccctgctgtggacaatatgtcattgtggaggccagggcaggcactggaggcgagtgcctcagcatccgtaggcttcggcatccagatgctcctgctgcatctgtgtctgctggccaggacttgccacaatctgccggccttctgaccgaagctgcccagagctcagtgtgcaagctcctgtcctttgttgttgctaatagaaacctggcctttcacgaaaggtcccgtcatctattaaaacactggttgcatagcagccaaacatttttgttgagaaataagccggacggaaatctctgtgatgacacttccttcaacctcacgctattgccgaacatgcgacaaggaggatgttgggaatggaatcataagaatcctcctgcagcacgtcagcagttcaccctggagcagttagagctgtggataagatgccatgaatttgcgagtaaaagtgtttatctctccctggagcagactagacccctaggctctgtcctagagcacaactcacccttagctgccctgcaacctgatcatctccaacagggaagtaatattgccagcgctgaagcagaagatgcagacactgtgaaatgtgctgtggtcaaccaagctgtccacatgccaggagatttatttcccatctcttcagcaagctctctccatcctggggcagctggtgtctcctcttacttgcctctatggactggttttctgcctcaggaggtcaccctagtccaagtcgaaaacattcctcagtttgcttgtctaacgtcaattaacaagttcctctgtgccctaattacaaattcccctgaagaaaagcagattggccccaggatattggcagatagcaatctgagtgtttgcaggtatgacatgttgaggaaacgtgtctaccttaggggccaagctcaagttccaccttctgaggaagcccagtacttcaggcctgtgaacgctaatgcaagtggagaagggaggttctccaaaacaagcttgagatgctgtcccaaagtctggggaatggattccaaacaagtaaaaggacaggtgtccactttagctgtactgaaaaattcctctatcaagcctgagaagcctcacaaaggccccgttgtgcatgaccagccactccctgatcctcatggcagctgcccttggcagtgcggcttttcagatttgtcttcagcgaagcggaagtttgcagattccttaaatgaatttaaatttcagtgcataggagatgcagaaacagatgatgagatgtgtatagcaaggtctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggaatttccttctggatccttcttctctgcctttgcagattttcagaatgatttctcctgttttccccctccacttgcagtgtcagttggcaagcccaggcagagagaagctttgaggtgtgtggggtggttgggagtagatgcatctctccgtgtaagcgtgttggatttgcgctacaagaagatcaaaggctacaggaacacatggggcttagccgcaggagcccagttggaaggcgtatcagcccagttgtctaagcagccacacgatgcagggggtggtggtgacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacatcttcttgagttctgctaaaggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctcccatggcttcccacattgctccagtcattgccattttccagccagaaaatgaggatgaaagcatttcgaaggacccagaagatgcacatgtcacttccattggctcaaacataatggtacagccatatctacctgcaaagcaggctgggaaacctaggctgtacataggcagtcatgggccctgccaggaccctggacatgttattacttcaaagaagaagaggagaaaggatactgtgaatagttggcagtctccatcctag

SEQ ID NO: 5144 - DNA, 465 bp, Homo sapiens
actattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtctatgcctcgcccccgccccgtttgccggctattggcttctcccatcccctaccagagggtgacgagacgggaagccgggaagccgggagggatctactgtgcacgtccaaggcgctgggcctagagcaggagaaagggcttggaggtgcgtcggagactatgaagtgcggccttcggcgtgatcctttccggaagcggaagctcggggggcgggccaagaaggtccgggagcccacggcggttgttttttctgtgaggcttcacttacctcggtctgggcttctctga

SEQ ID NO: 5145 - DNA, 255 bp, Homo sapiens
atggagaggaaggcctggaggagactaggaagaaaatttttggttcagccaggtacaagtgaaaagggcgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccag

SEQ ID NO: 5146 - DNA, 918 bp, Homo sapiens
atgcgactcaccgtgctgtgtgctgtgtgcctgctgcctggcagcctggccctgccgctgcctcaggaggcgggaggcatgagtgagctacagtgggaacaggctcaggactatctcaagagattttatctctatgactcagaaacaaaaaatgccaacagtttagaagccaaactcaaggagatgcaaaaattctttggcctacctataactggaatgttaaactcccgcgtcatagaaataatgcagaagcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatgattccagacctgcatcagagtctgaaagctctccctacctagtccactccttcacccgttatccttcacaggtgtttccccaaaaacctcttttatgtcgaatccgatcctcttggtatcagcttttagagaacttgaattaa

SEQ ID NO: 5147 - DNA, 570 bp, Homo sapiens
atgcagaacctcaatgaccgcctggcctcctacctggacaaggtacgtgccctggaggaggccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagagtgggcctggctgtgcatctcccacaatcacagcttcttcaagcacaccaaggagagaaaggacgctctgaaatgctccaaccataaaagtggggtgggggagttagggactcggtctgtgaatggccctgagttttccaccatcaaaactgaataa

SEQ ID NO: 5148 - DNA, 458 bp, Homo sapiens
ccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagtctcccattagaatatcagtatccacagaaggagcaaatacttcttcatcttctctggatgccttcagcaactgcctgaggcatgatacccagctgtttggagcttccgttccaaaacttcttcattctcatataaagttagctgtgatggagtaa

SEQ ID NO: 5149 - DNA, 2103 bp, Homo sapiens
atgctgcataagctacaaagaaaacaagtgtgcatgcttgcttgctgtgtgtcactggggtttactatgcctcagggtaaaggtacatgtgacagcgttgcagctatgagtggaattttaaaggggaagtttgaagaagtcaacggctcctcaccctgctcttcagtgcaggaatcagatgatgaagttttcagctgtgacagtactgagagtgttgatagtgtcaatcgttcagttttaatgattttaccaggcagtgctagtgatgagtttatgaacaaattcaatgagctaaatgaaatagtgggccgagaattcaatttgagtgtgaaagaacattttacttcccctttctgtaacccagtgtttgacatttccactagtgtaaacaatattgggattgactatactctggcggaaaaaggagacaatgtcttcaattcctcaggtacatgtgacagcactgcagcgatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttatggaggaaaagctgaactccttaaaactaaagatgactaagaatggcacagtagaatcagaagaagccagcactcttacactggatgacatttctgatgatgacattgacctggacaacacagaggtagatgagtacttcttcctacaacctttgccaacaaaaaaacgaagagctctgctgcgtgcctctggagtgaaaaagattgacgtggaagaaaagcacgaactccgagccatccgcctctcacgagaggactgtggctgtgactgccgagtgttctgtgatccagacacgtgcacctgcagcctggctggcattaagtgccaggtggatcgtatgtctttcccatgcggctgcactaaagaaggatgtagtaacacagcaggtagaattgaatttaatcctatccgtgttcggactcactttttgcacacaataatgaaacttgaactggagaaaaaccgagagcagcaaatccccacgctgaatggctgccacagtgagataagtgctcacagtagttctatgggccctgtcgctcactccgtagaatattcaatcgcagacagttttgagattgaaactgagccccaggctgcagtgctgcacctgcagtcggctgaagaattagattgccaaggagaggaggaggaagaagaggaggatgggagcagcttttgcagcggagtcacagattctagcacgcaaagcttggcacctattctttgttattctgatggcaccgccgttcacgaaagccatgcaaagaatgcttctttttatgccaactcttcaactctgtattaccaaatagatagccacattccaggaactccaaatcagatctctgagaactattctgaaagagacactgtcaaaaatggtaccctttcgctggtgccttacaccatgaccccggagcaattcgttgactatgcccgacaagcagaagaggcctatggtgcctcccactacccagctgccaacccctctgtaatcgtttgctgctcctcttccgaaaatgatagcggtgtgccctgcaatagtttatatcctgaacacaggtccaatcaccctcaagtggaatttcactcatacttgaaaggcccctcccaagaagggtttgtctctgcattgaatggtgacagtcacatttcagagcatcctgctgaaaattctttgagccttgcagaaaagagcatattgcatgaagagtgcatcaaatcacccgtggttgagacagtccctgtttag

SEQ ID NO: 5150 - DNA, 585 bp, Homo sapiens
atgaacctaattagtaatagcattaaagaaaaaaatatcaaacaaaatatccatgagattggccagtataagccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaaggtgaaataacaatatccttggcctatacagtgacattaagtgatttttga

SEQ ID NO: 5151 - DNA, 705 bp, Homo sapiens
atggaggtgagaattatacatggaaatcccttcaatttgtacatcaggtgccagtcacgaattgcccgaacattacctgctgatcagaagccagaatgtcggccatactgggaaaaggatgatgcttcgatgcctctgccgtttgacctcacagacatcgtttcagaactcagagcctccgagagaaggagagagggtccacaagccagatccatccccatccacacagacggcagattcgcagggaagcaggccgagcctgatcttttctccgctagaactgctcaacaggtgaagaatctttttccagcactcctgagcccttcgggtcgcggaacagtgcgaagattattccaatgcctcattcggagaggtgataatctggtctgtggtttctttttcggtggggcatggggtggggggtgtgccgtcgccctgagccccgccgtccatggaggcactgtcccagggtgtgccgtcgccctgagccccgccgtccatggaggcactgtcccagggtgtgccgtcgccctgagccccgccgtccatggaggcactgtcccacgggccaaagcgggctcctgtattaaaggtggggagtcagggggagaacttcagggacaccggaatgtaatgattgctgtctgcggtacacgttttcagagtccacgggtaataagtggaaaagacatcatgattgtttag

SEQ ID NO: 5152 - DNA, 1734 bp, Homo sapiens
atgaagaagaacacgctggccgtgagaaccgccagcagctgtacggtgggtctggtgcgtatgtggacaatccatagacttagaatcccgttttccattgccttggccctgaaggaggctgtgggctacagcatagagaaagcagagcaagtcccgctgcttggaacagggtggttcgccgttataacaggccgtcagactctcaacatgttcctgatgagattagaagctcctgaagttcctggcatcctttttgggctgctcacagcccccagcctctatggtgaagacatacttgctagcagcgtcaccaacttgctgccaagagatcagtgctgcaaggcaaggttatttctaactgagcagagcctgccaggaagaaagcgtttgcaccccacaccactgtgcaggtgtgaccgcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgcccggaggtag

SEQ ID NO: 5153 - DNA, 3867 bp, Homo sapiens
atgagtgcagggttgcccagcccagacaagctcctgggaatccatggagctcaagaaccagtgaagcctctgggccagggtctcctcaaggacaaccaggccagccaggtctacagagagtggcatgcaggccctggatcccagggcctggtcagtcttctggctgagcagaggctactggccaagcttccctaccactgctctgagcccctggtggtcctgtgctctctaacacatgtgcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaaaaaaaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaaaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaa

SEQ ID NO: 5154 - DNA, 1332 bp, Homo sapiens
atgaacagagcagaggaatggtgtagcagaaacagctgtgtccgacaacggatgaagctgctgaactacatcaagggcttggtgcaccagctcttttcagaacaatcatccccagcaccttgccaggaggaggctatgtattaccagaggtttaatcatttccacctgaggacagcagggacccaggctggagaggaggttccgcccctggcatctgcgcggcgaaatccatatgtaaacgagccctgccccctggtggaaggagaagggtctggagctggatctgtcagacccctcaatggaggtgcaggctttgcaggcagcagtgcatgtggtggctctgttgctggaagtgaattttcctgtgccttgggagggggcttgggcagtgttcctggtgggagccatgctggtggtgcccttggaaatgctgcttgtattggctttgctggaagcgaagggggactcctctctggaaatgagaaggtgaccatgcaaaatcttaatgaccgcttggcatcctacctggataatgtgcgagctctggaggaggcaaatgctgaattagagagaaaaatcaagggttggtatgaaaaatacggacctggatcttgccgtggacttgatcatgactatagcagatatcacctaacaattgaggatcttaagaataagattatctcctccactactactaatgctaatgtcattctgcagattgataatgccagactggctgctgatgatttcaggctaaagtatgaaaatgagctcacccttcaccaaaacgtagaggccgacatcaacggattacggcgagtcctggacgagctgacgctctgcaggaccgaccaggagctgcaatatgagtctctgagtgaggagatgacatatctcaaaaagaaccacgaagagaaacactccctggagtgctccttgacggagaccgagagcaactactgtacgcagctggcgcagatccaggctcagatcggggccctggaggagcagctgcaccaggtcagaaccgagaccgagggccagaagctggagtatgagcatctcctcgatgtcaaggtccacttggaaaaagaaattgagacctactgccgcctgatagatggagatggaaattcatgctccaaatcaaagggctttggatcaggaagccctgggaattcatctaaagatttatccaaaaccacactggtaaagacagtggttgaagagctagatcaacgtggtaaagttctttcatcaaggattcactccattgaagaaaagacatctaaaatgaccaacggcaagacagaacaaagggttcctttctag

SEQ ID NO: 5155 - DNA, 837 bp, Homo sapiens
atggcgtactccacagtgcagagagtcgctctggcttctgggcttgtcctggctctgtcgctgctgctgcccaaggccttcctgtcccgcgggaagcggcaggagccgccgccgacacctgaagccagttttgagcttgctcaactgcaagaaaaactgaaggagacagaagcagccatggaaaaattaatcaacagagtgggacctaatggaaacagaattaagactgtttcattcattgaagatcagaatgccctgcgtacagtctggaaaagtaacatgtgccgcctgaagagacaagagtttgtgataagcagatatttgccagaaccacacaaagcacagactgtgacttctgaccaagagaaacggttgctacatcagctccgagaaatcaccagggtcatgaaagaaggaaaattcattgacagattttctccagagaaagaagctgaggaggccccttacatggaggactgggaaggcagggaagggctaaactggaactatagaaaggaggatggcaccatggtatctcgccagcgctggcacaaagttctagtgccctctagaaactggaccatgttgcaaaagctaatcgttggagggggtctctcacagagatgtacggccgaggtgtgggcagatcctgctaggacagaccgagaagtgtgcagcagccgtactaaggcctgcttactgctgagtagccctcgcggaggggccagacacaggccaatcctggatcatactcacgtgcaaaaagccagacaactttcaacagggaactgcctgatttcctactggaatggtttcaatctaatttatcaactctga

SEQ ID NO: 5156 - DNA, 1200 bp, Homo sapiens
atggaatttattcggcaaaaaggaaaaataactctcagcaaagtgagagagagtcctgctagcaggtttcccacctcacagattgaattccaggtcaccacacaggaacaggagaggccaggctcctcactgctgcaaatggcacgaacttcccaaggctccaccctgtcttcccagtgcacaggtggctcatccacaataagcttaaactctaaccaggctttggcaaacccagtttcaacacacaccattttaactcccaattccagcctcctgtctacttctcacgggacaagaatgccatcattatctacagcagttcagaatatggggatgtatggaaatctgccttgtaatcaacctaacacatacagtgtcacttcaggaatgaatcaattgacccaacagagaaacccaaagcaattgttagcaaatcaaaacaaccctatgatgccacggccacctaccttagggccaagtaataataacaatgtagccacttttggagctggatctgttggtaattcacaacaattgagaccaaatttaacccatagtatggcaagcatgccaccacagagaacatcaaacgtaatgatcacatccaacacaactgcaccaaactgggcctctcaagaaggaacaagcaaacagcaagaagccctgacgtctgcaggagtccgcttccccacaggtacacctgcagcctataccccaaatcagtcactgcaacaggcagtaggtagccagcaattttcccagagggcagtggctcctcctaaccagttaacaccagcagtgcaaatgagacccatgaaccaaatgagccaaacactaaatgggcaaaccatgggtcccctcaggggtctgaatctcagacccaatcagctaagcacacagattttgcctaatttgaatcagtcaggaacagggttgaatcagtcgaggacgggcatcaaccagccaccatccctgacgcccagcaattttccttcacccaaccaaagttccagggcttttcaaggaactgaccacagcagtgacttagcttttgacttcctcagccaacaaaatgataacatgggccctgccctaaacagtgatgctgatttcattgattctttattgaagacagagcctggtaatgatgactggatgaaagacatcaatcttgatgaaatcttggggaacaattcctaa

SEQ ID NO: 5157 - DNA, 465 bp, Homo sapiens
atgggggacacagcgcccccgcaggcccccgcaggagggctagggggggcctctggggcggggctccttggagggggctcagtcaccccgagagtgcacagtgctatcgtggagcgcctccgggctcggatcgctgtctgccgccaacaccacctgagctgtgaaggacgatatgaacgaggcttccccccaaagctgctggaccagtggcctctggtggaaggtagaaccctgccctgtggccctgcaggcttcctcccttttggagctccatgggacttctggattctatgtctgctccagtttacccaggctgttcctgttgaatatgctctgcaaataagtcatctgtcagcaaaggaacctggagaagaaagacgcaggcaccatttcagtgaatgcaagcaggaacaggacaccgaggaacatctgtggaatgcaggcctgaagctgaaggacgagtaa

SEQ ID NO: 5158 - DNA, 414 bp, Homo sapiens
atggcaaaagatgttgacgtacaactggctcctgaggctgtcaattgtttagagctcccaagtagtactgcattacggaatctactacttagaagaatgtacaagatgagtgcaaatgggctgttccccgatagcatcttctgggaagaatccaaccaagatacaaagcagatgatggtggatcggcaaactcttttctatgaaaagaaaaaccagatataccagggactggaaagcacctgcttgaaaattgatatgagcatgtctgaatttttcccttataagagcctgagtattgtaacaggttctctggcccagggaggcattgctaaagtagcacttcagagagcccctctgtcatatctggatttcatccaaacctttctatgcatttatatgctggaactttcttga

SEQ ID NO: 5159 - DNA, 3248 bp, Homo sapiens
acagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcagtgtacctaatatataccaggacaccacaatttcttggtggaaagatgggaaggaattgcttggggcacatcatgcaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatcacccacctggccatcttagcaagaagcccagcatcttgctcttactgcaggttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttacc

SEQ ID NO: 5160 - DNA, 4464 bp, Homo sapiens
atggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacaaagtggagcaaaaagtttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaagctccaaaaacgagagaagacatgcagggcttaccttaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaataattaccgtgtttgtgatggctactataatacggacttacctggctatgaagataataagccatttatcaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggaatgactggcaattacctactaacaaaccctcttcttcgaccccacggcactaacaacccctataacacattgctcgctgaaacagttgtatgtaatgccccttcagctcctgtatttaactcaccaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctt

SEQ ID NO: 5161 - DNA, 3872 bp, Homo sapiens
agacatgagtggacaccttagggggctcggctgcggaaaaggtgctgcagtccacagggaacatggggggattggacgggttgcctgaagaagagaggaaagaatccctcaccccagcccccaaaaggctgtgatgggatggggaaaccccataatcgctgtcttccggacaccttttgccccttggctgcagttccactggtcggcgcccttctcagcctggcttggaaccgtcctcactcacctccactcctcccagcagcgctcaggcacaacggtgtgtcctccctgtgacaacgagttgaaatctgaggccatcattgaacatctctgtgccagcgagtttgcactgaggatgaaaataaaagaagtgaaaaaagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaaggtgaagagccagtacttgctgacggccatccacaagtgggacaagaaaaacaaggagttcaaaaacttcatgaagaaaatgaaaaaccatgagtgccccacctttcagtccgtgtttaagtgattctcccgggggcagggtggggagggagcctcgggtggggtgggagcgggggggacagtgccccgggaacccggtgggtcacacacacgcactgcgcctgtcagtagtggacattgtaatccagtcggcttgttcttgcagcattcccgctcccttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatgtaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttaggattctaatctcatgttttttccttttcacatttttaaaagaacaatgacaaacaccacttatttttcaaggttttaaaacagtctacattgagcatttgaaaggcgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgtccccccgcactttttacatatatttgtttcatttctgccgatggaaagttgacatgggtggggtgtccccatccagcgagagagtttcaaaagcaaaacatctctgcagtttttcccaagtgccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggaggaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatctgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacattagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttcctaattatcgctagggccaaggtgggatttgtaaagctttacagtaatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtatgtgttcattttattttcatgctttttcagccatgtatcaatattcacttgactaaaatcactcaattaatc

SEQ ID NO: 5162 - DNA, 3842 bp, Homo sapiens
actcgcctggagcgcgcgggcaaggcgggcggagcgcactggaactcaagggggcgcacagcggcgcgctcgcaccgctcggctccgcgcggctctaggaggtggcggcggtggcggtggtggcggcggtggcggcggcggcggcggcggggcgcagggctgagcgagcgtccgggctccggggctccggggaaggcggttgcagctcctgagtgcagcgcggcttcctgccactgtcccggcccggccacctctctgtcatggctctggcggacagcacacgtggattacccaacgggggcggcggcgggggcggcagtggctcctcgtcgtcctccgcggagccaccgctcttccccgacatcgtggagctgaacgtggggagccaggtgtacgtgacccggcgctgcacggtggtgtcggtgcccgactcgctgctctggcgcatgttcacgcagcagcagccgcaggagctggcccgggacagcaaaggccgcttctttctggaccgggacggcttcctcttccgctacatcctggattacctgcgggacttgcagctcgtgctgcccgactacttccccgagcgcagccggctgcagcgcgaggccgagtacttcgagctgccagagctcgtgcgccgcctcggggcgccccagcagcccggcccggggccgccgccctcgcggcgcggggtgcacaaggagggctcgctgggtgacgagctgctgccgcttggctactcggagcccgaacagcaggagggcgcctctgccggggcgccgtcgcccacgctggagctggctagccgcagtccgtccgggggcgcggcgggcccgctgctcacgccgtcccagtcgctggacggcagccggcgctcgggctacatcaccatcggctaccgcggctcctacaccatcgggcgggacgcgcaggcggacgccaagttccggcgagtggcgcgcatcaccgtttgcggaaagacgtcgctggccaaggaggtgtttggggacaccctgaacgaaagccgggaccccgaccgtcccccggagcgctacacctcgcgctattacctcaagttcaacttcctggagcaggccttcgacaagctgtccgagtcgggcttccacatggtggcgtgcagctccacgggcacctgcgcctttgccagcagcaccgaccagagcgaggacaagatctggaccagctacaccgagtacgtcttctgcagggagtgagctccccagaccccctcgccactccagcgcccttttcagctgctgctcgccagaagcccttgattccactggttgacatggcagcagttactggcaagagggagaaaggacgctgccgcctaagagtgcaaggctgctcaggtctccaagcgccgtaggaggtcacctggcagtgactgtagggagctgggtcatagtgcacgtcgtgggtattaggaaagcctgtattctttcaatgaatgtcagtaggaccttcctttagctgtaagacttggtgggcggggtggggtggggagggaggaaagggtaggaagggtgggaagggagaagcagacatagtcatttatgatttgaaagttggaaatttgtaccatctgtttgagtatatgcacatttaaaaaatatcatatagtaaatgcaaacatgccaagtattttataaagattaataacagacctactcttacctggcagtttacttaacttactgttttgagtcctaaacttagagttgttaatgcttatatataatctaaccaaagagttacccagtagggttttagtttttgaacttttattttcttgttgattataaatcctgattttggaatctattgcgcaaaagaagtttcattttggttacttagacctaagatcacttattaaaaatccttattttctccaagcccagcaaacgttgacttctgggcaaacctgaaaacctgaaaatgccactttcatgcagtttgtttgaagttaagtggaatcctttcaaatgacgagctgcagagaactcagcaccaagggctgcctatctgtagatagctgtaaaatggaatatttttaaatgaaggcaaataagtacttaaaagtgagctgagcaataaaatggtccaataataggtaaatgcaacagaaacagaaggagacctggttgccttatgcctttactcttacatggaataaattcccaatgcatatcctatgtaaaccataagtgaagggaaataaacctcgtcatgctccatgctgtgaggtgtcctttggatattctgtgatgacagagaagcctattttgttttgttttcagcatctttctctgatgtacgtttttaaggattttgtaagagctgttttcagtgtttaaattagtgctatttttccttgtttttaaaaatgaatctcgtactgtatcttactatgtccatacagatgttacaaatcgacagttttattcttagactcatgtgatccaagctgtatataccatatataaacattttacatgaatcatttagttttttaattcatttactaatgctataaaatttcctatattaccccagtaatttgcatcagctggtttatatactaaagcaacatgttttgatgagtttcttacatccttatcgaggaattgggttaggaaaaaatacataattgtaaaactgagtttgctgtattatactttttttcttgagtattagttgtattactaatcatatgttgattaactgtctacttaaagtcaaggtacctgtatttttaatccactaatttttttttagttgggaaatagatttcaggtcttttattagactaacattttttgagaagtaaaattgacttcatatacaaagcctgtaattttaggcgaaatggaagcagaaatctaggaagttgtgcttgcttgtatgttgagtttggtctcagactaagtaatgcatcagaattcatctgtttgaagcctgaaataatttaggactctgattcactgaccaaaagtcagtgttgcagagatttctctaccccgtatggtattttgttagattgttcaacaggaagcacatgattgagaacatcttgggacagaccaaaaccactgacagatggcaaggctcggcgattctgatttcccttctcaaatctgctcaactccaagagtcttgagaaactgctaaaattttgcctctgtcactcaagtcttacaaatgttatcttgtaaacctttgaggtgaactattccactgtcttgtacataggcatcttattcactgcaccctgtcacacccagcaccccccgccccgcacattatttgaaagactgggaatttaatggttagggacagtaaatctacttctttttccagggacgactgtcccctctaaagttaaagtcaatacaagaaaactgtctatttttagcctaaagtaaaggctgtgaagaaaattcattttacattgggtagacagtaaaaaacaagtaaaataacttgacatgagcacctttagatcccttcccctccatgggctttgggccacagaatgaacctttgaggcctgtaaagtggattgtaatttcctataagctgtaatagtggaggtattgtgggttcatttgagtaagccctccaaagataccattcaaataacctgggagaatgtcataaattattcagataattaacactgcatgaatctgattcagaggcatgcatttacatatgttgccctaattaccatttgatgatcataaatacaagtgaatgacattggacttttagtaacaaacttaatttttaaaaaggtgtagacaatggtggtt

SEQ ID NO: 5163 - DNA, 4112 bp, Homo sapiens
gagcatatttttaaccttggagaagaggacgaaacatacggacctggagaatcccaaatcacagcacaaagtagggaactcttgaaggattcccctcaagatttagatctctctcacacagatctaggggagagtgatgtagattgtggtagcaccagcttagtagaaaatgtgacacttttgacacaatatgattcaggagaatgcaacattgcatctaaagaggaagtggaggctcctctttctgcccaggagagcgaaatgctctataagaagttctccctgaaattcgtatcagcaagaaagaaagcagcacccagaaaaacaggggcccaggcaggaatattggacacagtctgcaatggctttcagttggttcaggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagcttgtggccaatcagaagcccccgtcggctgagttcaaagtggtaaaggcccagatacaagaacaaaagcttctccagagattgttggatgaccgaaaatctacggtggaggtaatcaaacgagaaggagaaaaaattgctacaacagcagagcccgcagataaagtgaagattttgaaacagctcagtctcttggatagcagatgggaggcattgcttaataaagctgaaacaaggaatcgtcagttggaaggtatctcggtggtagcacagcaatttcatgaaaccttagaaccactgaacgagtggcttacaaccatagaaaagaggctggtgaattgtgaacccataggaacccaagcatctaaacttgaggaacaaattgcacagcacaaagccttagaagatgacatcatcaatcacaataaacatttacaccaggctgttagcattggccagtccttaaaggttttgagctccagggaggataaagatatggtgcagagtaaattagacttctctcaagtatggtacattgagattcaagagaaaagtcacagcaggtctgagctcctccagcaggccttatgtaatgctaagatttttggggaagatgaagttgaactgatgaactggctgaatgaagtgcatgacaaactgagcaagctctcagtccaggattacagcactgaggggctatggaagcagcagtctgaacttcgggttctgcaagaggacatcttactcaggaaacaaaatgtagatcaggctttactaaatggtttagaactacttaaacaaaccacaggtgatgaagttttaataattcaagataaattggaagccattaaagcaaggtacaaagacattactaaactgagcactgatgtggccaagactctggaacaggcgctgcagcttgcaaggcggctgcactccacacacgaagagctgtgtacctggctggacaaagtggaggtggaattactttcatatgaaactcaggttctgaaaggagaagaagcaagtcaagcacaaatgagaccaaaggaactgaaaaaggaagctaagaacaacaaagccttactggactcccttaatgaagtgagcagtgctttgctggaactggtaccatggagggcaagagaaggacttgagaaaatggtagctgaggacaatgagcgctaccgattagtgagcgacaccatcactcagaaggtggaggagatcgatgcagccattctgcgatcacagcagtttgaccaagcagctgatgctgagttatcctggattactgaaacagaaaaaaaattgatgtctctgggtgacatcaggcttgagcaagaccagacttctgctcagcttcaagttcaaaagacattcaccatggagattttgagacacaaggatattattgatgaccttgttaaatctgggcataaaatcatgaccgcatgcagtgaagaggaaaagcaatcaatgaagaaaaaactggacaaggtactgaagaactatgataccatctgccagattaattcagaaaggtatctgcagctggaacgggcacagtccctggttaaccaattctgggaaacatatgaagaactttggccatggctgacagaaacacaatcaatcatctctcagcttcccgccccagcccttgaatatgaaactctaaggcagcagcaggaagaacatcggcaactgcgtgagttgatagctgaacacaagcctcatatagataagatgaacaaaactgggccacagttactggaattgagccctggggaaggcttttctatccaagagaagtatgtggcagccgacaccctttacagtcaaattaaagaagatgtcaaaaagcgtgctgtggcactggatgaagccatttctcaatcaactcagttccatgacaagatagatcagatccttgagagcctggaacgcatcgtggaacgtctgaggcagccaccctctatctctgcagaggttgagaagatcaaggaacagatcagtgaaaataagaatgtgtcagtagacatggaaaagctacagccgttgtatgaaactcttaaacagaggggagaggaaatgattgctagatctggggggactgataaagacatatctgccaaagctgttcaggataagcttaaccaaatggttttcatttgggagaacatacacacactggtggaagagagggaagccaaactactggatgtgatggagctagcagaaaagttctggtgtgatcacatgtcattgatagttaccattaaagatactcaagatttcatccgggacctggaagatcctggaattgatccttcagtagtaaaacaacagcaagaagcagcagagaccataagggaagaaatagatggactacaggaggagctggatatagttattaacctaggttctgaactcattgcggcatgtggggagcctgataaacccattgtcaagaagagtatagatgagttaaattcagcatgggattctctaaataaagcttggaaagaccggattgacaaacttgaggaggcaatgcaggctgccgttcagtaccaggatggactgcaggcggtatttgactgggtagatattgcaggtggtaaattagcttcaatgtctccaattggaacagatctcgaaactgtcaagcagcagattgaagagctaaagcaatttaagtctgaggcctatcaacagcagatagaaatggaaagactgaatcatcaagcagagcttttgctaaagaaagtaacagaagagagtgacaaacacactgttcaagacccattaatggaactgaaattgatatgggatagcctggaggagagaatcatcaacagacagcataaactggagggtgctctattagccttgggtcagttccaacatgccctggatgagctcctggcatggctgacacacaccgagggcttgctaagtgagcagaaacctgttggaggagaccctaaagccattgaaattgaacttgccaagcatcatgtgctccaaaatgatgtattagcccatcagtccacagtggaagccgttaataaagcaggaaatgatctaattgaatcaagtgcaggagaagaagcaagcaaccttcagaacaagctagaggttttaaatcaacgctggcaaaatgttttggaaaaaacagaacaaaggaagcagcagctggatggtgccttgcgccaggccaaagggttccatggcgaaattgaggatttgcagcagtggctgactgacacggagcgtcatctgttggcatctaaaccgctgggaggtttaccggaaacagccaaggagcagcttaatgtccatatggaagtctgtgctgcctttgaagctaaagaagaaacatataagagtctgatgcagaaaggccagcagatgcttgcaagatgcccaaaatctgcagagacaaatattgaccaagacat

SEQ ID NO: 5164 - DNA, 8027 bp, Homo sapiens
acgcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcagttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacggaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacccgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggccagcccaggcagtacaatgtgggtccctctgtctccaagtaccccctgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccatcgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccaacattgatcgccctaaaggactggcattcactgatgtggatgtcgattccatcaaaattgcttgggaaagcccacaggggcaagtttccaggtacagggtgacctactcgagccctgaggatggaatccatgagctattccctgcacctgatggtgaagaagacactgcagagctgcaaggcctcagaccgggttctgagtacacagtcagtgtggttgccttgcacgatgatatggagagccagcccctgattggaacccagtccacagctattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggtgttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagacgagcttccccaactggtaacccttccacaccccaatcttcatggaccagagatcttggatgttccttccacagttcaaaagacccctttcgtcacccaccctgggtatgacactggaaatggtattcagcttcctggcacttctggtcagcaacccagtgttgggcaacaaatgatctttgaggaacatggttttaggcggaccacaccgcccacaacggccacccccataaggcataggccaagaccatacccgccgaatgtaggacaagaagctctctctcagacaaccatctcatgggccccattccaggacacttctgagtacatcatttcatgtcatcctgttggcactgatgaagaacccttacagttcagggttcctggaacttctaccagtgccactctgacaggcctcaccagaggtgccacctacaacatcatagtggaggcactgaaagaccagcagaggcataaggttcgggaagaggttgttaccgtgggcaactctgtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttacgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaatgatcctagtaattgcctagaaatatctttctcttacctgttatttatcaatttttcccagtatttttatacggaaaaaattgtattgaaaacacttagtatgcagttgataagaggaatttggtataattatggtgggtgattattttttatactgtatgtgccaaagctttactactgtggaaagacaactgttttaataaaagatttacattccaca

SEQ ID NO: 5165 - DNA, 7242 bp, Homo sapiens
gcccgcgccggctgtgctgcacagggggaggagagggaaccccaggcgcgagcgggaagaggggacctgcagccacaacttctctggtcctctgcatcccttctgtccctccacccgtccccttccccaccctctggcccccaccttcttggaggcgacaacccccgggaggcattagaagggatttttcccgcaggttgcgaagggaagcaaacttggtggcaacttgcctcccggtgcgggcgtctctcccccaccgtctcaacatgcttaggggtccggggcccgggctgctgctgctggccgtccagtgcctggggacagcggtgccctccacgggagcctcgaagagcaagaggcaggctcagcaaatggttcagccccagtccccggtggctgtcagtcaaagcaagcccggttgttatgacaatggaaaacactatcagataaatcaacagtgggagcggacctacctaggcaatgcgttggtttgtacttgttatggaggaagccgaggttttaactgcgagagtaaacctgaagctgaagagacttgctttgacaagtacactgggaacacttaccgagtgggtgacacttatgagcgtcctaaagactccatgatctgggactgtacctgcatcggggctgggcgagggagaataagctgtaccatcgcaaaccgctgccatgaagggggtcagtcctacaagattggtgacacctggaggagaccacatgagactggtggttacatgttagagtgtgtgtgtcttggtaatggaaaaggagaatggacctgcaagcccatagctgagaagtgttttgatcatgctgctgggacttcctatgtggtcggagaaacgtgggagaagccctaccaaggctggatgatggtagattgtacttgcctgggagaaggcagcggacgcatcacttgcacttctagaaatagatgcaacgatcaggacacaaggacatcctatagaattggagacacctggagcaagaaggataatcgaggaaacctgctccagtgcatctgcacaggcaacggccgaggagagtggaagtgtgagaggcacacctctgtgcagaccacatcgagcggatctggccccttcaccgatgttcgtgcagctgtttaccaaccgcagcctcacccccagcctcctccctatggccactgtgtcacagacagtggtgtggtctactctgtggggatgcagtggctgaagacacaaggaaataagcaaatgctttgcacgtgcctgggcaacggagtcagctgccaagagacagctgtaacccagacttacggtggcaactcaaatggagagccatgtgtcttaccattcacctacaatggcaggacgttctactcctgcaccacagaagggcgacaggacggacatctttggtgcagcacaacttcgaattatgagcaggaccagaaatactctttctgcacagaccacactgttttggttcagactcgaggaggaaattccaatggtgccttgtgccacttccccttcctatacaacaaccacaattacactgattgcacttctgagggcagaagagacaacatgaagtggtgtgggaccacacagaactatgatgccgaccagaagtttgggttctgccccatggctgcccacgaggaaatctgcacaaccaatgaaggggtcatgtaccgcattggagatcagtgggataagcagcatgacatgggtcacatgatgaggtgcacgtgtgttgggaatggtcgtggggaatggacatgcattgcctactcgcagcttcgagatcagtgcattgttgatgacatcacttacaatgtgaacgacacattccacaagcgtcatgaagaggggcacatgctgaactgtacatgcttcggtcagggtcggggcaggtggaagtgtgatcccgtcgaccaatgccaggattcagagactgggacgttttatcaaattggagattcatgggagaagtatgtgcatggtgtcagataccagtgctactgctatggccgtggcattggggagtggcattgccaacctttacagacctatccaagctcaagtggtcctgtcgaagtatttatcactgagactccgagtcagcccaactcccaccccatccagtggaatgcaccacagccatctcacatttccaagtacattctcaggtggagacctaaaaattctgtaggccgttggaaggaagctaccataccaggccacttaaactcctacaccatcaaaggcctgaagcctggtgtggtatacgagggccagctcatcagcatccagcagtacggccaccaagaagtgactcgctttgacttcaccaccaccagcaccagcacacctgtgaccagcaacaccgtgacaggagagacgactcccttttctcctcttgtggccacttctgaatctgtgaccgaaatcacagccagtagctttgtggtctcctgggtctcagcttccgacaccgtgtcgggattccgggtggaatatgagctgagtgaggagggagatgagccacagtacctggatcttccaagcacagccacttctgtgaacatccctgacctgcttcctggccgaaaatacattgtaaatgtctatcagatatctgaggatggggagcagagtttgatcctgtctacttcacaaacaacagcgcctgatgcccctcctgacacgactgtggaccaagttgatgacacctcaattgttgttcgctggagcagaccccaggctcccatcacagggtacagaatagtctattcgccatcagtagaaggtagcagcacagaactcaaccttcctgaaactgcaaactccgtcaccctcagtgacttgcaacctggtgttcagtataacatcactatctatgctgtggaagaaaatcaagaaagtacacctgttgtcattcaacaagaaaccactggcaccccacgctcagatacagtgccctctcccagggacctgcagtttgtggaagtgacagacgtgaaggtcaccatcatgtggacaccgcctgagagtgcagtgaccggctaccgtgtggatgtgatccccgtcaacctgcctggcgagcacgggcagaggctgcccatcagcaggaacacctttgcagaagtcaccgggctgtcccctggggtcacctattacttcaaagtctttgcagtgagccatgggagggagagcaagcctctgactgctcaacagacaaccaaactggatgctcccactaacctccagtttgtcaatgaaactgattctactgtcctggtgagatggactccacctcgggcccagataacaggataccgactgaccgtgggccttacccgaagaggacagcccaggcagtacaatgtgggtccctctgtctccaagtacccactgaggaatctgcagcctgcatctgagtacaccgtatccctcgtggccataaagggcaaccaagagagccccaaagccactggagtctttaccacactgcagcctgggagctctattccaccttacaacaccgaggtgactgagaccaccattgtgatcacatggacgcctgctccaagaattggttttaagctgggtgtacgaccaagccagggaggagaggcaccacgagaagtgacttcagactcaggaagcatcgttgtgtccggcttgactccaggagtagaatacgtctacaccatccaagtcctgagagatggacaggaaagagatgcgccaattgtaaacaaagtggtgacaccattgtctccaccaacaaacttgcatctggaggcaaaccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgaaaaatgaggaagatgttgcagagttgtcaatttctccttcagacaatgcagtggtcttaacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatcactggctacaggatccgccatcatcccgagcacttcagtgggagacctcgagaagatcgggtgccccactctcggaattccatcaccctcaccaacctcactccaggcacagagtatgtggtcagcatcgttgctcttaatggcagagaggaaagtcccttattgattggccaacaatcaacagtttctgatgttccgagggacctggaagttgttgctgcgacccccaccagcctactgatcagctgggatgctcctgctgtcacagtgagatattacaggatcacttacggagagacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaaatgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaggacttatggtggccaccaaatatgaagtgagtgtctatgctcttaaggacactttgacaagcagaccagctcagggagttgtcaccactctggagaatgtcagcccaccaagaagggctcgtgtgacagatgctactgagaccaccatcaccattagctggagaaccaagactgagacgatcactggcttccaagttgatgccgttccagccaatggccagactccaatccagagaaccatcaagccagatgtcagaagctacaccatcacaggtttacaaccaggcactgactacaagatctacctgtacaccttgaatgacaatgctcggagctcccctgtggtcatcgacgcctccactgccattgatgcaccatccaacctgcgtttcctggccaccacacccaattccttgctggtatcatggcagccgccacgtgccaggattaccggctacatcatcaagtatgagaagcctgggtctcctcccagagaagtggtccctcggccccgccctggtgtcacagaggctactattactggcctggaaccgggaaccgaatatacaatttatgtcattgccctgaagaataatcagaagagcgagcccctgattggaaggaaaaagacagtcaacgaaggcttgaaccaacctacggatgactcgtgctttgacccctacacagtttcccattatgccgttggagatgagtgggaacgaatgtctgaatcaggctttaaactgttgtgccagtgcttaggctttggaagtggtcatttcagatgtgattcatctagatggtgccatgacaatggtgtgaactacaagattggagagaagtgggaccgtcagggagaaaatggccagatgatgagctgcacatgtcttgggaacggaaaaggagaattcaagtgtgaccctcatgaggcaacgtgttatgatgatgggaagacataccacgtaggagaacagtggcagaaggaatatctcggtgccatttgctcctgcacatgctttggaggccagcggggctggcgctgtgacaactgccgcagacctgggggtgaacccagtcccgaaggcactactggccagtcctacaaccagtattctcagagataccatcagagaacaaacactaatgttaattgcccaattgagtgcttcatgcctttagatgtacaggctgacagagaagattcccgagagtaaatcatctttccaatccagaggaacaagcatgtctctctgccaagatccatctaaactggagtgatgttagcagacccagcttagagttcttctttctttcttaagccctttgctctggaggaagttctccagcttcagctcaactcacagcttctccaagcatcaccctgggagtttcctgagggttttctcataaatgagggctgcacattgcctgttctgcttcgaagtattcaataccgctcagtattttaaatgaagtgattctaagatttggtttgggatcaataggaaagcatatgcagccaaccaagatgcaaatgttttgaaatgatatgaccaaaattttaagtaggaaagtcacccaaacacttctgctttcacttaagtgtctggcccgcaatactgtaggaacaagcatgatcttgttactgtgatattttaaatatccacagtactcactttttccaaacgatccaagtaattgcctagaaatatctttctcttacctgttatttatcaatttttcccagtatttttatacggaaaaaattgtattgaaaacacttagtatgcagttgataagaggaatttggtataattatggtgggtgattatttttatactgtattgccaaagctttactactgtggaaagacaactgttttaataaaagatttacattccacaa

SEQ ID NO: 5166 - DNA, 522 bp, Homo sapiens
  misc_feature (106)..(106): n is a, c, g, or t
  misc_feature (109)..(109): n is a, c, g, or t
  misc_feature (165)..(235): n is a, c, g, or t
  misc_feature (239)..(239): n is a, c, g, or t
  misc_feature (243)..(243): n is a, c, g, or t
  misc_feature (246)..(251): n is a, c, g, or t
  misc_feature (323)..(323): n is a, c, g, or t
gtgcccggatccagagtgtgaagacagaggcagaggagctgtttggggagaccatggagatgatggacaggatgaaagacatggagttggagctgctgcggggcanccnaggccatcatgctgcgctcagcggacctgacaggactggagaagcgtgtggagcannnnnnnnnnnnnnnnnnnnnnnnnnnnnnnnnnnnnnnnnnnnnnnnnnnnnnnnnnnnnnnnnnnnnnngccngttnccnnnnnnatctgccgcctttgcttttggttgggggcagattgggttggaatgctttccatctccaggagactttcatgnagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggag

SEQ ID NO: 5167 - DNA, 3106 bp, Homo sapiens
cgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcattcgcctctacggaccaaacttcatccttcagatgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggatcgtgggcggtgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcacctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagcaaaaaaaaaaaaaaaaaaaaaaaaaaaaaaa

SEQ ID NO: 5168 - DNA, 3003 bp, Homo sapiens
cgcgagctaagcaggaggcggaggcggaggcggagggcgaggggcggggagcgccgcctggagcgcggcaggtcatattgaacattccagatacctatcattactcgatgctgttgataacagcaagatggctttgaactcaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcagatgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggatcgtgggcggtgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcacctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagcaaaaaaaaaaaaaaaaaaaaaaaaaaaaaaa

SEQ ID NO: 5169 - DNA, 2916 bp, Homo sapiens
cgcgagctaagcaggaggcggaggcggaggcggagggcgaggggcggggagcgccgcctggagcgcggcaggtcatattgaacattccagatacctatcattactcgatgctgttgataacagcaagatggctttgaactcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcagatgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggatcgtgggcggtgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcacctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagcaaaaaaaaaaaaaaaaaaaaaaaaaaaaaaa

SEQ ID NO: 5170 - DNA, 492 bp, Homo sapiens
ctgagtgtcagcagccgaagcttcttttcgttccttggcgaggcttttgatggggctcgggacatgtggagagcctactctgacatgagagaagccaattacatcggctcagacaaatacttccatgctcgggggaactatgatgctgccaaaaggggacctgggggtgcctgggccgcagaagtgatcagtttattttcagctgaactgtagagagtgaaggaagaagccttttttcttcactcctacatgacccaggcattgatccaggcaatgaagattcagtgtaaataaccaccactaacaagaccatggcctttggaacctgtgctaagaggcatggatgagctccctcagcatgtggatggagactgaagagaggtctgaaggctcagtgtggtgtctccattctctaagaagtttggaggagaagctggatacagcaaaacagactgagaaggagcagctgttgggaaaggaggaaaactagga

SEQ ID NO: 5171 - DNA, 2643 bp, Homo sapiens
gggactacatttcccagggggcagaggcaggggcgggagggggcgggccccggcgctgctcccgcccctcccccgtgctcgcggggagaggtaaacaaaccacgcgcgggctgcccgcggcacggcgggcgcggctggcgcggctggggcggcaggggcggcggagagcgcgccgagccgcggccgagctggcccgcccgcccgtcgcacatgttccggaacggcgcccggccgtagccgcctgcggcgcctcctgtcggcccgagaagggagtgcggagaggcgccggtcgccacccgcggtgcccatggagcgggtgaagatgatcaacgtgcagcgtctgctggaggctgccgagtttttggagcgccgggagcgagagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggattccatgctaagcaagctaaccttatcctgcattgttagcactaggcacccagctgccacctctccatcctgctgcccttaggccacatgggagcagtccatgcatgacagcctctatcctacaaggcctatgagtatggattgggggggccaaaaggaaaaagctccatgtgcctctttgtctgcgtgggtcagaagagttgtgcacgcagattagcaggccaaggtctgagccacagcagcatttttatttcagattttgataactgtttatatgtgttgaaaaccaaaatgacatctttttaaagcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagttaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccctgtggccctctcccttaccctgggaaggcctcttggagaccttacccctggctgtttggactttgtatactttaaataatttaactacccttaattacttaaaaaaaaaaaaaagctttatgattttcataacttattgctgattttaatggattgttaatttcagtcctgtagttttattttatgtttagatagggctgggcaaggaaaaagaaaataaagacaaccatatttagcagtgca

SEQ ID NO: 5172 - DNA, 783 bp, Homo sapiens
gcccccagagggttacaattcaaacgcgggcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgatgtctggcgataaagggatttctgccttccctgaatcagacaaccttttcaaatgggtagggaccatccatggagcagctggaacagcagtggggagcatcagaaccagctcaacagtttgtctactgtccggtcccagagaaactcaagattctagcaagccccttgtgtggggcttgggttgggacatgaggctgctgctggagcttactctgcaactgtttctccaaatgccagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttaaacaaaaaaat

SEQ ID NO: 5173 - DNA, 696 bp, Homo sapiens
gcccccagagggttacaattcaaacgcgggcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatggcagtggggagcatcagaaccagctcaacagtttgtctactgtccggtcccagagaaactcaagattctagcaagccccttgtgtggggcttgggttgggacatgaggctgctgctggagcttactctgcaactgtttctccaaatgccagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttaaacaaaaaaat

SEQ ID NO: 5174 - DNA, 912 bp, Homo sapiens
atggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaa

SEQ ID NO: 5175 - DNA, 1757 bp, Homo sapiens
cattttcgagtgaaggacccggagccgaaacaccggtaggagcggggaggtgggtactacacaaccgtctccagccttggtctgagtggactgtcctgcagcgaccatgccccgtaaaggcacccagccctccactgcccggcgcagagaggaagggccgccgccgccgtcccctgacggcgccagcagcgacgcggagcctgagccgccgtccggccgcacggagagcccagccaccgccgcagagactgcaagtgaggaacttgataatagaagtttagaagagattttgaacagcattcctcctcccccgcctccagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatgtaagtgccttgattgatattaccaatttttatattagtttttaaccattaagtcaaagcccttctcttttcctagagaaacatgaagactgaagtgaaaaaaaatctctaaatattgttttgtgtgactgaatgtgttagctcatgcctgtaattccagcactttgggaggctgaggcaggaggatcacttgaggctgggagttcaagaccagcctgggcaacatggcaagaccccatctctacaaaaaaaggaattatgtggtgaacttatccaatgtgaggactatctggctgtgacacctgtcatcccgttgatcaccagggttgaatttattaaattaggcatattaattcattgaagttgactttttagtatcctgctttaagttgggagttatgagttgcagaaacgaattgctgaaatggaaactcaaaaggaaaaaattcatgaagataccaaagaaattaatgagaagagcaatatactatcaaatgaaatgaaagctaagaataaagatgtaaaagatacagaaaagaaactgaataaaattacaaaatttattgaggagaataaagaaaaatttacacagctagatttggaagatgttcaagttagagaaaagttaaaacatgccacgagtaaagccaaaaaactggagaaacaacttc

SEQ ID NO: 5176 - DNA, 1194 bp, Homo sapiens
atggatgtaaaggaccggcgacaccgctctttgaccagaggacgctgtggcaaagagtgtcgctacacaagctcctctctggacagtgaggactgccgcgtgcccacacagaaatcctacagctccagtgagactctgaaggcctatgaccatgacagcaggatgcactatggaaaccgagtcacagacctcatccaccgggagtcagatgagtttcctagacaaggaaccaacttcacccttgccgaactgggcatctgtgagccctccccacaccgaagcggctactgctccgacatggggatccttcaccagggctactcccttagcacagggtctgacgccgactccgacaccgagggagggatgtctccagaacacgccatcagactgtggggcagagggataaaatccaggcgcagttccggcctgtccagtcgtgaaaactcggcccttaccctgactgactctgacaacgaaaacaaatcagatgatgagaacgaaagtcgtcccattccacctacatcctcgcctagtctcctcccatctgctcagctgcctagctcccataatcctccaccagttagctgccagatgccattgctagacagcaacacctcccatcaaatcatggacaccaaccctgatgaggaattctcccccaattcatacctgctcagagcatgctcagggccccagcaagcctccagcagtggccctccgaaccaccacagccagtcgactctgaggccccctctcccaccccctcacaaccacacgctgtcccatcaccactcgtccgccaactccctcaacaggaactcactgaccaatcggcggagtcagatccacgccccggccccagcgcccaatgacctggccaccacaccagagtccgttcagcttcaggacagctgggtgctaaacagcaacgtgccactggagacccggcacttcctcttcaagacctcctcggggagcacacccttgttcagcagctcttccccgggataccctttgacctcaggaacggtttacacgcccccgccccgcctgctgcccaggaatactttctccaggaaggctttcaagctgaagaagccctccaaatactgcagctggaaatgtgctgccctctccgccattgccgcggccctcctcttggctattttgctggcgtatttcatagcaatg

SEQ ID NO: 5177 - DNA, 1582 bp, Homo sapiens
gatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatacttccctgtaaatagagtgattcggcttttaatcggcaccacccttccacccccaaaaaggagaaaattcatcaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatg

SEQ ID NO: 5178 - DNA, 540 bp, Homo sapiens
cccaaggaaggaggacatggagctggacggctgcagcaagtttgtgcagtacgaggtgggtgcaggagccgattctccctgcagtacgagacggacctgaccttcgtgggctgcgtaggcatgctggacccgccgcgaactgaggtggctgcctgcatcacacgctgctaccaggcgggcatccgcgtggtcatgatcacgggggataacaaaggcactgccgtggccatctgccgcaggcttggcatctttggggacacggaagacgtggcgggcaaggcctacacgggccgcgagtttgatgacctcagccccgagcagcagcgccaggcctgccgcaccgcccgctgcttcgcccgcgtggagcccgcacacaagtcccgcatcgtggagaacctgcagtcctttaacgagatcactgctatgactggcgatggagtgaacgacgcaccagccctgaagaaagcagagatcggcatcgccatgggctcaggcacggccgtggccaagtcggcggcagagatggtgctgtcagatgac

SEQ ID NO: 5179 - DNA, 611 bp, Homo sapiens
gctgagctctgttctctccagcacctcccaacccactagtgcctggttctcttgctccaccaggaacaagccaccatgtctcgccagtcaagtgtgtccttccggagcgggggcagtcgtagcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagct

SEQ ID NO: 5180 - DNA, 735 bp, Homo sapiens
ctgaagctcgacaaagagaacgccttggatcgagctgagcaagcggaggctgataagaaggcggcggaagaccggagcaagcagctggaagatgagctggtgtcactgcaaaagaaactcaagggcactgaagatgaactggacaaatactccgaggctctcaaagatgcccaggagaaactggagctggcggagaaaaaggccacagatgctgaagctgacgtagcttctctgaacagacgcatccagctggttgaggaggagttggatcgtgctcaggagcgtctggccacagctctgcagaagctggaggaggccgagaaggctgcagatgagagtgagagaggcatgaaagtcattgaaagccgagcccaaaaagatgaagaaaagatggagattcaggagatccagctgaaagaggccaagcacattgctgaagatgctgaccggaagtatgaagaggtggcccgtaagctggtcatcatcgagagcgacttggaacgtgcagaggagcgggctgagctctcagaaggcaaatgtgccgagcttgaagaagaattgaaaacggtgacgaacaacttgaagtcactggaggctcaggctgagaagtactctcagaaggaagacaaatatgaagaggagatcaaggttctctctgacaagctgaaggaggctgaaactcgggctgagtttgcagagagatcagtaaccaaattggagaaaagcattgatgac

SEQ ID NO: 5181 - DNA, 922 bp, Homo sapiens
agtgtgcagacggaacttcagccgctgcctctgttctcagcgtcagtgccgccactgcccccgccagagcccaccggccagcatgtcctctgctcacttcaaccgaggccctgcctacgggctgtcagccgaggttaagaacacagctggcccagaagtatgaccaccagcgggatcaggagctgacagagtggatcgagggggtgaccggtcgcctcatcatcaacaacttcatggacggcccccaaaacgagaatattctttgcgaaatcatcattaatctgcattctggctccatgaataacatcaatgagtcaacccatatctggcaccacctggagaacatcggctatttcttcaaggccatcgcttagtatggggagaagccccacgatatttttgaagacaacgacctgaatgataacaccaaccttacacatgtgcagcacacccttccaggccttggccatatatggacaagacaaaaggataaagttaaacttttaatcgaaatatctataaaatcaagatctcaaaactctatcccagtgaagctataaataacgttaaatcatctacggtctgcagacggatgacttccaccttctcaccccctcagtctctgaccgctcttggattcggccatcacacttaggacctactactgtgaccacaccagcttcttgaaccacgcgatcaaactctcgttaatggtcactattttgcctacactctctacagagtcggtgcccccggttaactcccttagagtcttcaacttcgcccactaacgacccttcctatcacacattctaaggttgtctacgtgctaaatgctccaaacattatgatctaatccgggagtggccctgtatcttttactatctcacagtcgcacgttagtgactcctctaagggcccc

SEQ ID NO: 5182 - DNA, 744 bp, Homo sapiens
ccagaggatgttctaccggccctccagttaccagccccctctgcagaatgccaagtggagatggggtttcaccatgttggccaggatggtctccaactcccgacctccagtgatccgcccgccttggcctcccaaagtgctgggattacaggcgtgagccaccgtccgcccggccgccatctttcaaatgatctcagaaccacgaccatgcctgcatcgcctgtcggatcatctatcggtcagacgagcaccaccctcccatcctgcccccaaaggcagacctgaccatcggcctgcacggggagtgggtgagccagcgctgtgaggtgcgccccgaagtcctcttcctcacccgccacttcatcttccatgacaacaacaacacctgggagggccactactaccactactcagacccggtgtgcaagcaccccaccttctccatctacgcccggggccgctacagccgcggcgtcctctcgtccagggtcatgggaggcaccgagttcgtgttcaaagtgaatcacatgaaggtcacccccatggatgcggccacagcctcactgctcaacgtcttcaacgggaatgagtgcggggccgagggctcctggcaggtgggcatccagcaggatgtgacccacaccaatggctgcgtggccctgggcatcaaactacctcacacggagtacgagatcttcaaaatggaacaggatgcccgggggcgctatctgctgttcaacggtc

SEQ ID NO: 5183 - DNA, 714 bp, Homo sapiens
ccagtccagatcaaacagaaatgaccattgaaggtttgcaacccactgtggagtacgtggttagtgtttatgctcagaaccggaacggagaaagccagcccctggttcaaactgcagtgaccaacattgatcgccctaaaggactggcattcactgatgtggatgtcgattccatcaaaattgcttgggaaagcccacaggggcaagtttccaggtacagggtgacctactcgagccctgaggatggaatccgggagcttttccctgcacctgatggtgaagacgacactgcagagctgcagggcctcaggccggggtctgagtacacagtcagtgtggttgccttgcacgatgatatggagagccagcccctgattggaatccagtccacagccattcctgcgcccaccaatctgaagttcagtcaggtgacacccaccagctttactgcccagtggatagcacccagtgttcagctcactggctaccgggtgcgggtgaacccgaaagagatgacaggaccaatgtaaaaatcaacctttctccagacagctcatcggtgattgtgtcaggactcatggtggccaccaaatacaagtcagtgtctatgctcttcaggaccactgacaagcacaccacctagggatcatcactctctggaaatgttaccctccaaaatggccttgtacgaccctcataacccacatcctatag

SEQ ID NO: 5184 - DNA, 718 bp, Homo sapiens
cagatccagtccggcccgcagcgcaactcggtccagtcggggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagcccaaactacaattgagaatcataaaatacggattgaaaaccagaaggagtaatgttactgttgaaagtggagagacaatgtatcaggatcctaaactgcttttgcatttaagcaatatatttaaccctaggcttcctgccagtccagttgcaaaggaatgtccagggattatcatttgaaaaaaagaaagcaaatggatgtctaaaaagaccctttcctagcattgaatttgtggaattgatctatctcataggtttttatgtatgtctcagtagggattgaactagagaccacattag

SEQ ID NO: 5185 - DNA, 740 bp, Homo sapiens
agtctggctgcagcttattgatcatcatcacggagcctggctgcagcttattgatgaagatcaatgagtcaacccagaattggcaccagctggagaacatcgacaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgcagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggtgagtgggggcccccgggacacgccgtcaaggcccaggaccctggccaccccacggcctgaccacaccacccttcgcaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacaaccccaagtactgtctga

SEQ ID NO: 5186 - DNA, 869 bp, Homo sapiens
cagctttactgcccagtggatagcacccagtgttcagctcactggctaccgggtgcgggtgaacccgaaagagaagacaggaccaatgaaagaaatcaacctttctccagacagctcatcggtgattgtgtcaggactcatggtggccactaaatacgaagtcagtgtctatgctctcaaggacacactgacaagcagaccagcccagggagtcatcactactctggagaatgttagccctccaagaagggcccgtgtgacggacgctacagagaccaccatcactattagctggagaacaaagacagagacaatcactggcttccaagtcgatgccatcccagccaatggccagaccccagttcagaggagcatcagcccggatgttagaagctacaccattacaggtttacagccaggcactgactacaagatccacctgtacactctgaacgacaatgcccggagctcgcccgtgatcatcgatgcctccaccgccatcgacgcaccatccaacctgcggttcctgaccaccacacccaactccttgctggtgtcatggcaggcgccccgtgccaggattactggctacattatcaagtatgagaagcctggatcccctcccagagaagtggtccctcggccccgccctggtgtcacggaggccaccattactggtctggagccaggaaccgagtacaccatctacgtcattgccctgaagaacaatcagaagagtgagcccctgattgggaggaagaagacagatgagcttccccaactggttacccttccacaccccaatcttcatggaccagagatcttggatgttccctccacagttcaaaagacccccttcatcaccaacc

SEQ ID NO: 5187 - DNA, 763 bp, Homo sapiens
agaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaaggtttgatgtgactggttgcagatccagtgataatgatgctcacgttgaatacagtggctccccgatgttgattctccccttgatcactgttccagagaagagaaatcactgttccagagaaaagaaagtcaccgggattagtatgtctctaagtagctatgatcaggctcagttctctcaacttcacctctccccaaatcccatgc

SEQ ID NO: 5188 - DNA, 818 bp, Homo sapiens
gtttcggtccggaatcccgggagaaagagctgaacactctgtgcagcgagttacatgttgagccatttcaggtccgtggcagcccacagggtctctggtgatctgtctggggcctgagacttagaaagcaacgttgacttgggcctgcagatggaaggcttcctcgtagggatggagctagacgaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagct

SEQ ID NO: 5189 - DNA, 2033 bp, Homo sapiens
gaattccgggactgagctcttgaagacttgggtccttggtcgcaggtggagcgacgggtctcactccattgcccaggccagagtgcgggatatttgataagaaacttcagtgaaggccgggcgcggtgctcatgcccgtaatcccagcattttcggaggccgaggcatcatggaccgatctaaagaaaactgcatttcaggacctgttaaggctacagctccagttggaggtccaaaacgtgttctcgtgactcagcaatttccttgtcagaatccattacctgtaaatagtggccaggctcagcgggtcttgtgtccttcaaattcttcccagcgcgttcctttgcaagcacaaaagcttgtctccagtcacaagccggttcagaatcagaagcagaagcaattgcaggcaaccagtgtacctcatcctgtctccaggccactgaataacacccaaaagagcaagcagcccctgccatcgcacctgaaaataatcctgaggaggaactggcatcaaaacagaaaaatgaagaatcaaaaagaggcagtggctttggaagactttgaaattggtcgccctctgggtaaaggaaagtttggtaatgtttatttggcaagagaaaagcaaagcaagtttattctggctcttaaagtgttatttaaagctcagctggagaaagccggagtggagcatcagctcagaagagaagtagaaatacagtcccaccttcggcatcctaatattcttagactgtatggttatttccatgatgctaccagagtctacctaattctggaatatgcaccacttggaacagtttatagagaacttcagaaactttcaaagtttgatgagcagagaactgctaacttatataacagaattgcaaatgccctgtcttactgtcattcgaagagagttattcatagagacattaagccagagaacttacttcttggatcagctggagagcttaaaattgcagattttgggtggtcagtacatgctccatcttccaggaggaccactctctgtggcaccctggactacctgccccctgaaatgattgaaggtcggatgcatgatgagaaggtggatctctggagccttggagttctttgctatgaatttttagttgggaagcctccttttgaggcaaacacataccaagagacctacaaaagaatatcacgggttgaattcacattccctgactttgtaacagagggagccagggacctcatttcaagactgttgaagcataatcccagccagaggccaatgctcagagaagtacttgaacacccctggatcacagcaaattcatcaaaaccatcaaattgccaaaacaaagaatcagctagcaaacagtcttaggaatcgtgcagggggagaaatccttgagccagggctgccatataacctgacaggaacatgctactgaagtttattttaccattgactgctgccctcaatctagaacgctacacaagaaatattttgtttttactcagcaggtgtgccttaacctccctattcagaaagctccacatcaataaacatgacactctgaagtgaaagtagccacgagaattgtgctacttatactggaacataatctggaggcaaggttcgactgcagtcgaaccttgcctccagattatgaaccagtataagtagcacaattctcgtggctactttcacttcagagtgtcatgtttattgatgtggagctttctgaatagggaggttaaggcacacctgctgagtaaaacaaatatttcttgtgtagcgttcttaggaatctggtgtctgtccggccccggtaggcctgttgggtttctagtcctccttaccatcatctccatatgagagtgtgaaaataggaacacgtgctctacctccatttagggatttgcttgggatacagaagaggccatgtgtctcagagctgttaagggcttatttttttaaaacattggagtcatagcatgtgtgtaaactttaaatatgcaggccttcgtggctcgag

SEQ ID NO: 5190 - DNA, 557 bp, Homo sapiens
cttgcaaccttccccccacccaacacaacaaccctcagacacaaaaacaccattgctgactgataccccaggtcttcagggttaaaggaaccgtgtgttggcagcgcaattgtgcagacgctgtaaggccaaaacgaggatttgtgttgtgaggtcggtgagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacg

SEQ ID NO: 5191 - DNA, 576 bp, Homo sapiens
agtgacatcgccggtgtttgcgggtggttgttgctctcggggccgtgtggagtaggtctggacctggactcacggctgcttggagcgtccgccatgaggagaaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggtacactgcctacatttgttcttcctaaaagtcactttggttttcctctaggtatcttgtaattgctttgttttaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagt

SEQ ID NO: 5192 - DNA, 547 bp, Homo sapiens
gggtcgtctttgctaggggctgagggtttgcaatttggggtcccgaccttcgcgccctctgctttcccgccgcactccaccccacgctctgccgtggacaggagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatt

SEQ ID NO: 5193 - DNA, 569 bp, Homo sapiens
agaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccgcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacgacattgagacagccaacagttttgctgtaacaaacgccttctgttcccagtattctagaggagtatttgccatttttggactctatgataagaggtcggtacataccttgacctcattctgcagcgccttacatatct

SEQ ID NO: 5194 - DNA, 571 bp, Homo sapiens
ctgcgggaagcccgagccggggcgggcccgagtcaaagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactctcactgtctatggcacccccaaacccaaacgcccagcgatccttacctaccacgatgtgggactcaactataagtcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaattcctctacaataattggagttggtgttggagctggagcctacatcctggcgagatatgctcttaaccacccggacactgttgaaggtcttgtcc

SEQ ID NO: 5195 - DNA, 547 bp, Homo sapiens
gttcgcatctgcctcggatggtgggagatttttctttccaagaccttttcatcgccttgcagggtcgatttccccccctcgtccccccaactacaaaagagcacgactcgctttgatgtctcgccgcaagcaagcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactg

SEQ ID NO: 5196 - DNA, 590 bp, Homo sapiens
gatttcctcagtgattacgtacagagcgagtccctgcgggttaggggccccctctggagccatcctgatggctttgggggccttgcttccattttccattattatgtggactaccggagcgacagcgcagtccaagaccttgcagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagggtgacgcacattccttggagagcctgccttgatgaaaacctattcactccgtatcaaaagtcttgaaactgagccaaggccaaacgaagcctttggagatgaaggtcaaatacagaagaacaagatgatcaattctagacccagatttgaaagtcagctataagattatgtgccaggtaaaataatgattagctgtccacgtggactgaaattttagacagtggatcctgcagggataaagaaaatgcgagctcacacacacct

SEQ ID NO: 5197 - DNA, 575 bp, Homo sapiens
gaaccagcctaaaaacaactttaagtagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcggctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcct

SEQ ID NO: 5198 - DNA, 558 bp, Homo sapiens
aagtgaaggtggaagcggccgcggcggcagcaggccaccatggcggagctgcaggaggtgcagatcacagaggagaagccactgttgccaggacagacgcctgaggcggccaagccactgtttcagttcgaggacatgcaggaaatcattcagaactttgtgcgtttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggata

SEQ ID NO: 5199 - DNA, 551 bp, Homo sapiens
  misc_feature (166)..(166): n is a, c, g, or t
gggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaacntgcagctgcaatcccgacaaatgcaagattattatctgatcattccaaaccaactgctgaaacggtagcacccgacaacactgcaatccccagtttaagggctgaagctgaagaaaatgaaaaagaaacagcagtatccacaaagacgattcccaccataaggctgaaaaatcatcagtactaaagtcaaaagaggaaagccattaacagtcagcagaacagggcaagagttctagccaagagctgggattgaaggatcaagaggacagtgatggtcacttaagtgtgaatttggagtatgcaacatgaaaatgaaaatataggtaccactgagcctggagagcaccaagaggccaagaaagcagagaactcatcaaatgaggag

SEQ ID NO: 5200 - DNA, 560 bp, Homo sapiens
acccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgccgagacctgaactttgagcgtggaggtgatatcaccctcaggtgtcctgtgatgctggtggtaggagaccaagcacctcatgaagatgcagtgatggctgactccggaggtcagccccagctgactcagccaggcaagctgaccgaggccttcaagtacttcctgcaaggcatgggctatatggcctcatcc

SEQ ID NO: 5201 - DNA, 564 bp, Homo sapiens
gtgtgctggaccgcggggaccctggcgtccctgcttagaacccacgcagcgtctcggaccggctaggggtacaccaaagcggacaaaagccactgaggggaaggatcacatttgaaatcataggactgaaaattatgaagcagaaacatttgtccttggtgtttctgaaatatgtgaaccaaaccccaatgcctgcacttttactctcacaaacttctgacatgaggaacagatttttacaaaatagcttaaatggttttgaaccaaagaagctgtattcccttaaaaagacggacaacccatcgtgtgaactatagagtttgtgaacaaatttatattgggttcatagtggcgtcatgcacgcagactcctgcgagttcccctaagttcttagaggactgctttgccttttgatctgagagttgcaaatttccctaaagaatggcccttgtggataagcgctaagtcaagagacagtgattggacagaatttgtgaggaattcgcccccagatcatgaaagtcaccctgaaccccgcctcgtggtggctctgctggatggacg

SEQ ID NO: 5202 - DNA, 573 bp, Homo sapiens
aggtgctgcagctgaggagatgggagcacagtctcaaatccatctcactaactgacttaaactaggggtttacatagcaagggaaaaatgtaacaatgtgtaagaaaataagaactaggtaggggtaaggaaacaatcatggtgaataagcggtcaggcatctgctgcagtgatctgatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagc

SEQ ID NO: 5203 - DNA, 577 bp, Homo sapiens
ttcatccttcgctctcctttaaaatgagacagttgtcagcaggaatcctgcgcaagaacacaccaccctgtttcatagaagatatctcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaac

SEQ ID NO: 5204 - DNA, 498 bp, Homo sapiens
tgagcatctggcatattggcagatacagttcaacaatatagctgctgtcacagtattttttgtctggattaagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcacccaggtcgatgacttcagtactttccaagagtgtataatatgtttttggctatcatcaatgatacttactctgaagtgaaatctgacttggcacagcagaaagctgaaatggaactctcagatcttatcagaaagggctaccataaagctttggtcaaactaaaactgaaaaaaaataccgtggatgacatttcagagagtctgcggcaaggaggaggcaagttaaactttgacgaacttcgacaagatctcaaagggtgagaatcatgcttcctgagg

SEQ ID NO: 5205 - DNA, 548 bp, Homo sapiens
acaggacagaggttggcttggaaagaccaaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaattgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagct

SEQ ID NO: 5206 - DNA, 574 bp, Homo sapiens
agtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaac

SEQ ID NO: 5207 - DNA, 458 bp, Homo sapiens
gatcgcgttccgggacacacaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaaggagtgcatcatcgacgaggactgtgggcccagcatgtactgccagtttgccagcttcca

SEQ ID NO: 5208 - DNA, 575 bp, Homo sapiens
  misc_feature (153)..(153): n is a, c, g, or t
tgctctggcgagggctccagcatcacagatggaggcagaagaagctgctgctaaagcatcatcagaagtgaacctggcaaacttacctcccagctatcacaatgagaccaacacagacacgaaggttggaaataataccatccatgtgcaccngagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacc

SEQ ID NO: 5209 - DNA, 576 bp, Homo sapiens
aacatgagtggaagaggagatggagggcagcagcagctgctgcactcaaagtttttggctggagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcggctctgcctgcagtcaagaacagccctttaaattcagctatggagagaagtgcctgtacaatgtcagtgcctatgatcagaagccacgagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttc

SEQ ID NO: 5210 - DNA, 579 bp, Homo sapiens
gatgatgcgtctttggttaatgcctcaatttccagctctgtgaaagctacttcttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccgggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaaactcactgtcagagcactcccctcaaaaaacaccaaggtgtttcaaaaactcagtcacttccagtaacagaaaaggtgaccgaaaaccagataccagccaaaaattccagtacagac

SEQ ID NO: 5211 - DNA, 576 bp, Homo sapiens
ggatagcgtggagtgacggtgccaccgcggcgcatgccctgtacagacttttggggaactgggtactgatgaacccgaacaggagttgcttctggttttaattctactactactggtgcatgatttacagctaaaccagagaggagtctgcaatgccgagtggaggaaggaggaaccggagtgtgagcagtagctgggtgggcaccatggctgggatcaccaccatcgaggcagtgaagcgcaagatccaggttctgcggcaccaggcagatgatgcagaggagtgagctgagcacctccagtgaaaagctgctgatgagagtgagagagatacaaaggttattgaaatctgggccttaaaagatgaagaagatggaactccaggaaatccaactcaaagaagctaagcacattgcagatgaggcagatgggaagtatgaagaggtggcttgtaagttggtgatcattgaaggagacatgggatgcacagaggaacgagctgagctggcagagtcccgttgctgagagatggatgagcagatcagactgatggaccagaacctgaagtgtctgagt

SEQ ID NO: 5212 - DNA, 595 bp, Homo sapiens
aatgttgaacttgcggagtttattcagagttgggaggaagggtcttgggaggaagggaggcattgggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcc

SEQ ID NO: 5213 - DNA, 586 bp, Homo sapiens
agagcctggaagcgtccagccgcccgcccctcgccccccggccccagcacaaccctttcctgagcggcagtctgggcgggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaacc

SEQ ID NO: 5214 - DNA, 562 bp, Homo sapiens
tagaagcccagtcttcaaaatgagcttacctttcagtgatttggataagagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagattt

SEQ ID NO: 5215 - DNA, 565 bp, Homo sapiens
agccagagatggagtccctgccagtgcagagctcttgacttctgccccatctcacttgcccggaatggaacctcttgcaccaagccctagaatttggacttgtgttttctattttggcattgaatctgaggaggatttgtcttcagcgaagctggaagtttgcagattccttaaatgaatttaaatttcagtgcataggagatgcagaaacagatgatgagatgtgtatagcaaggtctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttga

SEQ ID NO: 5216 - DNA, 556 bp, Homo sapiens
  misc_feature (156)..(156): n is a, c, g, or t
agtctctgcttcctcctccccaggttggcacacgaggggctgatggctcacgtcacaaagatggagtggatgttgaagatgatccgacttgctcttggccagcttcctcaccttctagcaaggatcagacttcccctagccatggagaaggttgcngattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggagg

SEQ ID NO: 5217 - DNA, 631 bp, Homo sapiens
aatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggagttggagaggcatagactagatatggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatcca

SEQ ID NO: 5218 - DNA, 469 bp, Homo sapiens
tcgttgatcgccattgctagttttgcacacgtttgcgaatcagagctgcccggggtacaccgaccgcgcagggaaacatcgagagtgtaaataaatacatcgcctcttgttcggatttttgctactaccgaaaatatgtaaattgtgaactctgttggctctctttggatccaggttgatagaagtccagatcctgaggaaatctccagctaaatgctcaaaatataaaaactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtt

SEQ ID NO: 5219 - DNA, 594 bp, Homo sapiens
atgcccctctgtctgtgtgtgagtgcaggcaggctgacaatgatttcctcagtgattacgtacagagcgagtccctgcgggttaggggccccctctggagccatcctgatggctttgggggccttgcttccattttccattattatgtggactaccggagcgacagcgcagtccaagaccttgcaggatgtctcgccgcaagcaagcgaaaccgagatccctcaaagagtatttccatatcctttaaaaaccactgtagttatccttactgacagcagtgacgtctaacagtgatgacagaatttttcaactttttgcttccgaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaagg

SEQ ID NO: 5220 - DNA, 580 bp, Homo sapiens
aagtgctgatgatgcgtctttggttaatgcctcaatttccagctctgtggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccaaaggttgagcaga

SEQ ID NO: 5221 - DNA, 607 bp, Homo sapiens
aatttccagctctgtgaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccactattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggtttcactgaatgcgaaatgacgaaatctagccctttgaaaataacattgtttttagaagaggacaaat

SEQ ID NO: 5222 - DNA, 564 bp, Homo sapiens
gtcctacccatcccttcccgatggcgcttgccttcgcgggccgtcgggggagaacgggagaagattgtgggaccgctctcctctccctttctccactcgtgggacctacacggagactgagtagaggagagaagcgacggcaccaatctttgtaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccc

SEQ ID NO: 5223 - DNA, 566 bp, Homo sapiens
aggctctccagattcccgggctgtttgctgcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcacta

SEQ ID NO: 5224 - DNA, 491 bp, Homo sapiens
tgacatttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgtaaaattattttcataattgattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttca

SEQ ID NO: 5225 - DNA, 568 bp, Homo sapiens
aaacgacaggatccagagacactctcagtcttggaaatcctaccaacaaggattcagccatccgggcatagccacaagaccttgtgacattaccaaggaccttgactgtccaccacagatcccctgtccacatataaaactccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaat

SEQ ID NO: 5226 - DNA, 494 bp, Homo sapiens
gtgcgtggggaggtgtgtgtgctgagatcgtgagtggaggcgtgtgtgagaggtcgcgcaggtgctgggggagagtgtgaacatggttacgcctcttcattcccgtccatgccgagcccccgactgcagcattcaaagcccccgcggaggttgagccgggcacagaaacacagcagcgggagcagcaacaccagcactgccaacagatctacacacaatgagctggaaaagaatcggtgagtcagtgatgagtcactttaataggctccagtgatcactggatggagtgagccatataccaggaggaaagagcacactgctcttacacaaaacaaggagcacagcttagctcatctaaaatatttgtctataaacaatctgaagagaaagtagctacagacgagctcatctgcgcctttgtttagaacgcttaaaagttctgattccactaggaccagactgcacccggcacacaacacttggtttgctcaaca

SEQ ID NO: 5227 - DNA, 590 bp, Homo sapiens
aggtcgggacgcagcaaagagaggagagaccccagagtcagaaggagtgagaaccctgacccctaatcccactgcatccagccaataggagcccagtaagtgaccccaccccgcaggctgcaggctccttcctgtgcaggccgccatggcaggagcctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctgg

SEQ ID NO: 5228 - DNA, 573 bp, Homo sapiens
aaaaaaaaaaaaaactgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagacaaatgcaagattattatctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgg

SEQ ID NO: 5229 - DNA, 551 bp, Homo sapiens
aagtgaaggtggaagcggccgcggcggcagcaggccaccatggcggagctgcaggaggtgcagatcgcagaggagaagccactgttgccaggacagacgcctgaggcggccaagtttgtctctccatctgggacgccacatggtcatgtgtttctgtgtgaatccgtgtgtgtctctccaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggag

SEQ ID NO: 5230 - DNA, 582 bp, Homo sapiens
agtagacttgaatgtgcctctgggcaaagaagcagagctaacgaggaaagggatttaaagagtttttcttgggtgtttgtcaaacttttattccctgtctgtgtgcagaggggattcaacttcaatttttctgcagtggctctgagtccagccccttacttaaaggccataagatgttttattgaaagaaactttcaatatcaagtaatccaaccaaccttctaagataagccttttccttcaacacaaagaagtgcattttgccaaatctggaaagcatgaagactgggctttttttcctatgtctcttgggaactgcagctgcaatcccgtttttaattttttcagacaaatgcaagattattatctgatcattccaaaccaactgctgaaacggtagcacccgacaacactgcaatccccagtttaagggctgaagatgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctggga

SEQ ID NO: 5231 - DNA, 526 bp, Homo sapiens
atacagaaccttcccactgctgcagagagttctattggatgatgctgcgtctctgacagactctgatgaggcttgctggttctgacattccttctggctaaaactgactcctgatactcaaaagcaaggttcccctggtttcatagaaaacaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctact

SEQ ID NO: 5232 - DNA, 552 bp, Homo sapiens
agacttgaatatgcctctgggcaaagaagcagagctaacgaggaaagggatttaaagagtttttcttgggtgtttgtcaaactttattccctgtctgtgtgcagaggggattcaacttcaatttttctgcagtggctctgggtccagccccttacttaaagatctggaaagcatgaagactgggctttttttcctatgtctcttgggaactgcagctgcaatcccgacaaatgcaagattattatctgatcattccaaaccaactgctgaaacggtagcacccgacaacactgcaatccccagtttaagggctgaagatgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaaggaaaccaagagcaggatccaaatatttccaatggagaagaggaagaagaaaaagagccaggtgaagttggtacccacaa

SEQ ID NO: 5233 - DNA, 591 bp, Homo sapiens
agggtgagaaaaaggcagggtgccgggtggagggagtgcccgcctctgctccgtgtggacagtctagcccggagcgggtgggagcgtcgccctgcctggcgccgggtctctgcggttcggaagtgcagctctctctcttccgttcttcgtggtcagcctgggtcacacttattttatttttggaagctcgggctgacccagcgcaggaagaaagtcatcaagcggtcgcgatcattttccattacctgaaagagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagtcatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcact

SEQ ID NO: 5234 - DNA, 554 bp, Homo sapiens
agcaaagagaggagaggtaccaggactctgggcacgagggagtcggaactcctgcgccctcgacgttcccccgtgccccctttcggcgccagcacacctgcccctgccagccggcgagacccccgcctcctcagcggcggtcccgcccacctcctcctttcttaatctagttctctgtgttcgggcggggggagtcgaactcgtggggtgtcagtatcccggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcacttccactgtctatggcacccccaaacccaaacgcccagcgatccttacctaccacgatgtgggactcaactataaatcttgcttccagccactgtttcagttcgagg

SEQ ID NO: 5235 - DNA, 570 bp, Homo sapiens
aaaaggcaagtgaaggtggcagcgaccgcggcggctgcagcaggccaccatggcagaacttcaggaggtgcagatcaccgaggagaagccgctgttgccaggacaaacacccgagactgccaagactcactctgtggagacaccttatggctcggtcacttttactgtgtatggcacccccaaacccaaacgcccggcaatattcacctaccatgatgtaggcctcaactataagtcttgcttccagccactgtttcggttcggggatatgcaagagatcatacagaacttcgtgcgggttcatgtggatgcccctggcatggaagagggggcgcctgtgtttcctctgggatatcagtacccatctctggaccagcttgctgacatgattccttgcatcctgcagtacctaaatttctctacaataattggagttggtgttggagccggagcctacattctgtcgcgatatgctctgaaccacccggacacagttgaaggtcttgttctcatcaacattgatcccaatgccaagggctggatggactgggcagcccacaagttaactgg

SEQ ID NO: 5236 - DNA, 541 bp, Homo sapiens
tttgatatctggcgcaaaaaatacatgcgatggatgaatcacaagaaatctcgagtgatggacttcttcaggagaattgataaagaccaggatgggaaaataacgcggcaggaatttattgatggaattctttcctcaaagtttccaaccagtcgcttggagatgagcgcagttgcagacatctttgacagagatggcgatggatatattgactactatgaatttgtagcagcccttcacccaaataaagatgcatataaacctatcacagatgccgacaaaatcgaagatgaggtgacaaggcaggtagctaagtgtaaatgtgcaaagcgatttcaagttgagcagattggtgataataaatacaggttcttcctgggaaatcagtttggagactcccagcaactgcgactggtccggatcctgcggagtactgtgatggttcgtgttggaggtggatggatggcacttgatgagttcttagtgaaaaatgatccttgcagggttcatcatcatgggagtaaaatgttacgttcggaat

SEQ ID NO: 5237 - DNA, 557 bp, Homo sapiens
gttttttcaaaccggagctgtgggcgcggcgctgctctgccgttgggtgaggcgcggagcgaagtgaagggtggcccaggtggggccaggctgactgaagattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgaga

SEQ ID NO: 5238 - DNA, 567 bp, Homo sapiens
aaatctttgctgcagcgaggaccggagtcccccgcgcgcagcccagtggcagaagagggctaggctgagagggaagccaggactgtaggagagggaggcagcccgtcctcctcacgaacctgcaaggatgctggcaggggcctgggggcatggggaggtacttaaccccccggagcccccgattggggcttgcagacctggcccgtgggcggattttctgcctagcgcagccgagaagcagaggtgccaggaaaaccaagagaggggcgctgggggtgcccatccccagagtcggtccctctgcgaaccgaggaagaaaagaggagggagtcagcgagtggtcagaagggaaaacctgacaccagactggctccggagcgtccgggagactggggcgctccgcgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagccttttccgag

SEQ ID NO: 5239 - DNA, 550 bp, Homo sapiens
  misc_feature (147)..(147): n is a, c, g, or t
ttttgagccgtaagtgtaaggcattttggtggtattattacaatggttatgaggagtttctttgcttgcccaaggtcacatagctagcaagttaaagtagattcaaatccaggcctgctagataccaaattattatttaagagtacnttttcactactcctaaataatgacacagacctattcacttcattaaatctagaggcagttgagcatgggagccgtctgtatgttgaattagggctcgcactcttgcgcaacacgtcaccagtcggaaactgggggtttgcttctgtgatttatttcattattgtgctggtaaaagctgatgaagagactagcagctcgctgctttgctggcttgttaattttatccccactaactgtgatttctgatagccggcctgctgatagtggtaaggccatcgaagacggcaatttggaggaaatggaagaggaagtacggcttaagaagcgaaaaagacgaagaaatgtggataaagatcctgcaaaagaagatgtggaaaaagctaagaagagaagaggccgccct

SEQ ID NO: 5240 - DNA, 589 bp, Homo sapiens
aaaaatcgcgcccgctccgacgtgtccaggtccgcggccccgggagcttggcgcggcccggcctggatgcgctgggcggagggtgcaggggagggcacggcgccgcttgcttggcctgcgcacccggacctagaagccgggacgagccggggcagagccaggcgcgcggaagtctgaaggtgccctccagacacggccccgatgactgaactacagcaagatgtggaagacacaaagcctgcgaaagtgctcgggaagagggagagcaaacttggctcagcccaacaatcttgagggccagcacagcctgaggacttgctgacacaaagtattgacgggccagaggaagtgggcagcctggatatcacatcaccccatgtctgctgctgctcaggtttctctcactgtctcttggctcagaggctgagaatggtgtggaggagaaaaagaaagcctgcaggtcgccaacagcccaatcccctaccccatctgtggaggcggactccccagaccagaagaaaatcattagcctatggtcaaaatccagttttgatggtgcctctttagcaagtgataagaacgactgtaa

SEQ ID NO: 5241 - DNA, 551 bp, Homo sapiens
cttgaaacccgagccatctcaccgctcgcccccaaccctgggctctggctgtttaaaagctggagaggaagtgaaagcgtcaagtacagttgatagaagtccagatcctgaggaaatctccagctaaatgctcaaaatataaaaacttgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatc

SEQ ID NO: 5242 - DNA, 573 bp, Homo sapiens
aacatttttgaaagatcactcagctttaacacaccttggctgggtctggataaaaaaaaagtgagcactgcaaatttctagaagaaaacatcaggagaagaaagagagagggggatttattcaaagttgtttccaattccttcaaaacctcaaaccaggtggctatggtatggatgtagccaagaaaaacaaacgagatggaactgaagtcactgagagaattgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaaggtccaggactggaactctgggaagccatgtgttggaaaaattggtgagaaagagactaaacacagtgacaagt

SEQ ID NO: 5243 - DNA, 570 bp, Homo sapiens
cttcctgaagctgcaatttcctcggaacaatgagcttgcagaggtttgctgcaatccgaacttgaggagggggtggagtctgttcagttctgtttctccttgccgaagtgtggtctttggagctaagtgaagaatgacttctgttaggttttcctctgctggtcttccttgcagcctcgaaaacctcaccagagtcgcctctgctggtctcttactgtgctgctctgtcagagatgggcaagcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttt

SEQ ID NO: 5244 - DNA, 566 bp, Homo sapiens
attttcgagtgaaggacccggagccgaaacaccggtaggagcggggagcaatgaccaatgaagctggagctcctcggcttatgataactcatattgtaaaccagaacttcaaatcctatgctggggagaaaattctgggacctttccataagcgcttttcctgtattatcgggccaaatggcagtggcaaatccaatgttattgattctatgctttttgtgtttggctatcgagcacaaaaaataagatctaaaaaactctcagtattaatacataattctgatgaacacaaggacattcagagttgtacagtagaagttcattttcaaaagataattgataaggaaggggatgattatgaagtcattcctaacagtaatttctatgtatccagaacggcctgcagagataatacttctgtctatcacataagtggaaagaaaaagacatttaaagatgttggaaatcttcttcgaagccatggaattgacttggaccataatagatttttaattttacagggtgaagttgaacaaattgctatgatgaaaccaaaaggccagact

SEQ ID NO: 5245 - DNA, 579 bp, Homo sapiens
agtgccgagcctgggtgccctttgttgagccctgtctgttgtgctgtgataccagcctgttggagcagaaatctaccagcctgggctaagtctcagccatgtggagcaggctttcactgctttggaatataaacgtttagacaagaaattcaaagggataggaatatttgttggatttcccctccactcagctgggaagtcagctctagcaaagtgattgtgagatatgtggcaccaagccgagtccctcctgactttcaggggatggatctcaagacagtggcctagggagggtgctagtctgaggctgccaagacatgacgaaccaaagatgttctcagcaggtcgttcctcagaaatgcactccctgcatctcccccagggtgctcagacatggaatattaaagtgttagaaacgattggaggggatgcagccccactcctcactttacagaagagcaatggaggcccagagggaaatgccttgtcccagctcacaggacagtttagagatcctgaccgccaccattgaaaacaaccgggtcatcctggagattgacaatgccaggctggctgtgg

SEQ ID NO: 5246 - DNA, 578 bp, Homo sapiens
tcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccagcagccagcaggctccctgctgcttcctagcctctctgggtggacagggccatctgagacaccccagctggccttggatgctgtgatacaatccggtctatgtcaggacatctaatcacacccctgctccaatctcagcttccacccctggatctggcctgaacccaccaagaatgaagtctgccagcagggaatagtgaagccatgcagtgctccgtcatgctgggccttcctattcacttcaccttgaagcctcgcatcagtctcacttcccagatgagtcagggaggttgagtaatgaagccatactgcaccatcaaggcaggaagtgaacacatgcctacctcactcaaagcccatgctccttctgcagccctaagtgaaaatgccaaccttccccacccagatgccaagt

SEQ ID NO: 5247 - DNA, 567 bp, Homo sapiens
agctaagtcagtcctggctcctgagctgctgctgtgaagggaggacctggtgggctaggtaaccgggagctcccccagaaagtcactggaggttgctcaggacttccccacctttactgagtgcttttgaagaagtaggacctgccctgctccgctacagaactactggacaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtg

SEQ ID NO: 5248 - DNA, 563 bp, Homo sapiens
ataaattactgaaaagatcattgaagaagaaattctgaaaatcacaggaaaccagtagcccatttttaagatatttatatattactgttgtattaaaggcggacaacttttcaggaggagtttaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggc

SEQ ID NO: 5249 - DNA, 592 bp, Homo sapiens
agcatactcaagccccttgccatgtaatatccagtgccaccacaggactctgcagagaactcccactaggaagaaggccctcaccagatgaggcccctccacctggaatttctcagcctccacagtgtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatg

SEQ ID NO: 5250 - DNA, 567 bp, Homo sapiens
aaaagcgggaactgtgtggcattacactgagcatctatatgctttgtgtttctgtgccacagagaagagaaatgaactgtggcatcgctcctgccttctgaacagctctactccgattaaaaaaaaaaaatctcactgtgttctttgtaaaatggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatgg

SEQ ID NO: 5251 - DNA, 579 bp, Homo sapiens
gcttgaaccgctggagcccccgagggacgcgggggttcagagagcaagaggaaggaaccagactgacagggtcgccagaggcagtcccagcacaaaggttctccttactatgacaatgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagc

SEQ ID NO: 5252 - DNA, 559 bp, Homo sapiens
aagtgaaggtggaagcggccgcggcggcagcaggccaccatggcggagctgcaggaggtgcagatcacagaggagaagccactgttgccaggacagacgcctgaggcggccaaggaggctgagttagctgcccgaatcctcctggaccagggacagactcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcggcccacaag

SEQ ID NO: 5253 - DNA, 579 bp, Homo sapiens
acgtatttccggagtcccttccgagacagaaggttgtgttggggaactgaagcagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtggaggtggtagctagtgactgctggagtctgctgctcgagttcctacagagtttttctaggcagcccacacaccagggg

SEQ ID NO: 5254 - DNA, 583 bp, Homo sapiens
cacttcagacccccactagttgacagagcagcagaatttcaactccagtagacttgaacgtgcctctgggcaaagaagcagagctaactgaggaaagggatttaaagagtttttcttgggtgtttgtcaaacttttattccctgtctgtgtgcagaggggattcaacttcaatttttctgcagtggctctgagtccagccccttacttaaagacagaattgcccagggatcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatgg

SEQ ID NO: 5255 - DNA, 478 bp, Homo sapiens
  misc_feature (160)..(160): n is a, c, g, or t
atgcattctatccttaggaggatagaacatctcgttgtataatgtgatattagtgcggttattttggcataaagggctctttttgatgatttggtcattggctgggatgtgtccgtggatggtggtggtggtgctgtctggattttgaagaaggggcacntgagtctgaggctgtctgttccctctcacacctccagcaactcgaaccgtaccagtcacaggtgggggcttcgagaaggagaaggtgtgtgcacaatggtgcacggtgaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgcccca

SEQ ID NO: 5256 - DNA, 775 bp, Homo sapiens
  misc_feature (682)..(682): n is a, c, g, or t
  misc_feature (765)..(765): n is a, c, g, or t
  misc_feature (770)..(770): n is a, c, g, or t
agcaggtagggggaggggcaggcgaggggccgtagggcctggaaggcgccagccgggccggcgggcggtgtgattgatccgcgtcccctggagctggaggctcgggggaaagggccagcacggagcgggcgctcggttgctgcgcacaaaggctgaggctccaagagctgcagggcgtgtttggggccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccctctggaccagcttgcagacatgatcccttgcgtcctgcagtacctaaatttctctacaataattggagttggtgttggagctggagcctacatcctggcgagatatgctcttaaccacccggacactgttgaangtcttgtcctcatcaacattgatcccaatgccaagggttggatggattgggcaagcccacaagctaacaggccttaccttttncattncggaa

SEQ ID NO: 5257 - DNA, 852 bp, Homo sapiens
  misc_feature (646)..(646): n is a, c, g, or t
  misc_feature (680)..(680): n is a, c, g, or t
  misc_feature (704)..(704): n is a, c, g, or t
  misc_feature (803)..(803): n is a, c, g, or t
  misc_feature (812)..(812): n is a, c, g, or t
  misc_feature (822)..(822): n is a, c, g, or t
agccatttggacagaagccctaaatggcccagaggcacagccatttagaactcttttctttttttttttttttttttcagtagaatattttgacccccagaggtatgcgtagctatatcggggatccaaaggtttcacacaggatgagtcctgtgtctacatgcagcgtagcaggagctgggaatggaagcaaaccaatattccagcatctgcttctagaacagtgatcaggatcgctatcgttaataagatgggtgtatgtgggacccaagactcatctgtcaagcccttcttctgactgcttttaaggtgccagtcacgaattgcccgaacattacctgctgatcagaagccagaatgtcggccatactgggaaaaggatgatgcttcgatgcctctgccgtttgacctcacagacatcgtttcagaactcagaggtcagcttctggaagcaaaaccctagaaggagcacaagtctcaggcggaggagaaaaagagatcggcttttctcctccaacgttgtcatgggcttaagcaagagcagtggagacttctcttggcccctagattgtagcacccgggtcccaatccaaaacagctaggaaatggtgcccatgaagttttaaatgttttaaaatgaccctgngttatagtctgatttggtgttaaacaggaccttnttccccaaaattggtcagattatnaaatgtgagccattcagcccccaaggtccagggcaggcgacaggaacgagcccacgtgtgacaaagcctaacctactttcctctttccaaagctttttnaaaaacttntggagtgggncccagcccttttggggaaagaccgaacttt

SEQ ID NO: 5258 - DNA, 799 bp, Homo sapiens
  misc_feature (754)..(754): n is a, c, g, or t
  misc_feature (757)..(757): n is a, c, g, or t
  misc_feature (777)..(777): n is a, c, g, or t
attacaggatcacttacggagaaacaggaggaaatagccctgtccaggagttcactgtgcctgggagcaagtctacagctaccatcagcggccttaaacctggagttgattataccatcactgtgtatgctgtcactggccgtggagacagccccgcaagcagcaagccaatttccattaattaccgaacagaaattgacaaaccatcccagatgcaagtgaccgatgttcaggacaacagcattagtgtcaagtggctgccttcaagttcccctgttactggttacagagtaaccaccactcccaaaaatggaccaggaccaacaaaaactaaaactgcaggtccagatcaaacagaagtgactattgaaggcttgcagcccacagtggagtatgtggttagtgtctatgctcagaatccaagcggagagagtcagcctctggttcagactgcagtaaccactattcctgcaccaactgacctgaagttcactcaggtcacacccacaagcctgagcgcccagtggacaccacccaatgttcagctcactggatatcgagtgcgggtgacccccaaggagaagaccggaccaatgaaagaaatcaaccttgctcctgacagctcatccgtggttgtatcaagacttatggtggccaccaaatatgaagtgagtgtctatgctcttaaaggacactttgacaagcagaccaacttaaggtggtgtcaccctctggagaatgtcagccccccaanaanggcttgtgtgacagatgctncttgagaccaccatcaccatta

SEQ ID NO: 5259 - DNA, 530 bp, Homo sapiens
agtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagaggg

SEQ ID NO: 5260 - DNA, 571 bp, Homo sapiens
attatgtttttattctttgctgcagctatgttttctgtcagcttgtcttctctgtttggctatcattgttggctagtcagcaaaaataaatctacattagaggcattcagaagtccagtatttcgacatggaacagataagaatggattcagcttgggtttcagtaaaaacatgcgacaagtttttggtgatgagaagaagtactggttgctacccattttttcaagtctaggtgatggctgctcctttccaacttgccttgttaaccaggatcctgaacaagcatctactcctgcagggctgaattccacagctaaaaagtatgagcaatcctgcattaaccatggaaaatgagacttaactcttcaagcaagataaattcatactttataaaagtatcaatgctgtagatggatggaagaggcttcccacaggaaggtgccaccagtcagttgtgcctatgtccctttggctggaaatgcagaatatgaattgattagttctctccaagccattgcttaaaatataacatgttttggatccaatacacacattgttacaactaacacaa

SEQ ID NO: 5261 - DNA, 567 bp, Homo sapiens
acagtcctcggcccaggccaagcaagcttctatctgcacctgctctcaatcctgctctcaccatgagcctccgcctgcagagctcctctgccagctatggaggtggtttcgggggtggctcttgccagctgggaggaggcctgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccctggaggaggccaacgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgcggacgacttcaggctcaagtatgagaatgagctggccctgcgccagagcgtggaggccgacatcaacggcctgcgccgggtgctgga

SEQ ID NO: 5262 - DNA, 568 bp, Homo sapiens
aactgggcagacagcacccaagggtagaagatgggggcccaggagggagctgcaccctggtgggcagccatgggagtgtgtcaggtggaagcagccgtcagggtccctctctgctctctgtccggacagacagggctccaaccttcacttcagttcttgtgaactcccaccaggtaggcactggcccccaccaggctgccatggactggaagacactccaggccctactgagcgttgtgaacaagtactccacagcgttcgggctcatctggctgtccgtggtgttcgtcttccgggtgctggtatacgtggtggctgcagagcgcgtgtggggggatgagcagaaggactttgactgcaacaccaagcagcccggctgcaccaacgtctgctacgacaactacttccccatctccaacatccgcctctgggccctgcagctcatcttcgtcacatgcccctcgctgctggtcatcctgcacgtggcctaccgtgaggagcgggagcgccggcaccgccagaaacacggggaccagtgcgccaagctgtacgacaacgcaggcaagaa

SEQ ID NO: 5263 - DNA, 582 bp, Homo sapiens
agaagagccctgggctgggtggggcagggcggaagggccctggccttgttgggtggaggtgaagagttaatggctccgcgcgcaggcactgccctctgaactggaacaaaatgcaacttccggttggagtcactcggccaggcgccggcgacctgaggggagagggaacgcagctgaaagcgtgaactgtacctgtcatttactccatcctttatagtgatgctacaggacgaagaggaatggataaaaacactggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagagg

SEQ ID NO: 5264 - DNA, 545 bp, Homo sapiens
gtagcaggcggaagtaagggtgagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagatggatgagcagattagactgatggaccagaacctgaagtgtctgagtgctgctgaagaaaagtactctcaaaaagaagataaatatgaggaagaaatcaagattcttactgataaactcaaggaggcagagaccccgtgctgagttttgctgagagatcggtagccaagctggaaaagacaattgatga

SEQ ID NO: 5265 - DNA, 554 bp, Homo sapiens
agagaggaggctgcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcgagaagttgagggagaaaggcgggcccgggaacaggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctactctcaaaaagaagataaatatgaggaa

SEQ ID NO: 5266 - DNA, 567 bp, Homo sapiens
gtgtgtggcattatcgtcttcgaaaagggctatgggagcacgagcattttagagagtttttaatctcattggaggcttcagagaccctttcataggtccctgagaactgatattcttttttgtctgtgaggttgtctgtgtgaaagggcaaagtgatctctcaaaagacatattcatttactttcttttttcttttttttttttgagacagagtctcactctgtcacccaggctggagtgcagtggtgcaatctctgctcactgcagcctccacctcccaggttaaagcgattctcctgcctcagcttcctgggtagctgggattacaggtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccat

SEQ ID NO: 5267 - DNA, 555 bp, Homo sapiens
aacgaacagtggtctgatttggctggagagcaagtttcctcaaggggcgccgtggggaatttagctggctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaa

SEQ ID NO: 5268 - DNA, 824 bp, Homo sapiens
  misc_feature (547)..(547): n is a, c, g, or t
  misc_feature (550)..(550): n is a, c, g, or t
  misc_feature (559)..(559): n is a, c, g, or t
  misc_feature (631)..(631): n is a, c, g, or t
  misc_feature (650)..(650): n is a, c, g, or t
  misc_feature (800)..(800): n is a, c, g, or t
  misc_feature (811)..(811): n is a, c, g, or t
  misc_feature (815)..(815): n is a, c, g, or t
  misc_feature (823)..(823): n is a, c, g, or t
actgcgagtttccggtctgggctttggcgggtctggtttgaagctctcctgtttgacgaaagtatgtctcaggaaggctggagtctttctgaaagagttgcttccgcttgttgttggctttcaactgttggatttgaggcgcttagcgccttcttcgtccgggtgcagcacattcttgattggtctcatgcctttgtggttgtaaatgtgcctggaatcctagcctttcatggtttgttctgagtaatgaataccctattactatgatactagtatcttccttaattatcctactcattgtctcaacattctgacagttggattgagcatattcaaattttgaaaattattgtagaaatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttacaaacaatggtgcagctcttanganctctcacangatgtgttcagcatatctgtgccacacaggaatccatcattttggaaaatattcaaaatctcccctcctcantccttcatataattaaaancacatttgttgcattgtaagaataatgaatctgtgtattccggggtgtttacacctaatttcaaaacttctccaagctctttccaaggaaggcctattcccctccaaaaccatttaatggaactgctgggaaattggtttgcatgggaancctttaatttnaatnaaaaatgna

SEQ ID NO: 5269 - DNA, 555 bp, Homo sapiens
cgagtttttggagcgccgggagcgaggtaatggctgggcgccgctgcgtgagcccgagcgctactaatctttttcggcagtgcggtgcggccgagtgtgaacatggctacgcctcttcattcccgtccatgccgagcccccgactgcagcattcaaagcccccacggaggttgagccgggcacagaaacacagcagcgggagcagcaacaccagcactgccaacagatctacacacaatgagctggaaaagaatcgacgagctcatctgcgcctttgtttagaacgcttaaaagttctgattccactaggaccagactgcacccggcacacaacacttggtttgctcaacaaagccaaagcacacatcaagaaacttgaagaagctgaaagaaaaagccagcaccagctcgagaatttggaacgagaacagagatttttaaagtggcgactggaacagctgcagggtcctcaggagatggaacgaatacgaatggacagcattggatcaactatttcttcagatcgttctgattcagagcgagaggagattgaag

SEQ ID NO: 5270 - DNA, 560 bp, Homo sapiens
  misc_feature (143)..(143): n is a, c, g, or t
tccggttccggctggcgtctgcacctgcgaccaccgtgagcagtcatggcgtactccacagtgcagagagtcgctctggcttctgggcttgtcctggctctgtcgctgctgctgcccaaggccttcctatcccgcgggaagcnggcaggagccgccgccgacacctgaaggaaaattgggccgatttccacctatgatgcatcatcaccaggcaccctcagatggccagactcctggggctcgtttccagaggtctcaccttgccgaggcatttgcaaaggccaaaggatcaggtggaggtgctggaggaggagctctcaaaggggaaaacaactgcagaggatgggaaatgctatactgccatgcctggaaacacccacaggaaaattaccagttttgagcttgctcaactgcaagaaaaactgaaggagacagaagcagccatggaaaaattaatcaacagagtgggacctaatggtgagaggttaccctgaagagacttacccaatttatgacctttcagactgtatcaagcgtaggcaagaaacaatcttggtgga

SEQ ID NO: 5271 - DNA, 406 bp, Homo sapiens
aattttccactcgttcctttctcgggctcagacggtttcggtgcttctcccactcggatgttcccgcggcttaaaagagtccgcagcgagcaccgaaatacctcttccagggcgggttttcgggggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctg

SEQ ID NO: 5272 - DNA, 549 bp, Homo sapiens
agcaatctatcagggaacggcggtggccggtgcggcgtgttcggtggcggctctggccgctcaggcgcctgcggctggtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcccccttgctacagaggataaagaagccctgaagaag

SEQ ID NO: 5273 - DNA, 532 bp, Homo sapiens
ctttctgcccgtggacgccgccgaagaagcatcgttaaagtctctcttcaccctgccgtcatgtctaagtcagagtctcctaaagagcccgaacagctgaggaagctcttcattggagggttgagctttgaaacaacctgatgagagcctgaggagccattttgagcaatggggaacgctcacggactgtgtggtaatgagagatccaaacaccaagcgctccaggggctttgggtttgtcacatatgccactgtggaggaggtggatgcagcctatgaatgcaaggccacacaaggtggatggaagagttgtggaaccaaagagagctgtctccagagaagattctcaaagaccaggtgcccacttaactgtgaaaaagatatttgttggtggctttggtggcagccgtggtggtggtggatatggtggcagtggggatggctataatggatttggtaatgatggaagcaattttggaggtggtggaagctacaatgattttgggaattacaacaatcagtcttcaaattt

SEQ ID NO: 5274 - DNA, 574 bp, Homo sapiens
ctttgaaggatgcccaggagaagctggaactggcagagaagaagggtgctgatgctgaggctgaggtggcctccttgaaccgtaggatccagcctggttgaagaagagctggaccgtgctcaggagcgcctggccacctgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaaagaagataaatatgaggaagaaatcaagattcttactgataaactcaaggaggcagagacccgtgctgagtttgctgagagatcggtagccaagctggaaaagacaatt

SEQ ID NO: 5275 - DNA, 569 bp, Homo sapiens
tttactattttaggtatgagaatgagctggccctgcgccagagcgtggaggccgacatcaacggcctgcgccgggtgctggatgagctcactctgtctaagactgacctggagatgcagatcgagagcctgaatgaagagctagcctacatgaagaagaaccatgaagaggtgagcggggattgcaggctgccctgggctcaacaacctccagtgagaaggaggagccctcccctgcaactggacacagtcctccattgtgggacctggaaacactctccagaacactctgccagcactcagagccaaggagagggaggatgagtagcctcacacatcttcctttcccatccccacaggagatgaaggaatttagcaaccaggtggtcggccaggtcaacgtggagatggatgccaccccaggcattgacctgacccgcgtgctggcagagatgagggagcagtacgaggccatggcagagaggaaccgccgggatgctgaggaatggttccacgccaagagtgcagagctgaacaaggaggtgtctaccaacactgccatgattcaga

SEQ ID NO: 5276 - DNA, 561 bp, Homo sapiens
aatttttctgcagtggctctgggtccagccccttacttaaagatctggaaagcatgaagactgggctttttttcctatgtctcttgggaactgcagctgcaatcccgacaaatgcaagattactacctgatcattccaaaccaactgctgaaacggtagcacccgacaacactgcaatccccagtttaagggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgagtgagcctcaggagaaaaaactctcagagaacactgttttttggctcctggtgttagttccttcacagattctaaccaacaagaaagtatcacaaagagagaggataaccaagaaagaaagacagaatt

SEQ ID NO: 5277 - DNA, 577 bp, Homo sapiens
aacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctgga

SEQ ID NO: 5278 - DNA, 501 bp, Homo sapiens
cgtgcgcgcgcgtccctcgccgccaccgccgcccggacagccctgcggccgccccgccggcggagccggggccggcctggtcctcgggcggctgcttggccaccgccaccgccgtccgaagggctcgagcccatatgaagatcaatgatgcagactgatggttttgatgaagctgggcatttataactagattcattaaggaatacaaagaaaatacttaaagggatcaataatggtgtctcctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctacccgatgcctt

SEQ ID NO: 5279 - DNA, 584 bp, Homo sapiens
aacagagccaccttctgcgtcctgctgagctctgttctctccagcacctcccaacccactagtgcctggtcctcttgctccaccagcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgt

SEQ ID NO: 5280 - DNA, 573 bp, Homo sapiens
gtccactagccctgggctgcagggaggctgctgcgtccagtgaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggaaagcaagcaagtggagaccaagacagatgccaagaatggagaggaaaggggcagagatgccagcaaaaaaagccctgggccccagacgggactcagatctggggaaggagccaaagaggggtggtttaaagaaaagcttctctagagacagagatgaagctggtggcaagagtggcgagaag

SEQ ID NO: 5281 - DNA, 482 bp, Homo sapiens
agtgtgttctgacggagccgaagtacagaaaccatatttacaggtacatgtgacagcgttgcagctatgagtggaattttaaagaggaagtttgaagaagttgacggctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccacccggagatgttgagagaacaccttagggaggaaaagctgaactccttaaaactaaagatgactaa

SEQ ID NO: 5282 - DNA, 576 bp, Homo sapiens
gctcctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaattcatgctgtttatcctgcagctggacattgccttcaagctaaacaaccaaatcagagaaaatgcagaagt

SEQ ID NO: 5283 - DNA, 577 bp, Homo sapiens
gcggaacccagcgaaggcgagagaatgaagacacgcatcgggctgtggccagacggttggcagccagggacctagccaagcctccctgcccccgacgcccgcgtccagggatcgtcgatgacagttcgcctgtcgggacatcggatcaggcggccgcccctggggagatgagcaagtcaagccacagctgacctgtgaaaggccgtgtaacagtgactggaagaaccaggaagcctaaacaaatcaggagtatgaaagggagagaacacagtgctgcgggagtttatgccaaaggcacggacccaggcatcagcgtttaagtttaaactgtctagaggaaagatggatactatgatgctgaatgtgcggaatctgtttgagcagcttgtgcgccgggtggggattctcagtgaaggaaatgaagtccgaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccatt

SEQ ID NO: 5284 - DNA, 477 bp, Homo sapiens
aaatgaagtgtgctttatttctgagagtgaagattttacagcgtgtgtgccgtagtcgttatatagtgcacgcaggtacatgtgacagcactgcagcagatgagtggaattttaaagaggaagtttgaagaagttgacggcctcctcaccctgctcctctgtgagggaatcagatgatgaagtttccagcagtgaaagtgctgacagtggggacagtgtcaatccatccacttctagtcattttaccccttcctccattctcaaaagggagaaacgactgaggacaaagaatgtacattttagttgtgtcaccgtgtactacttcaccaggaggcaaggcttcacaagtgtgcccagtcaagggggaagcaccctggggatgtccagccgccataacagcgtgcgccagtacactcttggcgagtttgcaagggagcaggagaggctccaccgggagatgttgagagaacaccttag

SEQ ID NO: 5285 - DNA, 553 bp, Homo sapiens
cacacagtgatttctgttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaaacatcccagttaccagtgtccttgaattgatagtggcttctgtttgtcagtctcatataagaactacagctcatcaggaggagatcacagcagggtaagagacaccaacaccatgttctgcacgaagctcaaggatctcaagatcacaggagagtgtcctttctccttactggcaccaggtcaagttcctaacgagtcttcagaggaggcagcaggaagctca

SEQ ID NO: 5286 - DNA, 531 bp, Homo sapiens
gagactgctgagctggcacaaaaagggagcgaagagggaagaaagggaaaggaaggcgaacttcgggcgccttcgaggggagcgaatttaaatggcccccagctcatcagctagtttttggttctgaaatccgttcaggggaatttgcacaggggacgaggaaaattatgatgataattccgaagaaggcttccacactattcattcaggaaggcatgaatatgcattcagcttcgagcttccacagactcaccccaagcaggcacaaaagaaaagacactctgttgctggttctgtacctcaggcccaatatccttaagtgccaaaattgaaaggaagggctataccccaggtgaatcaattcagatatttgctgagattgagaactgctcttcccgaatggtggtgccaaaggcagccatttaccaaacacaggccttctatgccaaagggaaaatgaaggaagtaaaacagcttgtggctaacttgcgtggggaatccttatcatctggaaagacagagacgtggaat

SEQ ID NO: 5287 - DNA, 484 bp, Homo sapiens
gaggctgcggcgcggccaccggcgggagtgcagcggccactgtacccagagattcaaaaccccaaacccgggacttgggggcgctgagccgggccgggaagcagagcctggtcgtgaggaacagccgcccgttgctgtctgcccctttgcggacagcgtctccctcgactccgcttaggaagtggtgggggcggcgtggcccccgtcgggaggcgttcgaacgcccgctaggagtaagatgatcgaccgcaacctccgtgaggacggcgagaaggcggcgcgcgaggtcaagctgctgctgctcggtgctggtgaatctggtaaaagtacaattgtgaagcagatgaaaattatccatgaagctggttattcagaagaggagtgtaaacaatacaaagcagtggtctacagtaacaccatccagtcaattattgctatcattagggctatggggaggttgaagatagactttggtgactcagcc

SEQ ID NO: 5288 - DNA, 826 bp, Homo sapiens
  misc_feature (689)..(689): n is a, c, g, or t
  misc_feature (763)..(763): n is a, c, g, or t
  misc_feature (784)..(784): n is a, c, g, or t
tctgccgttgggtgaggcgcggagcgaagtgaagggtggcccaggtggggccaggctgactgaagagagccaaaggaaatcaacatttgaattgactacccaatgtcctgcccctgtttctgtcctgtagcacttaggaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaactgaagaagagagaaaagangcgctctactagccgcagtttgttgatggtccccctggacctgtaaagaaaactcttccttggctttgcagtanaccaggggaatgaatccatanttgcaaaactacagtgactgttcccaacgatggcgggccatc

SEQ ID NO: 5289 - DNA, 560 bp, Homo sapiens
gctgatgctgccgtgcggtacttgtcatggagctggcactgcggcgctctcccgtcccgcggtggttgctgctgctgccgctgctgctgggcctgaacgcaggagctgtcattgactggcccacagaggagggcaaggaagtatgggattatgtgacggtccgcaaggatgcctacatgttctggtggctctattatgccaccaactcctgcaagaacttctcagaactgcccctggtcatgtggcttcagctccaggctgccagtctcctatttgtggataatcccgtgggcactgggttcagttatgtgaatggtagtggtgcctatgccaaggacctggctatggtggcttcagacatgatggttctcctgaagaccttcttcagttgccacaaagaattccagacagttccattctacattttctcagagtcctatggaggaaaaatggcagctggcattggtctagagctttataaggccattcagcgagggaccatcaagtgcaactttgcgggggttgccttgggtgattcctggatctcccctgttgattcg

SEQ ID NO: 5290 - DNA, 568 bp, Homo sapiens
agtcctttcattcccgctcctaccgagatgccgggaaagcactcccgcgccgatgcgaggtgatactctctggaatcataggattaacaacttggaaaaggcctatgatactcctggtaaacctctttgtgctgctctctgtggtttgtgtcctcttaaatctagctggatttatcctaggctgccaaggggcccagtttgtgtccagcgtgcccaggtgtgatctggtggacttaggtgaaggcaagatttgcttctgttgtgaagaatttcaaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgtt

SEQ ID NO: 5291 - DNA, 578 bp, Homo sapiens
acttcattaaatctagaggcagttgagcatgggagccgtctgtatgttgaattagggctcgcactcttgcgcaacacgtcaccagtcggaaactgggggtttgcttctgtgatttatttcattattgtgctgctgatgaagagactagcagctcgctgctttgctggcttgttaattttatccccactaactgtgatttctgatagccggcctgctgatagtggtaagtgctgctggctctggtttaaagcaagcgtttgcaggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagatagttcagggcgacagctcagtgaagtcttcattcagttaccttcaaggaaagaattaccagaatactatgaattaattaggaagccagtggatttcaaa

SEQ ID NO: 5292 - DNA, 749 bp, Homo sapiens
  misc_feature (629)..(629): n is a, c, g, or t
  misc_feature (678)..(678): n is a, c, g, or t
  misc_feature (686)..(686): n is a, c, g, or t
  misc_feature (705)..(705): n is a, c, g, or t
  misc_feature (711)..(711): n is a, c, g, or t
  misc_feature (744)..(744): n is a, c, g, or t
gaaggtggaagcggccgcggcggcagcagaccccagagtcagaaggagtgagaactctgacccctaatcccactgcatccagccaataggagcccagccaccatggcggagctgcaggaggtgcagatcacagaggagaagccactgttgccaggacagacgcctgaggcggccaaggaggctgagttagctgcccgaatcctcctggaccagggacagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaagtgagaggcctgggaacccctccaaaccagagttctctttccaagcacaaggagacccttagaacttccaggttcaccgtggttcctgagccagtttcagcttctgaactcaatatatcntcttccttcatgctccccgccttgattattgagaaaagtttctctacantaattggngttggtgttgggagctggngcctanatcctggcgagatatgctcttaaccactccggncactg

SEQ ID NO: 5293 - DNA, 598 bp, Homo sapiens
aaaaaaaagtgtgtggcacttccccccctcactcttgctcccactctcgccatgtgatatgcctgctccccttcttcttctgccgtgattgtgagcttcctgaggcctcattagaggcagatgttctgtatggcctgctgaactatcccaaaatccaggagtgagggatctattcaggcccacagagtactgcaaccagagctatctgatggcattcctcagctcagcttgcggctaagttatagaaaagcctgcttggaagacatgaattcagcagagggtgctattagtgccaagttggtacccagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactc

SEQ ID NO: 5294 - DNA, 893 bp, Homo sapiens
  misc_feature (691)..(691): n is a, c, g, or t
  misc_feature (699)..(699): n is a, c, g, or t
  misc_feature (809)..(809): n is a, c, g, or t
  misc_feature (840)..(840): n is a, c, g, or t
  misc_feature (859)..(859): n is a, c, g, or t
gaggggaacctgggcgcctgggacccgccgatgccccctgccccgcccggaggtgaaagcgggtgtgaggagcgcggcgcggcaggtcatactgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcagtgtactcatctcagaggaagtcctggcaccctgtgtgccaagacgactggaacgagaactacgggcgggcggnctgcaagnacatggggctataagaataatttttacttctaccaaggaatagtgggatgacagcggatccaccagctttatgaaactgaacacaagtgccggcaatgtcgatatctttnaaaaactgtaccacagtgatgcctggtcttnaaaacaggggttctttacnctggataacctgcggggtcaacttgaattaagcc

SEQ ID NO: 5295 - DNA, 534 bp, Homo sapiens
attcactggtccaggaatcaaggggtggaaatgggagtggcaccacgcactattactccaagtggcccactagcaaaattttcgcttgctgtttctgtgactttacgctctgctgacctagaggtcttagttccggagggaggaatgctgccaccaggagacacaacaatgattcaattaaactagaatttacgactgccacctggccacgctgagctccacatgcctctgaatcaaaaggcaaagagagagttatgcattggctggggagacccatctggactaccaaggagaagctatagactacttctactccaccaggaaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccag

SEQ ID NO: 5296 - DNA, 566 bp, Homo sapiens
gctctttttgatgatttggtcattggctgggatgtgtccgtggatggtggtggtggtgctgtctggattttgaagaaggggcactgagtctgaggctgtctgttccctctcacacctccagcaactcgaaccgtaccagtcacaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactc

SEQ ID NO: 5297 - DNA, 569 bp, Homo sapiens
aaactcgaagacaggcttttcatcctcctggaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcactcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtg

SEQ ID NO: 5298 - DNA, 570 bp, Homo sapiens
ggttcccttccaatcagctccgggagggcaacgtaatcgactttattaggaacaacagaagagtcggggaactgtgcccggcgcaaacccggagctctgttacaaggctgagatacttgcacgctccagggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcacaatgaacaggacttcagagaagagtttgggagtgtggcaaacaagatcctattacacatgatggcttcctgcttatcagagattcacctgtaacaatattacttcatatgagaaaatgcagaagtctccatggacgtttccctggcttaccgtgatgacgcatttgctgagtg

SEQ ID NO: 5299 - DNA, 574 bp, Homo sapiens
aggcagcagccccttctttcttgccccagtctccagttctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtctaagtgttctgagctggaggaggagctgaagaatgtcaccaacaacctcaagtctcttgaggctcaggcggagaagtactctcaaaagaagataaatattgaggaagaaatcaagattcttactgataa

SEQ ID NO: 5300 - DNA, 512 bp, Homo sapiens
cactcaggcagcagccccttctttcttgccccagtctccagttctccagtgttcacaggtgagcctaccaacagccactgctcatgatggaggccatcaagaaaaagatgcagatgctgaagttagacaaggagaatgctctggatcgggcagagcaagctgaagctgagcagaagcaggcagaagaaagaagtaaacagctggaggatgagctggcagccatgcagaagaagctgaaagggacagaggatgagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaaccgaagcct

SEQ ID NO: 5301 - DNA, 530 bp, Homo sapiens
agaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggaatgtgtcgagccactgggcctggagaatgggaacattgccaactcacagatcgccgcctcgtctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccaacccatgacccagggcattctgattgatagagaaaaagacatcagttttcaaagtattttcccttcttctggttggctcctctcctgtagcttctagaacatgtagcgttaggtgtgtttggcagatgtcagctttacgagggcagagaatctgtctgttttg

SEQ ID NO: 5302 - DNA, 588 bp, Homo sapiens
gcgtccagtgaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgaaagcaagcaagtggagaccaagacagatgactgaggtgaacgtcaacaactcagactgcatcacaaatgagatcttggtccggtttactgaggctctggagttcaacactgtggttaagctgttcgccttggccaacacgcgagccgat

SEQ ID NO: 5303 - DNA, 553 bp, Homo sapiens
aattagcagtcgcggtgtgccgctacgtgcgggctctcaaggagctcagcctcccggacggagccggcggctgcggggcgaggacggcggcgcggcgaggacggcggcggaccggggcagccccgcgccctggccagctctactgagatgaagaaagaaaaagaatacctgctcagctccagagacacgtaaagggacagagattgggggacagaaggaagtgcattaattccttccacgacccctgaagagcagcggtgggtctgagcatcctatctccaggaagcaggccagcaggcaagccagctgccacctcgtcctgtgcaaagcacaggcaccgtccccaaaagatttccaaagatgatgttaaacccagccacggttctgatctccaggaaagcaattgctgtggtacaaaaggacaagggttaaaagagaacagtgggagctctctttcccagctaactcacgcagtgtgacgcagaggctttcagcacagcccagggtgcccgggactgaaaactccttcaccagccccctccacaggatatag

SEQ ID NO: 5304 - DNA, 594 bp, Homo sapiens
atattgattccggctcgagcctagagaggacgtgttctctggacttaggggtagacagacactggggaggaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttgggtgttggagctggagcctacatcctggcgagatatgctcttaaccacccggacactgttgaa

SEQ ID NO: 5305 - DNA, 578 bp, Homo sapiens
attttgtcattaaattagcttaaagaggaacttgtagcttttagagaactcatgagttttccgcttcatcatctgcttctgttttctccatcttagtttgcccaaagcttgctggccgctgtgtagggctggtgagtggctggggctgtctgagccatgaacaacttcagggccaccatcctcttctgggcagcggcagcatgggctaaatcaggcaagccttcgggagagatggacgaagttggagttcaaaaatgcaagaatgccttgaaactacctgtcctggaagtcctacctggagggggctgggacaatctgcggaatgtggacatgggacgagttatggaattgacttactccaactgcaggacaacagaggatggacagtatatcatccctgatgaaatcttcaccattccccagaaacagagcaacctggagatgaactcagaaatcctggaatcctgggcaaattaccagagtagcacctcctactccatcaacacagaactctctcttttttccaaagtcaatggcaagttttccactgagactctttgaaaacctcaaggtatgtg

SEQ ID NO: 5306 - DNA, 547 bp, Homo sapiens
aggctatatattgttcttcccctggcccagcgccctgatccaatgcccggacacacatccacaccaagttggacgaaaagcttaaccagctcgaaaaagcagtggaggcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcacttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgccta

SEQ ID NO: 5307 - DNA, 542 bp, Homo sapiens
ccctgacactggagtgctcacagtctcctgggagaggagcaccaccccagacattactggttatagaattaccacaacccctacaaacggccagcagggaaattctttggaagaagtggtccatgctgatcagagctcctgcacttttgataacctgagtcccggcctggagtacaatgtcagtgtttacactgtcaaggatgacaaggaaagtgtccctatctctgataccatcatcccagctgttcctcctcccactgacctgcgattcaccaacattggtccagacaccatgcgtgtcacctgggctccacccccatccattgatttaaccaacttcctggtgcgttactcacctgtgacaaatctcctgcctggtacagaatatgtagtgagtgtctccagtgtctacgaacaacatgagagcacacctcttagaggaagacagaaaacaggtcttgattccccaactggcattgacttttctgatattactgccaactcttttactgtgcactggattgctcctcgagccaccatca

SEQ ID NO: 5308 - DNA, 543 bp, Homo sapiens
  misc_feature (155)..(155): n is a, c, g, or t
gcaacgccgagcggaggaggcaggaaccggagcgcgagcagtagctgggtgggcaccatggctgggatcaccaccatcgaggcggtgaagcgcaagatccaggttctgcagcagcaggcagatgatgcagaggagcgagctgagcgcctccagcngagaagttgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatggaccagaacctgaagtgtctgagtgctgctgaagaaaagtactctcaaaaagaagataaatatgaggaagaaatcaagattcttactgataaactcaaggaggcagagacccgtgctgagtttgctgagagatcggtagccaagctgga

SEQ ID NO: 5309 - DNA, 569 bp, Homo sapiens
  misc_feature (302)..(302): n is a, c, g, or t
agatggtgcctgaagagagagggcgttgctgcaagcgccctggctggagagcatgcctgcccggcaccgtgctgccctgaggagccgcggacagccccggagctcccttccggagttctttctgctgcctccaccgccaccgtctctctctagccccagctgaaatgaaggccataccgcggccacagaacttggttcagtttcaaaggctaatgtagtccctgggttttctgctcaatgtgaattacgctgcctgtgccttagaggaagccgcggagctcttcgttgctgcaattgcctcnggtattccagaaagaagagattgaacccttgcaaggtaaacagcaagatgtaaactggttaggtcaaggccttattcagagtgctgccaaaagcactagcactcagggcttggagcatgacctggatgatgtcaatgcacggtggaagactctcaataagaaggtggctcagcgagcagcccagctgcaggaggccttgctgcactgtgggaggttccaggatgccctggagtccctgctcagctggatggtggacactgaggagct

SEQ ID NO: 5310 - DNA, 576 bp, Homo sapiens
agtcctgcttctcttccctctctcctccagcctctcacactctcctcagctctctcatctcctggggggctccaagaggatctccattggctttggtctgggtggtggagccggccttgctggtggctttgggggccctggcttccctgtgtgcccccctggaggcatccaagaggtcaccgtcaaccagagtctcctgactcccctcaacctgcaaatcgatcccaccatccagcgggtgcgggccgaggagcgtgagcagatcaagaccctcaacaacaagtttgcctccttcatcgacaaggtgcggttcctggagcagcagaacaaggttctggaaacaaagtggaccctgctgcaggagcagggcaccaagactgtgaggcagaacctggagccgttgttcgagcagtacatcaacaacctcaggaggcagctggacagcattgtcggggaacggggccgcctggactcagagctcagaggcatgcaggacctggtggaggacttcaagaacaaatatgaggatgaaatcaacaagcgcacagcagcagagaatgaatttgtgactctgaa

SEQ ID NO: 5311 - DNA, 515 bp, Homo sapiens
attttcccccgcggggagcgcctgggcttcagcggttgctccgcggtcctctctggcgggatcggcggcagctccgcctcattccgggcccgggtcaagggctcggcctcctttggcagcaagagcctctcctgccttgggggcagccgaagcctggcgctcagcgctgctgcacggcggggcaggcggccgcctgggcggcttcgtgggcaccgccttcggcagcgccgggctggggcccaagtgtccctccgtgtgcccacccgggggcatccctcaggtcaccgtcaacaagagcctcctggccccgctcaacgtggagatggaccccgagatccagagggtgcgcgcccaggagcgggagcagatcaaggcgctaaacaacaagttcgcctccttcatcgacaagaaaacaccagcatttatagcatgagaagctacctctgtctcatgaaaactcactgaggcagaggcagatggtaccattgcttaagccctcttcctgattccatata

SEQ ID NO: 5312 - DNA, 584 bp, Homo sapiens
aacggctcgcggagcggctacgcggagtgacatcgccggtgtttgcgggtggttgttgctctcggggccgtgtggagtaggtctggacctggactcacggcctgcttggagcgtccgccatgaggagaagtgaggtgcctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcagagacagagtctcgctgtgttgtccaggcaggagtgcaatggtgtggtctcggctcactgcaacctccgcctcccgggttcaagcgattttcctgccgtagcctcccgagtagctgggattacaggaagaaggagagacaaccatcttgcaactagaaaaagatttgcgcacccaagtggaattgatgcgaaaacaga

SEQ ID NO: 5313 - DNA, 555 bp, Homo sapiens
aaactaccttcccaaatgcatccgggtaaggaaaatgagggtgaacaggaaaggtcagtgtgcagctgaaagcctctccagccttcctagcttcccaaaatacaaagggagaagaatcctattgtatctgtggaagtgagagacaaaccttgtcttggacagtgactcctaaaactctggggaatgtgaacttctcagtgagtgcagaggcaatgcagtccttagaactctgtggaaatgaggttgttgaggtccctgagattaaaagaaaagacacagtcatcaaaaccctgttggtggaggctgaaggtattgagcaagaaaagactttcagttccatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctga

SEQ ID NO: 5314 - DNA, 572 bp, Homo sapiens
  misc_feature (133)..(133): n is a, c, g, or t
aaaaggaggactctaagggaggcctgctgaagcctgccaccaccaccaggttttctgtaattggatctgcacaggggcctcagggagtgcagtatgaaaacacccatttccatgcactcccaaccaacacgcntgaacaatctgtactcttggtgagaaagacccatgagggactgaaaattctttttctacgtgacactgagaagacagtcacatggtttggaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttga

SEQ ID NO: 5315 - DNA, 571 bp, Homo sapiens
atataccatgccaaatagaatgagaatttgtgccatcttgcccatcccttccactccgacagttccattcattgacttccaggagacgggagagagaacctacctacctgagccgactttgaaaggagactgagtggggctcttttgaacctgaggcccagaaagtcttttagacttttcttataacttggttttggagtttgtcgtggggctgaggctgaggtggcctccttgaaccgtaggatccagctggttgaagaagagctggaccgtgctcaggagcgcctggccactgccctgcaaaagctggaagaagctgaaaaagctgctgatgagagtgagagaggtatgaaggttattgaaaaccgggccttaaaagatgaagaaaagatggaactccaggaaatccaactcaaagaagctaagcacattgcagaagaggcagataggaagtatgaagaggtggctcgtaagttggtgatcattgaaggagacttggaacgcacagaggaacgagctgagctggcagagtcccgttgccgagagatggatgagcagattagactgatgg

SEQ ID NO: 5316 - DNA, 580 bp, Homo sapiens
aaggaacccccacccccagccaagggaagcgcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtccgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggtcagtgtgcagctgaaagcctctccagccttcctagcttcccaaaatacaaagggagaagaatcctattgtatctgtggaaatgagagacaaaccttgtcttggacagtgactcctaaaactctggggaatgtgaacttctcagtgagtgcagaggcaatgcagtcct

SEQ ID NO: 5317 - DNA, 566 bp, Homo sapiens
gagagtgagctcgcgccgcggctggggcgaggctaggaaaccggcgtgcgccggtaaaggttcctccagagcgacccccacccagcccgtactcacagtttgttcccgggcttctgggggcagcccagcccgtgtcaacatcatgttctgtcgcccctcttttgggcctcctaagggccatcgaaaggaaacgacttcaggctttaactgagtagagggcagacgctcctgccggccttacagatgatgataattccgaagaaggcttccacactattcattcaggaaggcatgaatatgcattcagcttcgagcttccacagacaccactcgctacctcattcgaaggccgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaaggaagggc

SEQ ID NO: 5318 - DNA, 549 bp, Homo sapiens
agatccacttgcaggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaaggtgggtgtctctgggcctggaggctggggtttggagactttggtcaagatgaggagggcagggaggctccctggctggatgacaggacttcatgccatctgtgcccatgccacccagcttccctcctggggacacagagtggtgagggtggtgcagacttggtccctggagctgccttaccctctaacccctcccattcccgggggacctggcagaatgtcatcaacacatttacccagacggcccatt

SEQ ID NO: 5319 - DNA, 579 bp, Homo sapiens
gtgacgggtgaagctctggggctgcggtcaggccggcgaccggcttgggagcccatattctccattcccggttccggggtgatcgtggagaggcggaagccccttctggtgctagtagtgaacctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacag

SEQ ID NO: 5320 - DNA, 563 bp, Homo sapiens
  misc_feature (153)..(153): n is a, c, g, or t
aataatttgtgtgggttttggatatggtgggaatcttgtctacgtcttctcaatcataaacgtttttaggcttgtttggaggaaggggatgattatgaagtcattcctaacagtaatttctatgtatccagaacggcctgcagagataatacnttctgtctatcacataagtggaaagaaaaagacatttaaggatgttggaaatcttcttcgaagccatggaattgacttggaccataatagatttttaattttacagggtgaagttgaacaaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaagaatcatgtttgtcaatattatatttatgagttgca

SEQ ID NO: 5321 - DNA, 532 bp, Homo sapiens
attgtcacttagtgatttactggctctgtcatgatttagacattgaacttctgactccaagtccagtgttggtttgctacaattgtttcatcaagatgggaaagctatggaccagaaaaggcaaataacttgtccaaagtcacgtaaatatgaataatgaagctcgggtttcaacttaggcatcctgcctccagattccatgcccttaactcctataccagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagcccgagatcgccacataaaactccacaccggggacaagaagtaccactgcgg

SEQ ID NO: 5322 - DNA, 532 bp, Homo sapiens
gtgattggttggtgaaggttttcaaaccggagctgtgggcgcggcgctgctctaccgttgggtgaggcgcggagcgaagtgaagggtggcccaggtggggccaggctgactgaatgtatctcctagctatggactaaataatacatggggggaaataaacaagtattcatgagggtgaaaatgtgacccagcaggaaaattacaactattttcaattgacgttgaatagggagagccaaaggaaatcaacatttgaattgactacccaatgtcctgcccctgtttctgtcctgtagcacttaggaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgc

SEQ ID NO: 5323 - DNA, 541 bp, Homo sapiens
agttagcggatggcatgcccggaagccatctgaaatcacctctagagtttggggaccactgcgtgagacagggaaaagtccaaacccctctgagaaggggaagagagcagctggcgcagggcaccaagccttcagggaaaagccccactcgctgcatggcgaggaaacgagacctctttcgttccttctagaaggtctggaggacgtagagttattgaaaatgcagatggttctgaggaggaaacggacactcgagacgcagacttcaatggaaccaaggccagtgaataagcaactttctacagttttgcaccacggcaagaaaaccaaaaaccaaaacaaacaaacaaaaaaaacccaacaacaacccagaacaaagcaaaacccagcagactgtacttagcattgtctaaatccattctcaaattccaaatatcacagacacccctcacacaaggaatataaaaaccaccaccctccagcctgggcaacgtagtaaaacctcatctatacaagaatttaaaaataagctgggcgtggt

SEQ ID NO: 5324 - DNA, 586 bp, Homo sapiens
  misc_feature (150)..(150): n is a, c, g, or t
gatgcagcgtagctcttagggggaggtgtgagtccttggaaagctcacaagaatttcagaggggcccgagatgcgagtcggactcccttccgaggcgtcgtcttgcccatggtcagcgcgggggccgcgggacccgccagagcgcaggcnggagtgggctggcgcacgtggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcactt

SEQ ID NO: 5325 - DNA, 551 bp, Homo sapiens
actgcctgtaaagccctcgcatgagaggccagcctgctagggaaatccaggaatctgcaacaaaaacgatgacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagatctggaaagcatgaagactgggctttttttcctatgtctcttgggaactgcagctgcaatcccggtgaaaaggagataagaagcaaaggagcaaaccaaacctaatatgaatcctgtactttggccagaagccgtggctcacatctgtaatcccagcactttgggaggccaagacaaatgcaagattattatctgatcattccaaaccaactgctgaaacgg

SEQ ID NO: 5326 - DNA, 549 bp, Homo sapiens
ctcttctccctcctgccgccttatgaacagggtgactgtttccccatcggccatgattttaagtttcctgaggcctcccagtcatgctgaactatactgttcctaagagcatctgccccagtcaacttctcatccacagatattaatctcagtcaacctccagatttttagacatattttgaaagtctttcatcaccagatttcaaaggtgttgatagatatctatttttaaacatggaaagatggtggtgcaatggccagtggctgctacaccccatgtaaaaagcggaaaataaaatgaagattttccagcgcaagatgcggtactggttgcttccaccttttttggcaattgtttatttctgcaccattgtccaaggtcaagtggctccacccacaaggttaagatataatgtaatatctcatgacagtatacagatttcatggaaggctccaagagggaaatttggtggttacaaacttcttgtgactccaacttcaggtggaaaaactaaccagctgaatctgcagaacactgcaactaaagca

SEQ ID NO: 5327 - DNA, 551 bp, Homo sapiens
gttttcaaaccggagctgtgggcgcggcgctgctctgccgttgggtgaggcgcggagcgaagtgaagggtggcccaggtggggccaggctgactgaatgtatctcctagctatggactaaatagtacatggggggaaataaacaagtattcatgagggtgaaaatgtgacccagcaggaaaattacaactattttcaattgacgttgaataggaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacat

SEQ ID NO: 5328 - DNA, 565 bp, Homo sapiens
  misc_feature (149)..(149): n is a, c, g, or t
aaactctcatttgtgaaagtggactcacactttcgacagggaattcccttctttgggtgcgcctagtagatgggaaaggcgtccctataccaaataaagtcatattcatcagaggaaatgaagcaaactattactccaatgctaccacnggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaaggacctcactggcttccctgggcctttgaatgaccaggacgatgaagact

SEQ ID NO: 5329 - DNA, 553 bp, Homo sapiens
cgttattggctgcgggaagaacctcgccgggacctaacccgaagctccgccccctcgcggttaccctggatacccgtcaggctcgggctgcagagaaggttgatagaagtccagatcctgaggaaatctccagctaaatgctcaaaatataaaaactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagagatcagctctgcctgcagtcaagaacagccctttaaattcagctatggagaaaagtgcctgtacaatgtcagtgcc

SEQ ID NO: 5330 - DNA, 565 bp, Homo sapiens
  misc_feature (159)..(159): n is a, c, g, or t
ctccgcagttgggaggagggggcgggaagcagtttgaggggaatgtctgagaggcgctgccccccagagcaccgggagggggtaaatgacacaggaggatcccttttcccccagaaattactcaatgctgaaacctctcaaagtggtattagagacgcntgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacccatttcttttcaaacttcctcaagagttcatgatcccttttcaattccaatttgttgccatcctttatagtcctgggtctctgtcatcatttagcaagtcagctgtgcaaagtggtgcttcatgccccacctccaaccaagatcaaacgggagctgcacagccc

SEQ ID NO: 5331 - DNA, 587 bp, Homo sapiens
cttgattgacagcccggcacttgtttaccacggcgcggccgccgccgctcgcttcaatgagactgctgagctggcacaaaaagggagcgaagagggaagaaagggaaaggaaggcgaacttcgggcgccttcgaggatgatgataattccgaagaaggcttccacactattcattcaggaaggcatgaatatgcattcagcttcgagcttccacagacaccactcgctacctcattcgaaggctgacatggcagtgtgcgctattgggtgaaagccgaattgcacaggccttggctactaccagtaaaattaaagaaggaatttacagtctttgagcatatagatatcaacactccttcattactgtcaccccaagcaggcacaaaagaaaagacactctgttgctggttctgtacctcaggcccaatatccttaagtgccaaaattgaaaggaagggctataccccaggtgaatcaattcagatatttgctgagattgagaactgctcttcccgaatggtggtgccaaaggcagccatttaccaaacacaggccttctatgccaaagggaaaatgaaggaagtaaa

SEQ ID NO: 5332 - DNA, 567 bp, Homo sapiens
aagcgattcccctgcctcagcttctcaagtagctgggattaaaggcatgtgccaccacgcctggctaattttttgtattttagtagagacggggtttcaccatgttggccaagacagtctcgatctcctgacctcatgacccacccgcctcggcctcccaaagtgctgggattacagaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaaca

SEQ ID NO: 5333 - DNA, 545 bp, Homo sapiens
cacttcatcctggactctgtggggcacagggctgggctaacacctaggagggcatttgtttattctttgagtatctgctgtgcaccaggacactgataggcgcaggtggtgaccatcgctatgtgaacaacctacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcc

SEQ ID NO: 5334 - DNA, 579 bp, Homo sapiens
gcattctggaaatggattcaggctaacagagtgttctgaatagagacgcctaaaacaagagccaaagacatagcaatggagaacgtgggtggtacagccctccaccctggcgagcagcacattagaatcaccgtaggagccttaaaaagtactgactggcctggtctttttcggtgtgaaggcaattggaccacccaaatggcaaactaaaagcatagaagcggacaccagaggctcctggacctgagatgtggccctggaagtgaccagatgtggtctcaagagatgggggcccagggctaggaatgccgccatccggggaggccctagagcagagcagagcagctgtgggctggtgccaagctcactcctgcttctctctgcacgtctccctcattcttttctctctgaactgtgacccttttggcccctctgagtaccaggtgggacaaggtgacccctcagcacttgagtttacaccttagatgtgtaggtcctcacagaggccaacttatctccttctgggaccaaattccaaattcctaaagaaaaaacaaaccaaaaacggatatgataaac

SEQ ID NO: 5335 - DNA, 549 bp, Homo sapiens
aaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcat

SEQ ID NO: 5336 - DNA, 531 bp, Homo sapiens
gcacagttgaatcaacagaagatgctggtgtccgaaatagaaatgaaacagagcaaaatggacgagtgtcaaaaatatgcagaacagtactcagctacagtgaaggactatgaattacaaacaatgacctaccgggccatggtagattcacaacaaaaatctccagtgaaacgccgaagaatgcagagttcagcagatctcattattcaagagttcatggacctaaggactcgatatactgccctggtcactctcatgacacaatatattaaatttgctggtgattcattgaagaggctggaagaggaggagatagctaagaacaagcagtatgatatgcatacagaagtcacaacattaaaacaagaaaagaacccagttcccagtgctgaagaatggatgcttgaagggtgcagagcatctggtggactcaagaaaggggatttccttaagaagggcttagaaccagagaccttccagaactttgatggtgatcatgcatgttcagtcagggatgatgaatttaaattc

SEQ ID NO: 5337 - DNA, 566 bp, Homo sapiens
aaaacaacaagcaacaagaggaagccgcaggcgacaagaggaggagtgcgcgtgttgggggcccccggagaggtgatctttagacagtgactgagtatggatcatttgaacgaggcaacctcaggggaaagaacattcagaaatgtctaacaatgtgagtgatccgaagggtccaccagccaagattgcccgcctggagcagaacgggagcccgctaggaagaggaaggcttgggagtacaggtgcaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgct

SEQ ID NO: 5338 - DNA, 463 bp, Homo sapiens
gttaggcgccattttcgagtgaaggacccggagccgaaacaccgggtgaagttgaaccaattgctatgatgaaaccaaaaggccagactgaacacgatgagggtatgcttgaatatttagaagatataattggttgtggacggctaaatgaacctattaaagtcttgtgtcggagagttgaaatattaaatgaacacagaggagagaagttaaacagggtaaagatggtggaaaaggaaaaggatgccttagaaggagagaaaaacatagctatcgaatttcttaccttggaaaatgaaatatttagaaaaaagaatcatgtttgtcaatattatatttatgagttgcagaaacgaattgctgaaatggaaactcaaaaggaaaaaattcatgaagataccaaagaaattaatgagaagagcaatatactatcaaatgaaatgaaagctaagaataaagatgt

SEQ ID NO: 5339 - DNA, 581 bp, Homo sapiens
atgaaacgttccaaatacaccaaaagtggagagtacggtaggagcagctccatcgtgcccgcgggacagcagacgatagcaatcgattctccgtgctgggaatcccgccaccctgggcggatggcgctgaattcttgggaaccctctcctgcccctttcactcctgtaccacgtgtgactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccaatacagctgcgccctgaccggccctgtggtggacatcgtcaccggacatgctcggctctcggacatctgggccaagactccacctt

SEQ ID NO: 5340 - DNA, 576 bp, Homo sapiens
  misc_feature (1)..(1): n is a, c, g, or t
ntccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccaaaggttgagcagaaaattgaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgc

SEQ ID NO: 5341 - DNA, 550 bp, Homo sapiens
acacagtgatttctgttatggcggttgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacatccccgaggtgtgcgaagccaccaatctcatataagaactacagctcatcaggaggagatcgcagcagggtaagagacaccaacaccatgttctgcacgaagctcaaggatctcaagatcacaggagagtgttctttctccttactggcaccaggtcaagttcctaacgagtcttcagaggaggcagcaggaagctcagagagctgcaaagcaaccgtgcccatctgtcaagacattcctgagaag

SEQ ID NO: 5342 - DNA, 575 bp, Homo sapiens
agggcctggaaggcgccagccgggccggcgggcggtgtgattgatccgcgtcccctggagctggaggctcgggggaaagggccagcacggagcgggcagctcggttgctgcgcacaaaggctgaggctccaagagctgcagggcgtgtttggggtgcgcgcagaggttgtgtgcaagaccccagagtcagaaggagtgagaaccctgacccctaatcccactgcatccagccaataggagcccagccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccccttgggatatcagtacccatctctggacc

SEQ ID NO: 5343 - DNA, 565 bp, Homo sapiens
agtgtgaaatcttcagagaagaatttctctttagttctttgcaagaaggtagagataaagggaaggtgtggatgaagcaaccatcattgacattctaactaagcgaaacaatgcacagcgtcaacagatcaaagcagcatatctccaggaaacaggaaaggtaagttagagtggtaaatttagatatttaatttcagcatagttatacttaaccatggattcggaagcacagttacctagttctttaaggttctaaccactgttttctcattacatctatgattgggattgcagtgtttatccactttgttgcaatttaatcaattttatcaaatttcctatttttatacattagtcatcttggtgtatattgtttgcagatgtggtgctctggggacaaatttttaatttgaacgtaaacatcgagattgctgctgtcaataaagaatatggtctgattgaaatgtactaatatttaaactgaactgtttaatgcctaaattttatatataattctactttaaaaataagccttatgtcttttataccaaatatgagtagtttt

SEQ ID NO: 5344 - DNA, 537 bp, Homo sapiens
gtaatctcagcagttttgggaggctgaggagagtagatcacctgagctcaggagtttgagatcagcttatatagatggggaaactcccacctccctaagctaagaggcgttctatcacagtgtgtattttcatcacgagcacacatttttatttacctttcctcttatgaactgtggacttcttacaagatctcattagcaatgtgggctttctcatgtccctgcggctccgtggatgttcccaagcttactggttttggagtcttgcacagcctccttaacgtgaagacaatgaggatgaagacttttatgatgagccacttccactaaacgaatagccaccatggcggagctgcaggaggtgcagatcacagaggagaagccactgttgccaggacagacgcttgaggcggccaagactcactctgtggagacaccatacggctctgtcactttcactgtctatggcacccccaaacccaaacgcccagcgatccttacctaccacgatgtgggactcaactacaaatcttgctt

SEQ ID NO: 5345 - DNA, 552 bp, Homo sapiens
agacgggatgctatctggaaagggctcgggacgatggctcagcattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgcc

SEQ ID NO: 5346 - DNA, 555 bp, Homo sapiens
aggtatctaccctgactacccgtgccaacctttggcttcttgggcccttctttttcgcgtcctccaaagaaagtttctctacaataattggagttggtgttggaactggagcctacatcctggcgagatatgctgtaagaaataaaaagcccagaggagggaaaggagggtccagactgattaggagaatactgtttattagtgctgtttgggggaggaagtgggcactaggtggggagtcaggccctgtgggagtccaggagtgggtcgagcttagcggggaggggataaggccatgccctgtttctcatttccttccttctgctgtccctcagcttaaccacccggacactgttgaaggtcttgtcctcatcaacattgatcccaatgccaagggttggatggattgggcagcccacaaggtttggaggggcctgtgtgctgagacctacggttggggatcccctcgtatggatccagttaggctctggtagatagcctaactggatggactctgaacttcaaggagggagtaaaggggcaggaaagtgaagc

SEQ ID NO: 5347 - DNA, 456 bp, Homo sapiens
  misc_feature (397)..(397): n is a, c, g, or t
aatcggacacgatcagcagggagaacacatgtgtttttatgagaattacgctgagataggtaacagatgaggatgaaatttgggcttgactgaagtaatgggggctgtctgtgaagccttgcggcagtacagcccaggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctntagcatttcagagagtaacatggactacacagccaccatatacctccgacagcgctgga

SEQ ID NO: 5348 - DNA, 575 bp, Homo sapiens
gtttttaagacactagctctccagcagaaagctggggatagacttcagtttctctacaataattggagttggtgttggagctggagcctacatcctggcgagatatgctcttaaccacccggacactgttgaaggtcttgtcctcatcaacattgatcccaatgccaagggttggatggattgggcagcccacaaggtttggaggggcctgtgtgctgagacctacggttggggatcccctcgtatggatccagttaggctctggtagatagcctaactggatggactctgaacttcaaggagggagtaaaggggcaggaaagtgaagctgtcactttgcctgagtctcttataatatcctgaactttctttttctttttctttttcttttttttttttttgagatggtgtctcactctgttgccaaggctggagtgcagtggcttgatcttggctcactgcaacctctgcttcctgggttcaagtgattctcctgcctcagcctcccaagtagctgggattacaggcacccgccaccacgcctggctaatatttgtattattagtagagatggg

SEQ ID NO: 5349 - DNA, 602 bp, Homo sapiens
agtgacccagaggcggtgtgaggcggagggaccgtcggggggcgccgccgccgcctccactagcagcagcggcagcagccctagtcccgcggtgcggtcgaattggtccccagccctccgggagcgcaccacaaagcagccccaacgcctctccctgcgtccgcggctcctcagcgctcggctccgtggtcaacttcccctcgctgggctcggctggcgggcgcggagggcagcggcggaacggcgggctgtctgctcgcgctccccgcgcacaacacttcaccctctcgcctcgggtctcgggggccgctctgggatcccggccaccagcaattgtccggaaataatgcaaaaggtgtcccaaggctcctgaccagtgaacaaagatttgagaaagacagccaagctcatgttttctcctgatcaagaaaatcatccatctaaagcaccagtaaaatatggtgaactcattgtcttaggaagtgaagctggacaaggtttcatgctgttgctgcttagaaaagagctttgaactacaggaacgcaatgtgggactaaagagcaagatccagaagtgggatgagtcatgcaactcagaggac

SEQ ID NO: 5350 - DNA, 566 bp, Homo sapiens
gaacaccacccagtgtggagcagcccagccaagcactgtcaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactggtgaggcctgtgggagataagggggagaggggagcagtgtgttgctcagtaacttccaggaccatcctcactatccaaggagatgatgggatgaagttttg

SEQ ID NO: 5351 - DNA, 575 bp, Homo sapiens
acagtcctcggcccaggccaagcaagcttctatctgcacctgctctcaatcctgctctcaccatgagcctccgcctgcagagctcctctgccagctatggaggtggtttcgggggtggctcttgccagctgggaggaggccgtggtgtctctacctgttcaactcggtttgtgtctgggggatcagctgggggctatggaggcggcgtgagctgtggttttggtggaggggctggtagtggctttggaggtggctatggaggtggccttggaggtggctatggaggtggccttggaggtggctttggtgggggttttgctggtggctttgttgactttggtgcgctgacctggaggtgaagatccgtgactggcacctgaagcagagcccagctagccctgagcgggactacagcccctactacaagaccattgaagagctccgggacaagatcctgaccgccaccattgaaaacaaccgggtcatcctggagattgacaatgccaggctggctgtggacgacttcaggctcaagtatgagaatgagctggccctgcgccagagcgtggaggccg

SEQ ID NO: 5352 - DNA, 576 bp, Homo sapiens
cattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaagcaacatcagagctggatctagaaatggaagctcttaaaaccgtgtataagtcaggggaaacgattgtggtcacctgtgctgtttttaacaatgaggtggttgaccttcaatggacttaccctggagaagt

SEQ ID NO: 5353 - DNA, 577 bp, Homo sapiens
gacagtctgaaatactctctggtgccaacctccaaattctcgtctgtcacttcagacccccactagttgacagagcagcagaatttcaactccagtagacttgaatatgcctctgggcaaagaagcagagctaacgaggaaagggatttaaagagtttttcttgggtgtttgtcaaacttttattccctgtctgtgtgcagaggggattcaacttcaatttttctgcagtggctctgggtccagccccttacttaaagaagcctgaaggtcctgtcctgaggaaggaacttagataaaacaaatataagtttcacactttaagaccaggagggtcaacttctatgtttttcaaaaagatctgtctgtgggactattggatctggaaagcatgaagactgggctttttttcctatgtctcttgggaactgcagctgcaatcccgacaaatgcaagattattatctgatcattccaaaccaactgctgaaacggtagcacctgacaacactgcaatccccagtttaagggctgaagctgaagaaaatgaaaaagaaacagcagtatccacagaagacga

SEQ ID NO: 5354 - DNA, 579 bp, Homo sapiens
tgagagattttaaaggggatctagtgaatgtcaccagccttttcttaatgtccaggccttttcttctctgggcttgtttgaggcaccagtgacaggcttttggagccttcattttgccctacattacatatttgtctccttactctccagagattcaacttacaaactactaaaatctgtgtgtggacacttagaaaatacaagtgttggtaacagtcccaatccatcttctgctgaaaacagtctccgagcagaccgcccttcatctctgcctctggatttcaatgatgaattctcagatctggatggagtggttcaacaaagaaggcaagacatggaaggatatagcagttctggttctcaaactcctgaatctgagaactctcgagatttccatgcgacagaatcccaaacagttctgaatgcctccaagggagaagcaaagccaactcgggcagatgcccatgtgaacagagtacctgaaggaaaagccaagagtctccctgtacagggtctgtcagaaactgttggaatcttacataaagtcaagtctcagaaatgtccgatgcttcaccatat

SEQ ID NO: 5355 - DNA, 541 bp, Homo sapiens
  misc_feature (161)..(161): n is a, c, g, or t
atcctgtctgtccgaacccagacacaagtcttcactccttcctgcgagccctgaggaagccttctttccccagacatggccaacaagggtccttcctatggcatgagccgcgaagtgcagtccaaaatcgagaagaagtatgacgaggagctggaggagcnggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcatcataccaatcgtgggggtggtgaaggagccaggggttcattcatggttggtttctgatcaggcatcttgggaatggataatggaggcag

SEQ ID NO: 5356 - DNA, 570 bp, Homo sapiens
aactgagcgaggagcaattgattaatagctcggcgaggggactcactgactgttataataacactacaccagcaactcctggcttcccagcagccggaacacagacaggagagagtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcactttccccagcttcaaccacagcctcattcagcgtcacctctg

SEQ ID NO: 5357 - DNA, 598 bp, Homo sapiens
attgtccccaggtccactgaaaagggcaagcaccctgtaaatgagtttccctcctgctcttgctgggtggaggagataggcagaggtttagcccttaaaaagacatggctaggatatccagccctagtggcctgagaatacagcaagatggtatttaacttactgctagatccttggcgactggcatggtgcctggcatatccgaggtcctgatgaatgtttgctgaatgaagagctgaatagatgagtgatgagccctggctgcgagtgtgccccctgagtggagccgctccctggttctctggttctcttccatctcctccccctgacttctccaatcctggctctttctctgcagacggagctgtcactgcaaaaggagcagctgcagctcaagatcattgagattgaggatgaagctgagaagtggcagaaggagaaggaccgcatcaagagcttcaccaccaatgagaaggccatcctggagcaggatgctgtggaccaagtgaaggtgatcatggatgctctggatgagagagccaaggtgctgcatgaggacaagcagacccgggagcagctgcatagcatcagcgactct

SEQ ID NO: 5358 - DNA, 566 bp, Homo sapiens
gaacatcttctgacacactgacagtgctgagcagagcaaggttgggttcgctcctctggcagaacctcggctctcaggaggtccttgttccagggaacagctgcttctctggggctgggctctactccctgcagcccctcgcactacccagctggaaccagggacaacgcctgagtccaaccctcgtgtctattttccagaaaacgggcaatgctgtgagagccattggaagactgtcctctatggcaatgatctcagggctcagtggcaggaaatcctcaacagggtcaccaaccagcccgctcaatgcagaaaaactagaatctgaagaaatgacctggtcttcttctctgtcttctagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagataga

SEQ ID NO: 5359 - DNA, 547 bp, Homo sapiens
gacaatgatttcctcagtgattacgtacagagcagagtccctgcgggttaggggccccctctggagccatcctgatggctttgggggccttgcttccattttccattattatgtggactaccggagcgacagcgcagtccaagaccttgcagtttctttcagggctgaattgaaacaacttcagctgtttgcttttaggatgtctcgccgcaagcaagcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggctt

SEQ ID NO: 5360 - DNA, 554 bp, Homo sapiens
agccggccggcggaagaacctagagcgcgctgcctggcgagtcaggcgcgcggggcggcgttggtggtctccgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccagattaatactgaggaacacgtggatgcagctgatcaggaggttatcttgtgggatcataagattcctgaggatatcctaaaggaagtaactactcctaaagaggtaccagcagaaagtgttactgtctggattgacccacttgatgctacacaggaatatacagaggatcttcgaaagtacgtcactactatggtgtgtgtggctgtaaatggtaaacccatgctaggagttatacataagccattttccgaatatacagcttgggcaatggtagatggtggttcaaatgtgaaagcccgctcttcctacaatgagaagacc

SEQ ID NO: 5361 - DNA, 544 bp, Homo sapiens
gaatcttaccaagctgaaaaacaagcatgaatctatgatttcagaactggaagtgcgacttccacgagcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcagggccaagagggagcaggaggtgacggtgctgaagaaggccctggatgaagagacgcggtcccatgaggctcaggtccaggagatgaggcagaaacacgcacaggcggtggaggagctcacagagcagcttgagcagttcaagagggccaaggcgaacctagacaagaataagcagacgctggagaaagagaacacaga

SEQ ID NO: 5362 - DNA, 541 bp, Homo sapiens
gagtgcaggcaggctgacaatgatttcctcagtgattacgtacagagcgagtccctgcgggttaggggccccctctggagccatcctgatggctttgggggccttgcttccattttccattattatgtggactaccggagcgacagcgcagtccaagaccttgcaggatgtctcgccgcaagcaagcgaaaccgagatccctcaaaggtgtgggacttctaaatatgtcacgaaacctagaaggctagttaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaag

SEQ ID NO: 5363 - DNA, 555 bp, Homo sapiens
gaaaaagcttattagctgctgtacggtaaaactccttctttctgcaacatggggaagaacaaactccttcatccaagtctggttcttctcctcttggtcctcctgcccacagacgcctcagtctctggaaaaccagcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggacgaaaactttcaccccctgaatgagttgattccactagtatacattcagga

SEQ ID NO: 5364 - DNA, 547 bp, Homo sapiens
ttaaccttgactataaataggccatcaatgacctttccagagaatgttcagagacctcaactttgtttagagatcttgtgtgggtggaacttcctgtttgcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctaagtgattcctgtccatgccaactttccctgctgagaacaagggagtgaaggtcccaaagtcttc

SEQ ID NO: 5365 - DNA, 585 bp, Homo sapiens
aatctatgatttcagaactggaagtgcggctaaagaaggaagagaagagccgacaggagctggagaagctgaaacggaagctggagggtgatgccagcgacttccacgagcagatcgctgacctccaggcgcagatcgcagagctcaagatgcagctggccaagaaggaggaggagctgcaggcggccctggccaggcttgacgatgaaatcgctcagaagaacaatgccctgaagaagatccgggagctggagggccacatctcagacctccaggaggacctggactcagagcgggccgccaggaacaaggctgaaaagcagaagcgagacctcggcgaggagctggaggccctaaagacagagctggaagacacactggacagcacagccactcagcaggagctcaggccaaggcgaacctagacaagaataagcagacgctggagaaagagaacacagacctggccggggagctgcgggtcctgggccaggccaagcaggaggtggaacataagaagaagaagctggaggcgcaggtgcaggagctgcagtccaagtgcagcgatggggagcgggcccgggc

SEQ ID NO: 5366 - DNA, 570 bp, Homo sapiens
agtcccgctccgtcctcctcgcctgccaccggtgcacccagtccgctcacccagcccagtccgtccggtcctcaccgcctgccggccggcccaccccccaccgcagccatggacgccatcaagaagaagatgcagatgctgaagctggacaaggagaacgccatcgaccgcgccgagcaggccgaagccgacaagaagcaagctgaggaccgctgcaagcagctggaggaggagcagcaggccctccagaagaagctgaaggggacagaggatgaggtggaaaagtattctgaatccgtgaaggaggcccaggagaaactggagcaggccgagaagaaggccactgataggaatgaaggtcatcgaaaaccgggccatgaaggatgaggagaagatggaactgcaggagatgcagctgaaggaggccaagcacatcgctgaggattcagaccgcaaatatgaagaggtggccaggaagctggtgatcctggaaggagagctggagcgctcggaggagagggctgaggtggccgagaggtaaagatacccgggggtgacaagtgagcccat

SEQ ID NO: 5367 - DNA, 783 bp, Homo sapiens
  misc_feature (719)..(719): n is a, c, g, or t
  misc_feature (745)..(745): n is a, c, g, or t
  misc_feature (761)..(761): n is a, c, g, or t
gcaagtgaaggtggaagcggccgcggcggcagcaggccaccatggcggagctgcaggaggtgcagatcacagaggagaagccactgttgccaggacagacgcctgaggcggccaagactcactctgtggagacaccatacggctctgtcactttcactgtctatggcacccccaaacccaaacgcccagcgatccttacctaccacgatgtgggactcaactataaatcttgcttccagccactgtttcagttcgaggacatgcaggaaatcattcagaactttgtgcgggttcatgtggatgcccctggaatggaagagggagcccctgtgttccctttgggatatcagtacccatctctggaccagcttgcagacatgatcccttgcgtcctgcagtacctaaatttctctacaataattggagttggtgttggagctggagcctacatcctggcgagatatgctcttaaccacccggacactgttgaaggtcttgtcctcatcaacattgatcccaatgccaagggttggatggattgggcagcccacaagctaacaggcctcacctcttccattccggagatgatccttggacatcttttcagccaggaagagctctctggaaattctgagttgatacaaaagtacagaaatatcattacacatgcacccaacctggataacattgaattgtactggaacagctacaacaaccgncgagacctgaacttttgagcgtggangtgatatcaccctcangtgtcctgtgatgctggtggta

SEQ ID NO: 5368 - DNA, 410 bp, Homo sapiens
  misc_feature (21)..(21): n is a, c, g, or t
  misc_feature (127)..(127): n is a, c, g, or t
  misc_feature (189)..(189): n is a, c, g, or t
  misc_feature (194)..(194): n is a, c, g, or t
  misc_feature (220)..(220): n is a, c, g, or t
ggggaggggcggcgggcgganacgacggggtagcatacgataagacaccccaccacccccccccacccccccacacctcggatgcgggctttggcagggtttgcgaattaatggtgtagcattcggntatccctgggggttgcagctttgtataagttttcggtgtgggggctggattcaaaagaaaangaagngcatacgcagatttctaccagaaacntacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaac

SEQ ID NO: 5369 - DNA, 1224 bp, Homo sapiens
gtgtggagcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgggatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaatttatgccttcagttcttttccaaatcattcctagccaaaagctctgactcgttacctatgtgttttttaataaatttgaaataggctactggtaaaaaaaaaaaaaaaa

SEQ ID NO: 5370 - DNA, 551 bp, Homo sapiens
gacacacatgcacacacgcacacgcgggcgcacacacacacacaccatcctggacggcgttcaagtcaagcacgagaaacagccttctgcaagggagaggaaagaaagctggaaatccagacagactgaagggctgcctgcttttagacttgactttgaccgccttttcttctcgggccaagaactgtggcagtgcagaaattacaattaaaaaatacataagactactcccggattgctttttttttttttttttaactaaacacaaaaagcgacaccaaaacaacccctgagaaaatccacaaatctgtacctgagacacgtcaagtcagcggcccagggttctgttacagactcaagatctcttttatttaatgcaatacagtgcgatggatgaatttcacccattcatcgaggcacttcttccacatgtccgtgcaattgcctatacttggttcaacctgcaggctcgaaaacgcaagtactttaaaaagcatgagaagcgaatgtcaaaggatggagaaagagcagtcaaagatgagcttctcagt

SEQ ID NO: 5371 - DNA, 534 bp, Homo sapiens
gcacgaggcagtgtgataaggattggcctacatgtagtccagcaagccaccgctgatgttttcttgattaggtgtcttatcttccattgagctgcatctgatgaaggttgctgacagcataatggctgggaaaacgtcggacagctccataaaatggcagctatgttatgacatgtcagccaggacctggtggatggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgaca

SEQ ID NO: 5372 - DNA, 720 bp, Homo sapiens
  misc_feature (674)..(674): n is a, c, g, or t
gcacgaggctgcgatcgccactcccggatcctgctgcagtgttggcggcggtaaccttgaactttaccagcgcggtgacacattctcctcgctttccccaccgcctggcctcctgcgcccccctccccgcctttttttaaaaaaagcatttcaccacccaccatcaccccaatccaacccacaccgaaccctcgcgcaccccaacccccaacaacaaacaacaacaacaacaactgcaaaacagaaaacaaatcccctaaaccaggcgaccagcagcctgcaccagcggcggcagcctcggagagctcggccggcgcgcgcgaaccgcaagagggttaaaagtgtagattggatttcaccccgggaaatctagctcgccgagtgaacttgaatctttggctatttaaagaggactgggtttgttgcgaagttgcggtgaaccggcgcagtgccccgtcctgattgatcgcatcgctgggctcagatgactgtaaaatgaatagatgaaatccttgcttctggaagattttcttgggcatctccgggaaagtgcgttttaaggcgaagtcatgatgtattctcccatctgtctcactcaagatgaattccacccatttattgaggcacttcttcctcacgtccgtgcaattgcctatacttggttcaacctgcangctcgaaaacgcagtactttaaaaagcatgagaaacgaatgtcgaa

SEQ ID NO: 5373 - DNA, 533 bp, Homo sapiens
  misc_feature (523)..(523): n is a, c, g, or t
gcacgagggcaagatccaaggtgaaaacagtgaggtaaagagacagggctaaaagcaaatggtgagaggagcaggaagagatgggccccagaatttaaaggatgagatggggagtaagggaagagagggggctaagagaagctgggggagtcctgatggatgtagaactggggtagactgcaggggggtgggaatcgaatgtgcgtgttatggggagttgctccagaaggtctgcaagggtcagggcagaaatgctgtagtgaaagatcaagtgtaagagagcctttggtgcagaagacgaggaaccatgattctttggatgggaagagaccttgaaaggacctctagtttatcctgcaactccagtcaatatcccacttaaatcattccaggtaatagagaagaggaaacctaaccaatgactgtggaataatatggaagaagatggaaaaaacttgtttaatgggttgagaaagtggcgacttctataagacatggatagatgcaaacatgtaggggcggntacggctcgc

SEQ ID NO: 5374 - DNA, 693 bp, Homo sapiens
  misc_feature (36)..(36): n is a, c, g, or t
  misc_feature (637)..(637): n is a, c, g, or t
acccgaattcggcaccagcctggatcttgggtgggngtcagtgtctacaagcctaacttcattcgcgttggcttggttgtttggaaagtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcaggtgtactcatctcagangaagtcctggcaccctgtgtgccaagacgactggaacgagaactaccggcgggcgg

SEQ ID NO: 5375 - DNA, 790 bp, Homo sapiens
  misc_feature (514)..(514): n is a, c, g, or t
  misc_feature (538)..(538): n is a, c, g, or t
  misc_feature (668)..(668): n is a, c, g, or t
  misc_feature (698)..(698): n is a, c, g, or t
  misc_feature (713)..(713): n is a, c, g, or t
  misc_feature (764)..(764): n is a, c, g, or t
  misc_feature (768)..(768): n is a, c, g, or t
tggccatctcgggcaggggagccccacacccggcaggaaagaccaggacgcgagcggcggcgcctcggccctgggctgtttaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactggttcttggaaagcaccctctggaacaagccgtggtactgattatgaagtttgcattgaaaacaggtcccgttcttgttatcagttggagaaaaccagtattaaaattccagctctttcacatgggtgattatgaaataacaataaattctctacatgattttggaagttctacaagtaaaattcacactaaatgaacaaaacgtttccttaattccanatactccacagatcttgaatttgnctgctggatttctcaacctctacattatacctaaagtggaacgacaggggttcagtttttccacaccgctcaaatgttatctgggaaattaaagttctacgtaaagaaagtatgggagctcgtaaattantgacccacaccacacctctgaatggcaaanaacacttcatcactngggttgggcctcaaaatgcccttgggatgggccattctttggggaattaangctncttgacaatcttctttttctgg

SEQ ID NO: 5376 - DNA, 838 bp, Homo sapiens
  misc_feature (401)..(401): n is a, c, g, or t
  misc_feature (525)..(525): n is a, c, g, or t
  misc_feature (563)..(563): n is a, c, g, or t
  misc_feature (580)..(580): n is a, c, g, or t
  misc_feature (591)..(591): n is a, c, g, or t
  misc_feature (622)..(622): n is a, c, g, or t
  misc_feature (627)..(627): n is a, c, g, or t
  misc_feature (656)..(656): n is a, c, g, or t
  misc_feature (662)..(663): n is a, c, g, or t
  misc_feature (674)..(674): n is a, c, g, or t
  misc_feature (676)..(676): n is a, c, g, or t
  misc_feature (679)..(679): n is a, c, g, or t
  misc_feature (691)..(691): n is a, c, g, or t
  misc_feature (693)..(693): n is a, c, g, or t
  misc_feature (705)..(706): n is a, c, g, or t
  misc_feature (710)..(710): n is a, c, g, or t
  misc_feature (715)..(716): n is a, c, g, or t
  misc_feature (719)..(719): n is a, c, g, or t
  misc_feature (738)..(738): n is a, c, g, or t
  misc_feature (748)..(748): n is a, c, g, or t
  misc_feature (750)..(750): n is a, c, g, or t
  misc_feature (759)..(759): n is a, c, g, or t
  misc_feature (773)..(773): n is a, c, g, or t
  misc_feature (782)..(782): n is a, c, g, or t
  misc_feature (790)..(790): n is a, c, g, or t
  misc_feature (794)..(795): n is a, c, g, or t
  misc_feature (799)..(799): n is a, c, g, or t
  misc_feature (804)..(805): n is a, c, g, or t
  misc_feature (807)..(807): n is a, c, g, or t
  misc_feature (813)..(813): n is a, c, g, or t
  misc_feature (815)..(815): n is a, c, g, or t
  misc_feature (818)..(818): n is a, c, g, or t
ttctctggggctgggctctactccctgcagcccctcgcactacccagctggaaccagggacaacgcctgagtccaaccctcgtgtctattttccagaaaacgggcaatgctgtgaagagccattggaagactgtcctctatggcaatgatctcagggctcagtggcaggaaatcctcaacagggtcaccaaccagcccgctcaatgcagaaaaactagaatctgaagaagagtgaaacaaagccagagaaaagcagtttctaagtcatattaaaaggactatttctctaaaactcaaaaaaaaaaaaaaaaactcaagatagtaaaagcacctagtgtgatagatttatcggttaggtcatttgtgggttgattcttcagaaacagcagttgatacctagncagcgttttgatgggcattaatctatgttagttggcaccttaagatactagtgcagctagatttattttagggaaatcaccagtaacttgactgaccaattgattttagagagaaggttaccancccaatttttatctggggcaaggtcattaaatttctcncttgaatgccgctcaanaaaaaataagnccaaaacaagagttctggggccccagctcancccanagggttcctggggatggggggcctttctntccccnnccccggctctnanaantgggtttttccnanactccaccaatnntttncgaanncgngggcccttttttccaagancctggagaantnaaactttcnttttttttcccttncacctgccntttggtgntctnncctncttgnngnaacctnangantttttccttttcgatttgag

SEQ ID NO: 5377 - DNA, 721 bp, Homo sapiens
  misc_feature (539)..(539): n is a, c, g, or t
caccaggtagccgctgccctccgcgcctgtccccgcgcggcccccacgccagacggccctccctcggggcgcgctcgcagacggagatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctgnaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaagctgcagataaaatttatttcatgcccctggactccctat

SEQ ID NO: 5378 - DNA, 794 bp, Homo sapiens
cggggcgctcgagtaggacccgacgccaaggggagggggctgacctgtgcttggtccaccccaggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcc

SEQ ID NO: 5379 - DNA, 637 bp, Homo sapiens
acacaaatgaaatcacatatgcagacctgaacctgcccaaggggaagaagcctgctccccttcctgcggagcccaacaaccacacggagtatgccagcattcagaccagcccgcagcccgcgtcggaggacaccctcacctatgctgacctggacatggtccacctcaaccggacccccaagcagccggcccccaagcctgagccgtccttctcagagtacgccagcgtccaggtcccgaggaagtgaatgggaccgtggtttgctctagcacccatctctacgcgctttcttgtcccacagggagccgccgtgatgagcacagccaacccagttcccggagggctggggcggtgcaggctctgggacccaggggccagggtggctcttctctccccacccctccttggctctccagcacttcctgggcagccacggccccctccccccacattgccactccctggagacacagccttctggctgggactgacttggccatgttctcagctgagccacgcggctggtagtgcagccttctgtgaccccgctgtggtaagtccagcctgcccagggctgctgagggctgccctcttgaccgtgcagtcttatcgagacccaacgcctcagtctgctca

SEQ ID NO: 5380 - DNA, 1176 bp, Homo sapiens
tgcaagtgttattcgacaaaagcaattatgctaatttccttccctgtggctcaattccttttttgacacgatgacttggaggagtcattatgattactccaaacaggaaagacactcgcccagctgtccgcccgcagagagctggctacggtgcagaaagctgaggaggcgtctggagtttttgggtgttaatgattctgcctgcccacaggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttaggctgggctggtggagttggcacgagatgtcagaggaacctgagtcatgctcaggcccaagccctgttggcaggcagaccactgctttctggccttccgtgactatctgaaaaaaatcgtgaatggctagagctactcttcacttgctgaacattttcaaaaagaattgacacttgctgaacatttcttttcaattcagaacttctgatggattaaattgccttcttcctcgaaaaccctgggacccttccagatgggactaactggggaaagtggacaagttacaaacaaagaaactcaaaggaaagtcattggcactgatctctaagatgctatcacatgtgattggtggttgattttattaacaaattataagcaaagtactacaaaggtggctttaaaaagaaaataaagcaattcacagaaact

SEQ ID NO: 5381 - DNA, 375 bp, Homo sapiens
gagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtattgggagatcgatgggcaaacatctgtagatggacagaagaccgctgggttcttttacaagacatccttctcaaatggcaacgtcttactgaagaacagtgcctttttagtgcatggctttcagaa

SEQ ID NO: 5382 - DNA, 1399 bp, Homo sapiens
ggtgtctgtcaaactccagcaattgctgacattgtaatcctggtcgatggttcatggagtattggaagattcaacttcagactggttcggcatttcttggaaaacctggttacagcattcgatgtgggctcagagaagacacgaattggggtgaaaaacgcggatgtgaatgagctgcaggagatcgcctctgaaccagacagcactcatgtgtacaatgttgccgaattcgatctgatgcacacagttgtggagagtctgaccaggactctctgctctagagtggaagaacaggacagagaaattaaagcctcagcccatgccatcactgggccgcctacggagttgattacttctgaagtcactgccagaagctttatggttaactggactcatgccccaggaaatgtggaaaaatacagagttgtgtattatcctaccaggggtggaaaaccagacgaggtggtggtagatggaactgtatcttccacagtgttgaaaaacttgatgtctttaactgaatatcagatagcagtctttgcaatctatgcccacactgctagtgaaggcctacggggaactgaaactacacttgctttaccgatggcttctgaccttctactgtacgacgtgactgagaacagcatgcgagtcaaatgggatgcagtgcctggggcctcaggttacctgatcctttatgctcctctaacagagggcctggctggggatgaaaaagagatgaaaattggagagacccacacagatattgaattgagtgggttgttgcccaatacagaatacacagtcacagtttatgccatgtttggagaagaggccagtgatcctgttacgggacaagaaacaacattggctttaagtccaccaagaaacctgagaatctccaatgttggctctaacagtgctcgattaacctgggacccaacttcaagacagatcaatggttatcgaattgtatataacaatgcagatgggactgaaatcaatgaggttcagattttgcttaaactgtggagcaatggtttcagtttagatgatggagaattgagaccttacaatgaaccaacaaatgctcaatttctggagtctgttaagagaggccttacacctgaaatagtcagtacaccttcctctccagaagaggaggataaatcaatacttaatgcagttgttcttattgatgattcagtgccaacaacaaaaattcaaatcaggttagcagatgggagtcgtttgatacaaagattcaatagtacacacaggatcctggatgtccggaactttattgtacagtctcgtcctgaatttgccggctcttgactttattcttgtgacttcatttccgaataaagagctaacagatgaaaaaaaaaaaaaaaaa

SEQ ID NO: 5383 - DNA, 461 bp, Homo sapiens
  misc_feature (376)..(376): n is a, c, g, or t
  misc_feature (391)..(391): n is a, c, g, or t
  misc_feature (417)..(417): n is a, c, g, or t
  misc_feature (432)..(432): n is a, c, g, or t
  misc_feature (442)..(442): n is a, c, g, or t
cacagcgctgggctaggggcgcggcttgaactcgcctaaagagctgcgcctctcacccgtgccgccccagccgctgccgcctgcaccggacccggagccgccatgcccaagtgtcccaagtgcaacaaggaggtgtacttcgccgagagggtgacctctctgggcaaggactggcatcggcctgcctgaagtgcgagaaatgtgggaagacgctgacctctgggggccacgctgagcacgaaggcaaaccctactgcaaccacccctgctacgtagccatgtttgggcctaaaggctttgggcggggcggacgaagaagcccacacttttcaagtaaaccaaggtgggtggagaaccccatcctttggctgctttncaaggggccactgtnccaggcaaaattgccaaggccctttntcccccagaattgcnaaggggttcnccttggttggccccctaaa

SEQ ID NO: 5384 - DNA, 5610 bp, Homo sapiens
aacatttttgaaagatcactcagctttaacacaccttggctgggtctggataaaaaaaaagtgagcactgcaaatttctagaagaaaacatcaggagaagaaagagagagggggatttattcaaagttgtttccaattccttcaaaacctcaaaccaggtggctatggtatggatgtaaccaagaaaaacaaacgagatggaactgaagtcactgagagaattgtcactgaaacagtaaccacaagacttacatccttaccaccaaaaggcgggaccagcaatggctatgctaaaacagcctctcttggtggagggagccggctggagaaacaaagcctgactcatggcagcagcggctacataaactcaactggaagcacacgaggccatgcctccacctctagttacaggagggctcactcacctgcctccactctgcccaactccccaggctcaacctttgaaaggaaaactcacgttacccgccatgcgtatgaagggagctccagtggcaactcttctccggagtaccctcggaaggaatttgcatcttcttcaaccagaggacggagtcaaacacgagagagtgaaattcgagttcgactgcagagtgcgtccccatccacccgatggacagaattggatgatgttaagcgtttgctcaaggggagtcgatcggcaagtgtgagccccacccggaattcctccaacacactccccatccccaagaaaggcactgtggagaccaaaattgtgacagcgagctcccagtcggtgtcaggcacctacgatgcaacgatcctggatgccaaccttccctcccatgtgtggtcctccaccctgcccgcggggtcctccatggggacctatcacaacaacatgacaacccagagctcatccctcctcaacaccaatgcctactctgcgggatcagtcttcggagttccaaacaacatggcgtcctgctcacccactttgcaccctggactcagcacatcctcctcagtgtttggcatgcagaacaatctggcccccagcttgaccaccctgtcccatggcaccaccaccacttccacagcatatggggtgaagaaaaacatgccccagagtcctgcggctgtgaacactggcgtttccacctccgccgcctgcaccacaagtgtgcagagcgatgaccttttgcacaaggactgcaagttcctgatcctagagaaagacaacacacctgccaagaaggagatggagctgctcatcatgaccaaggacagcgggaaggtctttacagcctcccctgccagcatcgctgcaacttctttttcagaagacaccctaaaaaaagaaaagcaagctgcctacaatgctgactcaggcctaaaagccgaagctaatggagacctgaagactgtgtccacaaagggcaagaccaccactgcagatatccacagctacggcagcagtggtggtggtggcagtggaggaggtggcggtgttggtggcgctggcggcggcccttggggaccagcgccagcctggtgcccctgcggctcctgctgcagctggtggaagtggctgctgggcctgctgctcacctggctgctactcctggggctgctcttcggcctcattgctctggcggaggaggtgaggaagctgaaggcgcgtgtggatgagctggagaggatcaggaggagcatactgccctatggggacagcatggatagaatagaaaaggaccgcctccagggcatggcacccgcggcgggagcagacctggacaaaattgggctgcacagtgacagccaggaggagctctggatgttcgtgaggaagaagctaatgatggaacaggaaaatggaaatctccgaggaagccctggccctaaaggtgacatgggaagtccaggccctaaaggagatcgagggttccctgggactccaggtatccctgggcccttgggccacccaggtccacaaggaccaaagggtcaaaaaggcagcgtgggagatcctggcatggaaggccccatgggccagagagggcgagaaggccccatgggacctcgtggtgaggcagggcctcctggatctggagagaaaggggaaagaggggctgctggtgaaccaggtcctcatggcccacctggtgtcccaggttctgtgggtcccaaaggttccagcggctctcctggcccacagggccctccaggtcctgtaggtctccaagggctccgaggtgaagtaggacttcctggtgtcaaaggtgacaaaggaccaatgggaccaccaggacccaaaggtgaccagggtgagaaaggacctcgaggcctcacaggcgagcctggcatgagaggtttgcctggtgctgttggtgagcccggggctaaaggagcaatgggtcctgctggcccagacggacaccaaggcccaagaggtgaacaaggtcttactgggatgcctggaatccgtggcccaccaggaccttctggagacccaggaaagccaggtctcacaggaccccagggacctcagggacttcccggtacccctggccgaccaggaataaaaggtgaaccaggagctccaggcaagatcgtgacttcggaggggtcatcgatgctcactgtcccaggccccccaggacctcctggagccatgggacccccaggacctccaggtgccccaggccctgccggcccagctggtctcccaggacatcaagaagttcttaatttacaaggtcccccaggcccacccggcccacgcgggccaccagggccttccattccaggcccaccaggaccccgaggcccaccaggggagggtttgccaggcccaccaggcccaccaggatcgttcctgtccaactcagaaaccttcctctccggccccccaggcccacctggccccccaggtcccaagggagaccaaggtcccccaggccccagaggacaccaaggcgagcaaggcctcccaggtttctcaacctcagggtccagttctttcggactcaaccttcagggaccaccaggcccacctggcccccagggacccaaaggtgacaaaggtgatccaggtgttccaggggctcttggcattcctagtggtccttctgaagggggatcatcaagtaccatgtacgtgtcaggcccgccagggccccctgggccccctgggcctccgggctctatcagcagctctggccaggagattcagcagtacatctctgagtacatgcagagtgacagtattagatcttacctatccggagttcagggtcccccaggcccacctggtcccccaggacctgtcaccaccatcacaggcgagactttcgactactcagagctggcaagccacgttgtgagctacttacggacttcggggtacggtgtcagcttgttctcgtcctccatctcttctgaagacattctggctgtgctgcagcgggatgacgtgcgtcagtacctacgtcagtacttgatgggccctcggggtccgccagggccaccaggagccagtggagatgggtccctcctgtctttggactatgcagagctgagtagtcgcattctcagctacatgtcgagttctgggatcagcattgggcttcctggtcccccggggccccctggcttgccgggaacctcctatgaggagctcctctccttgctgcgagggtctgaattcagaggcatcgttggacccccaggtcccccgggtccaccagggatcccaggcaatgtgtggtccagcatcagcgtggaggacctctcgtcttacttacatactgccggcttgtcattcatcccaggccctccaggacctcctggtcccccagggcctcgagggcccccgggtgtctcaggagccctggcaacctatgcagctgaaaacagcgacagcttccggagcgagctgatcagctacctcacaagtcctgatgtgcgcagcttcattgttggccccccaggccctcctgggccgcagggaccccctggggacagccgcctcctgtccacggatgcctcccacagtcggggtagcagctcctcctcacacagctcatctgtcaggcggggcagctcctacagctcttccatgagcacaggaggaggtggtgcaggctccctgggtgcaggcggtgcctttggtgaagctgcaggagacaggggtccctatggcactgacatcggcccaggcggaggctatggggcagcagcagaaggcggcatgtatgctggcaatggcggactattgggagctgactttgctggagatctggattacaatgagctggctgtgagggtgtcagagagcatgcagcgtcagggcctactgcaagggatggcctacactgtccagggcccaccaggccagcctgggccacaggggccacccggcatcagcaaggtcttctctgcctacagcaacgtgactgcggacctcatggacttcttccaaacttatggagccattcaaggaccccctgggcaaaaaggagagatgggcactccaggacccaaaggtgacaggggccctgctgggccaccaggtcatcctgggccacctggccctcgaggacacaagggagaaaaaggagacaaaggtgaccaagtctatgctgggcggagaaggagaagaagtattgctgtcaagccgtgagctagccatggcaggacagctcctggaccaggtctcataatgcatgtggcacttaggtccaaggtctccagagggtgaaagctggagtctgtcaatgtcctactgagacagcacagccaacctagctagcaacatttgttttagtctgaacaatatatacttatagaattcagtcaaagatacacaatctgaaacagcttcatggggtggactctaacagtagttgcaatgttttagaatgagacttacttctctgctatctagatctgaactccttggcttctttacttagttcaagccccagcctaggaaagccagttacataaaagttggctcaggagtcttagagctttacctaaatatgagcccagaaaacggaggatgggggtggggcgccttcctggaggtgacacttgatgggggtgtgttctggttactgttctaaggctgtgccatcagctccttcctcccctgttcattctgcattctctagtcagttggctaagaagtgactcttgcaactaaaaaaattaagaaattcacttcccctctaggaggtgatgatagggtttctaatggttatatgtatatcacattcccatttgcttagaaagtctgattgtagctatgattgtccgtaggcccatactagagttcatggatatgttatactgaaccaggccagagcaaacagaaaaagaaggttgagggcaatggacaaggaaggaataaagggagaagagggaaaacagaaaacctgatgctggggacacagcatcagctcaagacgtcaccctccattctgcactcagaaaatggcacttgggggactgggcgcagttggtctttaaccacttttcaatgtctaaaaacatttgtttgtggtctataagatgaaacatcatttcaatcgtaaaatttcccattaaagaagtttttttttctaa

SEQ ID NO: 5385 - DNA, 7111 bp, Homo sapiens
gcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggttttgttttgtttcataagatcccactggatgggtagctgaaataaaggaaaagacagagaaaggggctgtggtgcttgttggttgatgctgccatgtaagctggactcctgggactgctgttggcttatcccgggaagtgctgcttatctggggttttctggtagatgtgggcggtgtttggaggctgtactatatgaagcctgcatatactgtgagctgtgattggggaacaccaatgcagaggtaactctcaggcagctaagcagcacctcaagaaaacatgttaaattaatgcttctcttcttacagtagttcaaatacaaaactgaaatgaaatcccattggattgtacttctcttctgaaaagtgtgctttttgaccctactggacatttattgacttaattgcttctgtttattaaaattgacctgcaaagttaaaaaaaaattaaagttgagaacaggtataagtgcacactgaatagtctaatctacatgtaacacatattttagtgtgattttctatactctaatcagcactgaattcagagggtttgactttttcatctataacacagtgactaaaagagttaagggtatatataccatcactttgggacttggtagtattattaaaaggttatttccttcactgtcaataaaagtccaaatgtttagcttaggtctgagagtcaaacaatgttaaggattgtcttaaagttccttagccagcaaaacaaaacaaaacaaaacaaacaaatgaaaaacgtttaaaaagaagaagaagaaaaaaaacaagaacaagcagcaacagctgttttgttggggctatagatttaagttaggcatagtcaatttcagaataactaagagtggaatatatgcatatggtgaaattataaccttgcccttttttatttgccctctgcgatccacctgctttttagaagtctgccgagtgagaaggccacagtatctcatgctgtttgcattacagaactgcagcttttctactctgaaaaggcctgggagcagaatggctggcctgctgtgagcaggagaggagattctaagaaggatagtcccccctacaacatactgtcatactgctgggttttcatgggtaggaaagcttgtcctgaccccagcagcaaagaggtggcaggtcgctaatgaatatatgctttataatgtccttcttcattgctgagagggcagccttagagctgtggatttctgcatcccccctgagtctgacccatggacacctgtttcattcactttagcatcacagtgacctttgtatgctctgttcagtctgtgtcaggcagtatgcttgtcctgaagagaggtttggctatccccaccccaccccaccccaccctgttccttttttatcaggaggacttcagagccaggcctgcagcattttgtttgaaaacacaatcagctctgacagttagacatgcacacagacgccatagctggattggaaacattgatgttttaaaaatttattttttttggaaatagttgcacaaatgctgcaatttagctttaaggttctatagatttttaactagtccaacacagtcagaaacattgttttgaatcctctgtaaaccaaggcattaatcttaataaaccaggatccatttaggtaccacttgatataaaaaggatatccataatgaatattttatactgcatcctttacattagccactaaatacgttattgcttgatgaagacctttcacagaatcctatggattgcagcatttcacttggctacttcatacccatgccttaaagaggggcagtttctcaaaagcagaaacatgccgccagttctcaagttttcctcctaactccatttgaatgtaagggcagctggcccccaatgtggggaggtccgaacattttctgaattcccattttcttgttcgcggctaaatgacagtttctgtcattacttagattccgatctttcccaaaggtgttgatttacaaagaggccagctaatagcagaaatcatgaccctgaaagagagatgaaattcaagctgtgagccaggcaggagctcagtatggcaaaggttcttgagaatcagccatttggtacaaaaaagatttttaaagcttttatgttataccatggagccatagaaaggctatggattgtttaagaactattttaaagtgttccagacccaaaaaggaaaaataaaaaaaaaggaatatttgtacccaacagctagaaggattgcaaggtagatttttgttttaaaatggagagaagtggacagataaggccatttaatatatcaaagatcagttgacatctcctagggaatgatgaaaacagcaggctattagaaaattatttcatatagttctcgtgttcttttcttttttttaatccctgaagggatgatcagtaacatagcttctcttttctgtactctagaccaccccttttcatcattttgctttttatgtctcccataagaaatgtgctttttagagcttcctaatgcatgtgttgcattattgcagcattagaaaaggagaggtagcatttttgctgaaatcgggcctgtcactctccaataaaggttctggcacttcaatgccaggcaggtctcctaaatgaacagaatgatctgtgtgagccgatgcctgcccttccagaggggccactgtccccagccgcagccaactgtgtcccacaggaatgggagcctaggtttccaaatcttgtgattctttaggagaaacatgaaacctggatttcgtgtgaaatgtcccgattgttaaaaagttggctcaattatttttaaaacattttgtaagccaacaaaagtctgtgggctgccagtttattacttttgtcttaaaacatgatcattgttctctcacggtatccttctgtcttcccgttgcaaattcacttttctttcttcctgacattgccattgagggctttgttaccacaagctaagaaactgagtttaacagcccagttatctgcaacatgtcaattacctttgctcctctcctgtgattcccaccatgctgtgaccctcagctgtctccctttgctgggaattctgcaccaatgtctcccctcaacccattccctggttggtcctactcccgtgtggccagagacatcctagcaaatccttcctcctattatatctgacactaatttcttttcaacagcgctcatgtctcttggcccagtcaggtgctgccaggtttagataggaaagtacatgtcccattttcatgggtgcccttaatgtggtccacgtcctatatcttattatatttactcatggctcaatgggggcctccagagaccctctcaggctgctgagctagactaaggaatgcatccaccgtcatcacatgagacactgactctgtgacgacaaaagtacaaacagtctgaggctaagaaaggttcatctcacaacaggaaaaacaaatctcaacacacattagagataattgattcaggggttttctctcccagtctcccagcagggactgatttcatttctgacccactaggttttctttccagaaataggtagcaaggacaagaactaaacaatcccagccccacccagcaacacagaacacaggagtttgcttttggcttctcactctccaagtaaccctgaattaggcccagaatggctgaggcttggagcatctcctcagacagagcagaggcgacacctcttcaggggtgtgtggagtaaatagctcgaagagctgaagacagaaaaccagtttcacgccaggtgcgagagagagcataatggagggaagcccgctttctctctcctcttcttttctctttatttctttagagcacttgacttttttttctctctctctctagtattctaaactgaccccatgaccaactgagaatttatttttgtttcattggttgtttcacagaattagaacacacacgactttttattcctccattgcaaaatggaatcaagatactacacaagacctgtgctttcttcctttgcatgatttacacctccgcctgttttggtgctagctgtctagaacttctctcttggtttgaatctgattccttcacactacactagaagtttatttcatcttgttttgtctagactccagatacagagggacagctggactgaggacaagcaattccatctagcatagggtctctcagggttggtgcatccagccacatgggcagggccagtcacatctagtctatgtccccagagcccttggagttgcgcagcttagctgacttgactccaaggaaattagtacagaagtaaccactctattaagtgtgttctgctatgttcacatgcctgtagtacctgcaaaccatgccaggttcatctaaagacataggggaagattaaggactcttttggacagaccatgaattgaatttgctgccaggtgctgccagactgaatttggctgacagaactcccagcccaggaaagttccatgacaatgactgtcgcagaaggaaatttcccactaaagtcagtccattttcaagttttggtcttcagagacaaaagaacgtcccagccacctgattttgatggtgaggtaactctaagttgaattcaggctagtgttgcagtatagctttggcatgttcatgagtgagcacccagaatgtgttgaaccaacccccacccctaactactgactatgactgcagtgggtttttatggggaaaaaaagtgtgaaaagcaaaaagaaaggaacagagattttttatcacctttattgtaagacagtccatttatgaattgagtataaacacatacaaagtaacaagagattcctaagaaacgcaaatccttgagtttcacgcacttcatgttcaaccatttgctgtaatccagaggcagcctgtgaatcattctcatgccctgttttttttttttttttcctataatgttctgggtttaaaagccatcttttccacattttctgtaaataatggataatcattttaaaaatttttatttttagtgctgttttaacaatgtagatagatcataaatgtacttgctgaattcaatcatttttaacaagccaataaagtttgataattcatctc

SEQ ID NO: 5386 - DNA, 8648 bp, Homo sapiens
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaaggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatggcccagaggttcccccaagaccgcctgataataatttggtatttggaggctcctgtgtcactgcaggaactaaaggaggctaaatccatgcctgatggaggagaagagttctatggttatctgcaaattctggccagacaacatcttgacgtcactccttagcttccataacctagccaagcaagaagttgcctttccaagacaaagcagtgtgctctaatgactaacccctcaaagtactatgccactttaactatagacccatctcctcgatcaatcaggatggcaagatggagctgaggagctcagcaacatcaagtctggagttggtctttaactcaactagctcgtttagacgtgtctgaacaccacatcacctgacagcacggggtggtttcccagtaaaatttacaaactcagctcaagggcagctgtgttgctttcctttccttgactgctgagaaactttttgacagggaacaatggaaacacaccttctgagctgaaacaaacaaacagaaacaaaacatactaaccagcaaaatccccaaatcatcaatcttgggttctcttgaagggcaggagtgtgttttatcttctcccgtcggagcaaacactatagatgtcctccctaaaattctgtcttccctagagcagccttgtaaattagctagggtcctagggttgaggcctaaatcaacttaaaattgtctctaaatatgtacctggatgtgtttgtacttgcagagcatgccctcttcatgtgcctagggctagtaactccctgtggcagaggcatgtaaagtattctgactttttttttttcaacttaattccatttccaatgaaatggatttttaaaaattttctccagagtgtgccatacttctccagctattatagttaatgtgtgtgtatccttgtgtatatgtgtgtttgtgtgtgcatatgtgttttcctagtggttacatgcttactaggcaattatgtaaataagcacagattcataggccagctaggcctgaggaaagaagacattataaagggagggagtattttaacattagctaaagctatcacacaaggcacccattctgctcccctcaacagccacagcccacttcgtccttgtcttaccaataaggggaaaggctggaggtgatatttttcacagaaccgcagaggttttgaacatatttgcaacattactttgagtacacatgagcaaaaattctgaattacatccaggaccccagaagctcattagatcaaagagtgcggggcccctcagagttaccagagattatctgcagacttcagtgcaatcgaatgaccatggtccattttgatggtcagaggtaggactgaaaaacgggtagaaacaattgctttagcgcttccttctgtactttgcctattaatgttttgtctttcaaaaatatattttctcctaattgtttaattggccaaataatggctgctttgggagttgtttgtatgccttggaaggccatggcctgcactttaaaaataagctaagtccattctgcccagcacgagcattaggacagagaatgcacttattttaggatccttaaaaattgcttcttttatggcacactgggttgacgactcatctcgtgggagccttcatggcacattgctgctgttctgcaggtcccaatacaattccttccccctctcagtgccacggcccccccattgctagctacacaatttgatatcatattcccttttcaactccaaaggagatgataagaagctatcaaataatgctttaaaaaagcaacttgagtttcttaaaagaaaggaaatgaatacatgctgcataattacatttaaaatgtaagccatgttattataagccgcactgagatgaagatttgttagcaaaccagtttcaagcacactcacagtgaagtaaaatcatgtttttagcatctgaccattgggtaatattattctttgttatcaaaagagaaatatcacccaagtatagtatacttagacctcctagaggaaacactccagtcctaagcttggtgtctgaaaagaaaaacaaaaataaagattatggatttaggtcagggagacagagtgatattctgaagactgtgtttactccctcatcatcggccaaccaagatggagttctgcatcctgcacatatcagacatttcagtccaatttcaccaaagcatcagtgatgttctagaagcatcccagcagatggaggatcctaatgtatttgttctgggtatttcccaaggcccagcctgactggagtgtgtgtaccaacaggatgaatccaatcaagctacgcccccattttggtttcggattggccactcttgcatgtgctagtagattgtggaccaggaccagctgagcaaacacagttgcagagtagcctcctatgttgctaagaagctcctgctacccaggtgctttgaacaattgagtgctccctctggttaagtagagatggcaccaccggagtttttcttggatgtgaggctcaatcctttacggcagctattataacaaagtgaaggttttctccctgggaaatgcagcttttctctgtctttactaattctgccagcctgtgagagtaaccaccgtagctgggcttcttctcagattaattgtcatgccaggtctccttcctggggagctgtgatgctgctctgaggttgattgctgaggttgtagtgggtttttgtttgtttttgtttagtttttcttgattgttcttctttctcttgaatggcaagagaagaaacactttctctaacccacggccaggaaggaaatggggagagagctacttcttagttcaacctggttgccacataaaggaatctctctccttggactcagcccctaactggaagcaagagccactgccctctgagactgagagagcagcccgaggaggagatgaatccattctgccctttgtttgggtttgcttcctgtcagtgagagaatgctgaggcagttcctgttatgtgaaactttcatttttaaaaccaggacagtcctaaacagactggaatgagttggtcaatcccagttggtataggcccaatgatttttgctagtaagataggattgtcttcctcacccaaaatgccttcaagtgccctaaaatgggtattttaaaataagaataaataatgtagatttagtagaaaacctggaaaacataagaaacaaagatgaaacgaaaagtcccatgtaattccaccagttagagttaaccactgatatcgtttggatatatggctttctagtcttgtggatatccttttaatctcttgtaatataaagtctgaccatatgtgtccttgcatttgtttgtactggactctgttaatatttctatagtaatggctcactttggggagattgtgctgcacagtgtgtaggaagcacattgggtgtattattcccagttttgtattttgtatttccttggagatgtgcaggggttaagagcgggggtctggccatagctggccacgtcagactctcatatggtaagtatcacagagcacatgaggcctgtgttatgcgctggaaagactcaggaaatgagaggctctcttgttctgacaaggcaggctgagagctctcatttagggtcatcactccagataactccaaatgcagtttattgctcaactgaagcagatgatcactttttgcctccaagttcttcaccctagctagctcctttcaaagagccgagtatgctggatcttaaagggccaaactagttacatctcatacatttcctgatgtttagggatgccttcacttccatcaaggataccttggctgtgcaaggacctctgatagctggagtctccttttggtcactcccagctttgcttaaacttgatggagtttgctgtccagtgatccccggatctttcatcatgaaagccttccttcctctcctgatgtctcaggcctctagacctagactggggttctggcaaggaggcctctatcaatagtatgacatccaataatatgttagtgttgatattttgcacagtaatattaagtttaagagattataaaaatgagttcaaatgaataagttcctgtgatgtaagagattagatatgtgtgatttcagaaccaaagccaggggggaatcccagaaagaaaacaataatataatcctagtttctatatattatttttattcattactgtatatgggtagagatcaatattctttcttatgctgttactattaattaacacattttttaaccatgccattgaacttttgggtgcattaaagtggaacccaagctcctcattagataataatggcatttggactgagtgccatattcctaaatttccaataaagtggttgatatagagaggacaggataaagccctatagtgtgcagttatatcaaaacagctagtctccactttagggaatgcctttactagagattacatgaaatgtctgcttataaaataagcagagatggcaccactaagcagccacctgaattgttttcctacaggaatgattacttttcagatccatttatgttttcatgctcaatacttactccccttccctgcaacacccaaagagtttacttttgcaagtcatttggtcttcagtctactactgaggaatagagaggcactaactgctttacccaggatcagaactcatgttcttaccttctattaatagagtacttgagccagatggactaactggtctcacattttctctatcttggttttacttccataaacatcaatatctttacccacatgatttttccatcctcccatttttttccatatgtattagggttcaggaactatgatgctaatgatcacatttcttcctagttcctaatttcattagtgccatttcctgatatctacagaaacaattatcaatacatgtagctgcttgagccttatttagaaggctagcctttcttttccaagtgctgtcagaatgtatacatttagtctgtctttttcccttttaggagtctttgttctgggttgatggcaaaattcctctttttacatgtgagatttttgatttcactgaattctacctagatttttatggacattggattttaaagaggaaaacactcattttcttagtaagatattggtgatacatagctatgccattgatttccatactcctgagctttggggagggagacagtggccaagtagcaggcagaataagatcatcactcatgtcctgaatcaatcacactttccttctcggattgtgtatatgctctgccacttcctacatattacatcctgagtttttaagtaaagtggatcttagccagatttgagtctaatggctgattcatcggcatagttcttggcgttaacatctcagtgtcctctttagttctctttgaggattcatgtcattgagggcctttgtgcctccacttgtctcagtatgaggaagaactttggtgtgagggcggagctatgtgaagggttgctgggttgggggattagttcatatggtccccatgccatctatttacttttggagagaggggactttgagtgggtgggtatggatagatgttcctcaaggaaaccctgctggctaatgggcactacatctgtgtattactgtgattctctctgtaagctccccatgtggccaaggacccccctcctaccagggcacttcctgccacctcattgcactggtctcaaccattcagcctgctgctgctgcaccatgttgggctgcggtaggatagggaaggggttctgttgattgctaaatgttgcctaactttatttccctctcccacatttcatgcaagggagcggacctaacacatgacttgcattctcttcctatgttcagaaactccagggcttgcccacgtgtatgtatgagtgaccaatggagcttggaattctttatctatatgatctgtccgaaaatgagatcttttgtactggaatttgtgatgtagttgatcattcagagccaaacgcatataccaataaagacaagactgtcatataaaaaaaaaaaaaaaaa

SEQ ID NO: 5387 - DNA, 4591 bp, Homo sapiens
actttcggggagcccggcggctctgggaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccgagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 5388 - DNA, 1571 bp, Homo sapiens
actttcggggagcccggcggctctgggaagctcactcctccactcgtacccacactcgaccgcggagcccttgcagccatgagggaacagctcaaaggccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgtgagtagtagcaaaagcagaacacactcttgtttgatgtatatttgaactcctctcagctgaacaccctccttcactcccaaatgcaaacagtctcttctatttctttctttttatttacattagctgaaaagagaaaaataagctgatgtccagttgccactttcccacgtcacttgacaatttctttttccaaaagttaaactttatctcacagggggaaaaaaaaaaaaaaaccacaacacaatacagccactaattgccttacaagccttataagaaatatgggactgtttacaaatgagtgattccagtatttcattttgattttcctctctcacaaatcagtaaatgtgtgtctttttgtatctcattgtgtggtcatatctagtcacttgtttctactcaaaagaaaatatagtcacaggaaactacttcacagtaagtagtaatgattctcaagatcaaagggga

SEQ ID NO: 5389 - DNA, 7048 bp, Homo sapiens
acactagcaatggcaaagctttgtgcggaggcattgctggctgctctgaactaaaagcatccgtggggaccgaaagaggtttttgcacaccttattaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaacgaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccgagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 5390 - DNA, 2161 bp, Homo sapiens
atcttttttcatcttctagctgtagctcgggctgcttgtcggcttggcctccccctcccccctttgctctctgcctcgtctttccccaggacttcgctattttgcttttttaaaaaaaggcaagaaagaactaaactcccccctccctctcctccagtcgggctgcacctctgccttgcactttgcacagaggtagagagcgcgcgagggagagagaggaaagaaaaaaaataataaagagagccaagcagaagaggaggcgagaagcatgaagtgttaactcccccgtgccaaggcccgcgccgcccggacagacgcccgccgcgcctccagccccgagcggacgccgcgcgcgccctgcctgcagcccgggccggcgaggcgagcccttccttatgcaaagcgcgcagcggagcggcgagcgggggacgccgcgcaccgggccgggctcctccagcttcgccgccgcagccaccaccgccgccaccgcagctcgcggaggatcttcccgagcctgaagccgccggctcggcgcgcaaggaggcgagcgagcaaggaggggccggggcgagcgagggagcacattggcgtgagcaggggggagggagggcgggcgcggggggcgcgggcagggcgggggggtgtgtgtgtgagcgcgctcggaggtttcgggccagccaccgccgcgcaagctagaagcgccccagcccggcaagctggctcacccgctggccacccagcacagcccgctggcccctctcctgcagcccatctggcggagcggcggcggcggcggcggcggcaggagaatggcatcagaactggcaatgagcaactccgacctgcccaccagtcccctggccatggaatatgttaatgacttcgatctgatgaagtttgaagtgaaaaaggaaccggtggagaccgaccgcatcatcagccagtgcggccgtctcatcgccgggggctcgctgtcctccacccccatgagcacgccgtgcagctcggtgcccccttcccccagcttctcggcgcccagcccgggctcgggcagcgagcagaaggcgcacctggaagactactactggatgaccggctacccgcagcagctgaaccccgaggcgctgggcttcagccccgaggacgcggtcgaggcgctcatcagcaacagccaccagctccagggcggcttcgatggctacgcgcgcggggcgcagcagctggccgcggcggccggggccggtgccggcgcctccttgggcggcagcggcgaggagatgggccccgccgccgccgtggtgtccgccgtgatcgccgcggccgccgcgcagagcggcgcgggcccgcactaccaccaccaccaccaccacgccgccggccaccaccaccacccgacggccggcgcgcccggcgccgcgggcagcgcggccgcctcggccggtggcgctgggggcgcgggcggcggtggcccggccagcgctgggggcggcggcggcggcggcggcggcggaggcggcgggggcgcggcgggggcggggggcgccctgcacccgcaccacgccgccggcggcctgcacttcgacgaccgcttctccgacgagcagctggtgaccatgtctgtgcgcgagctgaaccggcagctgcgcggggtcagcaaggaggaggtgatccggctgaagcagaagaggcggaccctgaaaaaccgcggctatgcccagtcctgccgcttcaagagggtgcagcagagacacgtcctggagtcggagaagaaccagctgctgcagcaagtcgaccacctcaagcaggagatctccaggctggtgcgcgagagggacgcgtacaaggagaaatacgagaagttggtgagcagcggcttccgagaaaacggctcgagcagcgacaacccgtcctctcccgagtttttcataactgagcccactcgcaagttggagccatcagtgggatacgccacattttggaagccccagcatcgtgtacttaccagtgtgttcacaaaatgaaatttgtgtgagagctgtacattaaaaaaaatcatcattattattattatttgcagtcatggagaaccacctacccctgacttctgtttagtctcctttttaaataaaaattactgtgttagagaaaaaaaaaaaaaaaa

SEQ ID NO: 5391 - DNA, 3962 bp, Homo sapiens
agtcttccagcagggttctgaaagcagcctgctcccatcgcgcccctcggatgtggacacccagggtgggctgcagaccgcggccgggccgcactctctgggggcgagggccaggtcaggtggctgcactgtcgcccagcagcgagtaaagactcgaaactgagggagccagagccctagtcactctgctggtcgagggtcggaaccgctgggggaaagaggaaatgtggacgaaggcagcccttcctggagacagcttggaagagagggatgaagatgcaaaaagcaaaacccaacctatcaagtgccacctccccggtgacaggcccccagccttgctctgcgctttcgctgaatgaactcctgagcacgtttttcccgttgcctaggaagggttgggccgcaggtttcgccagtgctcgacaacccacctggagatagcgggtcggggagggagctgcgaggggggcggactcctgttgctcagtcttcagaccgcagcacagcatcatctgcaccgggacccgggaatggggggacacttggagactgagagagaggaggctcgaggaatgaaccttggtctgttctaagccacaacccctgtctcaggtcgtttggcttcctttccttctctttgtatttgaatttaaaaacattcctgaatctcaagtgcttttgcttgaagtaggggggaggaggagaaaagaatagaagcaagccaggcttcctaagcgagctctgaaaggagaaatccattcactgcaaacctcgttccccatttctgaaaacggatagactgatatcgtaaactaaaggtcatgagggtttttccccccggtttgggggatttgttctgttaaaaggaattttaaagcaccacttgagaaaataattttgcctcagtttccctaaactatctttaaaatgggttgccataattacaggtcttcttttctctcacctctataagccaccgttttcaggtcatctgaagtcaagatttccagccttttgaatggactgatgtgttctaagcccgaagatccagtagaatacttggaaagttgtttacaaaaagtaaaggaactgggtggctgtgacaaggtgaaatgggatacatttgtaagccaggaaaagaagaccttacctccactaaatggaggacagtcacggagatcctttctaagaaatgtaatgcctgaaaactcaaactttccatatcggcggtatgaccggctccctccaatccatcaattctccatagaaagtgacacggatctctctgagactgcagagttgattgaggagtatgaggtttttgatcctaccagacctcgaccaaaaatcattcttgttataggtggtccaggaagtggaaagggtactcagagtttgaaaattgcagaacgatatggattccaatacatttctgtgggagaattattaagaaagaagatccacagtaccagcagcaataggaaatggagtcttattgccaagataattacaactggagaattggccccacaggaaacaacaattacagagataaaacaaaaattgatgcaaatacctgatgaagagggcattgttattgatggatttccaagagatgttgcccaggctctatcttttgaggaccaaatctgtacccccgatttggtggtattcctggcttgtgctaatcagagactcaaagaaagattactgaagcgtgcagaacagcagggccgaccagacgacaatgtaaaagctacccaaaggagactaatgaacttcaagcagaatgctgctccattggttaaatacttccaggaaaaggggctcatcatgacatttgatgccgaccgcgatgaggatgaggtgttctatgacatcagcatggcagttgacaacaagttatttccaaacaaagaggctgcagcaggttcaagtgaccttgatccttcgatgatattggacactggagagatcattgatacaggatctgattatgaagatcagggtgatgaccagttaaatgtatttggagaggacactatgggaggtttcatggaagatttgagaaagtgtaaaattattttcataattggtggtcctggctctggcaaaggcacacagtgtgaaaagctggtggaaaaatatggatttacacatctctcaactggcgagctcctgcgtgaggaactggcatcagaatctgaaagaagcaaattgatcagagacattatggaacgtggagacctggtgccctcaggcatcgttttggagctcctgaaggaggccatggtggccagcctcggggacaccaggggcttcctgattgacggctatcctcgggaggtgaagcaaggggaagagttcggacgcaggattggagacccacagttggtgatctgtatggactgctcggcagacaccatgaccaaccgccttctccaaaggagccggagcagcctgcctgtggacgacaccaccaagaccatcgccaagcgcctagaagcctactaccgagcgtccatccccgtgatcgcctactacgagacaaaaacacagctacacaagataaatgcagagggaacaccagaggacgtttttcttcaactctgcacagctattgactctattttctgaaggcaaaaatgcatgtttgttagaatggaaacagaaaaacattaaaaagttcattccttaacacaatgtttcaagttaaaccttttgtgtcaccgcccccaccaaccaccacctcctaaatcctgacagcactgtttgcttcccagctagacctgtgtgagaggtgtctggaaatcatgcatggtgtatttgggactatatcaacctattctccacacttcagacaactgtctgcactcacggcacacacactttgtatcatgcaggccacactcagagctagtcagtacatgaacagtggtgcggtgccagtctgtgtccgttgtgatcacaggccttgctagaccctgatcatctggttctcctctcattaagcatccctaacccccagtcacaccttcctcttacatactgttccccaatggaggcccctggcataggggacagccctgggcatcttcctttggtgtctggctgttttgtcaactctcatccactggtggctcagagccataaggtgggttgattacacaatgccttgtacatgatatagaggcatcaagcaagtaaaatttgacagaaattttaaaatatgaagatgtatagctttcccaagatgatggtaaaacccaggttagtcatcagtaaccttctctattattattattttttagaaacttggaatactgtcgtcatggctaagagaacaaatctgataaattgtgtaacctagtctcttctctacatggtgatgcatttcagcaattataaattaatataaatgaccaaaagtaacttaaaagcatgagatatttgctatttcattcattgggcacatatcaaattataattttgattttaaatggtcacccatgtatttatttgttgccaagcaagtaaaaaaataccctaacaaacctgatgtgggtgggaggggcatgtcagtaagtggtgtgttcaatgtgtttgtttcatatgggccctttccaggagtttgcaaaccttgtcatacccatatgcaaaactgtgtttccttgcattaaaccagtgaagtttgggttctcttttgtgctatcaatcagttgtaaaatcagagctgcttatatattctactggaataactgcatcttccactcagtcactacaaaaaagcatagtttcagtttgcatgaatttttttttttttcttcaatggctgtgcagataaggatccatttctgggatagaattgtattttttaagtcatttttttttcttgaaatggatatgtacaaataaaataaatggaagacaggataaaaaaaaaaaaaaaaaaaaaaaaaaaa

SEQ ID NO: 5392 - DNA, 3037 bp, Homo sapiens
ctcctcacaggtgtgtctctagtcctcgtggttgcctgccccactccctgccgagacgcctgccagaaaggtcacctatcctgaaccccagcaagcctgaaacagctcagccaagcaccctgcgatggaagctgcagatgcctccaggagcaacgggtcgagcccagaagccagggatgcccggagcccgtcgggccccagtggcagcctggagaatggcaccaaggctgacggcaaggatgccaagaccaccaacgggcacggcggggaggcagctgagggcaagagcctgggcagcgccctgaagccaggggaaggtaggagcgccctgttcgcgggcaatgagtggcggcgacccatcatccagtttgtcgagtccggggacgacaagaactccaactacttcagcatggactctatggaaggcaagaggtcgccgtacgcagggctccagctgggggctgccaagaagccacccgttacctttgccgaaaagggcgagctgcgcaagtccattttctcggagtcccggaagcccacggtgtccatcatggagcccggggagacccggcggaacagctacccccgggccgacacgggccttttttcacggtccaagtccggctccgaggaggtgctgtgcgactcctgcatcggcaacaagcagaaggcggtcaagtcctgcctggtgtgccaggcctccttctgcgagctgcatctcaagccccacctggagggcgccgccttccgagaccaccagctgctcgagcccatccgggactttgaggcccgcaagtgtcccgtgcatggcaagacgatggagctcttctgccagaccgaccagacctgcatctgctacctttgcatgttccaggagcacaagaatcatagcaccgtgacagtggaggaggccaaggccgagaaggagacggagctgtcattgcaaaaggagcagctgcagctcaagatcattgagattgaggatgaagctgagaagtggcagaaggagaaggaccgcatcaagagcttcaccaccaatgagaaggccatcctggagcagaacttccgggacctggtgcgggacctggagaagcaaaaggaggaagtgagggctgcgctggagcagcgggagcaggatgctgtggaccaagtgaaggtgatcatggatgctctggatgagagagccaaggtgctgcatgaggacaagcagacccgggagcagctgcatagcatcagcgactctgtgttgtttctgcaggaatttggtgcattgatgagcaattactctctccccccacccctgcccacctatcatgtcctgctggagggggagggcctgggacagtcactaggcaacttcaaggacgacctgctcaatgtatgcatgcgccacgttgagaagatgtgcaaggcggacctgagccgtaacttcattgagaggaaccacatggagaacggtggtgaccatcgctatgtgaacaactacacgaacagcttcgggggtgagtggagtgcaccggacaccatgaagagatactccatgtacctgacacccaaaggtggggtccggacatcataccagccctcgtctcctggccgcttcaccaaggagaccacccagaagaatttcaacaatctctatggcaccaaaggtaactacacctcccgggtctgggagtactcctccagcattcagaactctgacaatgacctgcccgtcgtccaaggcagctcctccttctccctgaaaggctatccctccctcatgcggagccaaagccccaaggcccagccccagacttggaaatctggcaagcagactatgctgtctcactaccggccattctacgtcaacaaaggcaacgggattgggtccaacgaagccccatgagctcctggcggaaggaacgaggcgccacacccctgctcttcctcctgaccctgctgctcttgccttctaagctactgtgcttgtctgggtgggagggagcctggtcctgcacctgccctctgcagccctctgccagcctcttgggggcagttccggcctctccgacttccccactggccacactccattcagactcctttcctgccttgtgacctcagatggtcaccatcattcctgtgctcagaggccaacccatcacaggggtgagataggttggggcctgccctaacccgccagcctcctcctctcgggctggatctgggggctagcagtgagtacccgcatggtatcagcctgcctctcccgcccacgccctgctgtctccaggcctatagacgtttctctccaaggccctatcccccaatgttgtcagcagatgcctggacagcacagccacccatctcccattcacatggcccacctcctgcttcccagaggactggccctacgtgctctctctcgtcctacctatcaatgcccagcatggcagaacctgcagcccttggccactgcagatggaaacctctcagtgtcttgacatcaccctacccaggcggtgggtctccaccacagccactttgagtctgtggtccctggagggtggcttctcctgactggcaggatgaccttagccaagatattcctctgttccctctgctgagataaagaattcccttaacatgatataatccacccatgcaaatagctactggcccagctaccatttaccatttgcctacagaatttcattcagtctacactttggcattctctctggcgatggagtgtggctgggctgaccgcaaaaggtgccttacacactgcccccaccctcagccgttgccccatcagaggctgcctcctccttctgattaccccccatgttgcatatcagggtgctcaaggattggagaggagacaaaaccaggagcagcacagtggggacatctcccgtctcaacagccccaggcctatgggggctctggaaggatgggccagcttgcaggggttggggagggagacatccagcttgggctttcccctttggaataaaccattggtctgtcaaaaaaaaaaaaaaaaaaa

SEQ ID NO: 5393 - DNA, 2583 bp, Homo sapiens
gcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaagcatcttgggattgaatttatggaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatg

SEQ ID NO: 5394 - DNA, 2710 bp, Homo sapiens
gcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaagacataaccttatagctgagctaaggagaaacaaggcacacagatccaaatgcatgcagatccagctatcagcaactcatcttagatcttcttccattccccatttgggcttcattctctaagaccccttggcctttaggaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatg

SEQ ID NO: 5395 - DNA, 2568 bp, Homo sapiens
gcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatg

SEQ ID NO: 5396 - DNA, 6419 bp, Homo sapiens
agtctgcgggcctccggggcagcggcgaggccggagcgtcgcggcggagaggacgagaccgggacaagaccagggcaggagggagccggccagccgcgagaaccccgcacgcccggcaagatgctgtcctggcggctgcagacgggccccgagaaggccgagctccaggagctcaacgcccggctctatgactacgtgtgtcgggtgcgggagctggagcgcgaaaacctactcctggaggaggagctgcgcggccggcgcgggcgagagggcctgtgggccgaggggcaggcccgctgcgccgaggaggcgcgcagcttgcggcagcagctggacgagctgagctgggccactgcgctggcggagggcgagcgggacgctctgcggcgcgagctgcgggagctgcagcgcctggatgcggaggagcgcgccgcccgcggccgcctggacgccgagctgggtgcgcagcagcgcgagctgcaggaggcgctgggcgcgcgcgccgccctcgaggcgctgctgggccggctgcaggccgagcgccgaggcctcgacgcggcccacgaacgcgacgtgagggagctgcgcgcgcgcgccgccagccttaccatgcatttccgcgcccgcgccaccggccccgccgcgccgccgccacgcctgcgggaggtgcacgacagctacgcactgctggtggccgagtcgtggcgggagacggtgcagctgtacgaggacgaggtgcgcgagctggaggaggcgctgcggcgcggccaggagagcagactccaggcggaggaagagacgcggctgtgcgcgcaggaggcagaggcgctgcggcgcgaggcgctcgggttggagcagctgcgcgcgcggctggaggacgcgctgctgcggatgcgcgaggagtacgggatacaggccgaggagcggcagagagtgattgactgcctggaggatgagaaggcaaccctcaccttggccatggctgactggctgcgggactatcaggacctcctgcaggtgaagaccggcctcagtctggaggtggcgacctaccgggccttattggaaggagaaagtaatccagagatagtgatctgggctgagcacgttgaaaacatgccgtcagaattcagaaacaaatcctatcactataccgactcactactacagagggaaaatgaaaggaatctattttcaaggcagaaagcacctttggcaagtttcaatcacagctcggcactgtattctaacctgtcagggcaccgtggatctcagacgggcacatctattggaggtgatgccagaagaggcttcttgggctcgggatattcttcctcggccactacccagcaggaaaactcatacggaaaagccgtcagcagtcaaaccaacgtcagaactttctctccaacctatggccttttaagaaatactgaggctcaagtgaaaacattccctgacagaccaaaagccggagatacaagggaggtccccgtttacataggtgaagattccacaattgcccgcgagtcgtaccgggatcgccgagacaaggtggcagcaggtgcttcggaaagcacacggtcaaatgagaggaccgtcattctgggaaagaaaacagaagtgaaagccacgagggagcaagaaagaaacagaccagaaaccatccgaacaaagccagaagagaaaatgttcgattctaaagagaaggcttccgaggagagaaacctaagatgggaagaattgacaaagttagataaggaagcgagacagagagaaagccagcagatgaaggagaaggctaaggagaaggactcaccgaaggagaagagcgtgcgagagagagaggtgccgattagtctagaagtatcccaggacagaagagcagaggtgtccccgaaaggtttgcagacgcctgtgaaggatgctggtggtgggaccggtagagaggcagaagcaagagagctacggttcaggttgggcaccagtgatgccactggttctctgcaaggcgattccatgacagaaaccgtagcagaaaacatcgttaccagtatcctgaagcagttcactcagtctccagagacagaagcatctgctgattcttttccagacacaaaagtcacttacgtggacaggaaagagcttcctggggaaaggaaaacaaagactgaaatagttgtggagtctaaactgactgaggatgttgatgtttccgatgaagctggcctggactaccttttaagcaaggatattaaggaagtggggctgaaaggcaagtcagccgagcagatgataggagacatcatcaacctcggcctgaaagggagggaggggagagcaaaggtcgtcaacgtggagatcgtggaggagcccgtgagttatgtcagcggggagaagccggaggagttttccgtcccattcaaagtggaggaggtcgaagatgtgtcgccaggcccctgggggttggttaaggaggaggaaggttatggagaaagcgatgtcacattctcagttaatcagcatcgaaggaccaagcagcctcaggagaacacgactcacgtggaagaagtgacagaggcaggtgattcagagggcgagcagagttattttgtgtccactccagatgaacaccccggggggcacgacagagatgacggctcggtgtacgggcagatccacatcgaggaggaatccaccatcaggtactcttggcaggatgaaatcgtgcaggggactcgaaggaggacacagaaggacggtgcagtgggcgagaaggttgtgaagcccttggatgtcccagcgccctctctggagggggacctgggttccactcactggaaagaacaagctagaagcggtgaatttcatgccgaacccacagtcattgaaaaagaaattaaaataccccacgaattccacacctccatgaagggcatctcctccaaggagccccggcagcagctggtggaggtcatcgggcagctggaggaaacccttcccgagcgcatgagggaggagctgtccgccctcaccagagaggggcagggtgggccggggagcgtttccgtggatgtcaagaaggtccagggtgctggtggcagttccgtgaccctggttgctgaagtcaacgtctcacaaactgtggatgccgatcggttagacctggaggagctgagcaaagatgaggccagtgagatggagaaggctgtggagtcggtggttcgggagagcctgagcaggcaacgcagcccagcgcctggcagcccagatgaggaaggtggagcggaggccccggctgctggcattcgctttaggcgttgggccacccgggagctgtacatcccttcaggcgagagcgaggttgctggtggggcctctcacagctcgggacagcgcactccccagggcccagtgtcggccactgtggaggtcagcagccccacaggctttgcccagtcacaggtgctggaggatgtgagccaggctgcaaggcacataaaactcggcccctctgaagtctggaggactgagcgaatgtcatatgaaggacccactgcagaagtggtggagatggatgtgagtaacgtagaggcgatccgcagccggacacaggaagcgggagctctcggtgtgtctgaccgtggttcctggagagacgcggacagtaggaatgaccaggcagttggtgtgagctttaaggcctctgctggggaaggagaccaggcccacagagaacagggcaaggagcaggccatgtttgataagaaggtgcagctccagagaatggtagaccaaaggtcggtgatttcagatgaaaagaaagttgccctcctctatctagacaatgaggaggaggagaatgatgggcattggttttaataagcagaaacattttgttttaatggcagcctgttggcgacgtgccaacatccaaaggccttaacttattttaagaggccgagggagtctatgaaaatctccccttttttacttttttaaagagtactcccggcatggtcaatttcctttatagttaatccgtaaaggtttccagttaattcatgccttaaaaggcactgcaattttatttttgagttgggacttttacaaaacacttttttccctggagtcttctctccacttctggagatgaatttctatgttttgcacctggtcacagacatggcttgcatctgtttgaaactacaattaattatagatgtcaaaacattaaccagattaaagtaatatatttaagagtaaattttgcttgcatgtgctaatatgaaataacagactaacattttaggggaaaaataaatacaatttagactctaaaaagtcttttcaaaaagaaatgggaaataggcagactgtttatgttaaaaaaattcttgctaaatgatttcatctttaggaaaaaattacttgccatatagagctaaattcatcttaagacttgaatgaattgctttctatgtacagaactttaaacaatatagtatttatggcgaggacagctgtagtctgttgtgatatttcacattctatttgcacaggttccctggcactggtagggtagatgattattgggaatcgcttacagtaccatttcattttttggcactaggtcattaagtagcacacagtctgaatgcccttttctggagtggccagttcctatcagactgtgcagacttgcgcttctctgcaccttatcccttagcacccaaacatttaatttcactggtgggaggtagaccttgaagacaatgaagagaatgccgatactcagactgcagctggaccggcaagctggctgtgtacaggaaaattggaagcacacagtggactgtgcctcttaaagatgcctttcccaaccctccattcatgggatgcaggtctttctgagctcaagggtgaaagatgaatacaataacaaccatgaacccacctcacggaagctttttttgcactttgaacagaagtcattgcagttggggtgttttgtccagggaaacagtttattaaatagaaggatgttttggggaaggaactggatatctctcctgcagcccagcaccgagatacccaggacgggcctggggggcgagaaaggcccccatgctcatgggccgcggagtgtggacctgtagataggcaccaccgagtttaagatactgggatgagcatgcttcattggattcattttattttacacgtcagtattgttttaaagtttctgtctgtaaagtgtagcatcatatataaaaagagtttcgctagcagcgcattttttttagttcaggctagcttctttcacataatgctgtctcagctgtatttccagtaacacagcatcatcgcactgactgtggcgcactggggaataacagtctgagctagcaccaccctcagccaggctacaacgacagcactggagggtcttccctctcagattcacctggaggccctcagacccccagggtgcacgtctccccaggtcctgggagtggctaccgcaggtagtttctggagagcacgttttcttcattgataagtggaggagaaatgcagcacagctttcaagatactattttaaaaacaccatgaatcagatagggaaagaaagttgattggaatagcaagtttaaacctttgttgtccatctgccaaatgaactagtgattgtcagactggtatggaggtgactgctttgtaaggttttgtcgtttctaatacagacagagatgtgctgattttgttttagctgtaacaggtaatggtttttggatagatgattgactggtgagaatttggtcaaggtgacagcctcctgtctgatgacaggacagactggtggtgaggagtctaagtgggctcagtttgatgtcagtgtctgggctcatgacttgtaaatggaagctgatgtgaacaggtaattaatattatgacccacttctatttactttgggaaatatcttggatcttaattatcatctgcaagtttcaagaagtattctgccaaaagtatttacaagtatggactcatgagctattgttggttgctaaatgtgaatcacgcgggagtgagtgtgcccttcacactgtgacattgtgacattgtgacaagctccatgtcctttaaaatcagtcactctgcacacaagagaaatcaacttcgtggttggatggggccggaacacaaccagtctttttgtatttattgttactgagacaaaacagtactcactgagtgtttttcagtttcctactggtggttttgatattgtttgtttaagatgtatatttagaatgacatcatctaagaagctgattttgctaaactcctgttccctacaatgggaaatgtcacaagaatgtgcaaaaataaaaatctgaggaaaaaacccaca

SEQ ID NO: 5397 - DNA, 1349 bp, Homo sapiens
cctgatcgaacagcctcacttgtgttgctgtcagtgccagtagggcaggcaggaatgcagcagagaggactcgccatcgtggccttggctgtctgtgcggccctacatgcctcagaagccatacttcccattgcctccagctgttgcacggaggtttcacatcatatttccagaaggctcctggaaagagtgaatatgtgtcgcatccagagagctgatggggattgtgacttggctgctgtcatccttcatgtcaagcgcagaagaatctgtgtcagcccgcacaaccatactgttaagcagtggatgaaagtgcaagctgccaagaaaaatggtaaaggaaatgtttgccacaggaagaaacaccatggcaagaggaacagtaacagggcacatcaggggaaacacgaaacatacggccataaaactccttattagagagtctacagataaatctacagagacaattcctcaagtggacttggccatgattggttagtctcactctatcacacaggctggagggcagtggcaggatctcagttcaccccaacctttgcctcacgggttcaagggattctcgtgcctcagccttccaagtagctgggattacaggtgtgcgccagtacgcctggctagttttagtattttttgttacagacggggtttcaccatgttggctgggctggtctcaaacttctgatctcaagtgatccatctgccttggcctcccaaagtgctgggattacaggcatgagccactgcacctggcctacgtattaggctttatgtaagatgtacatagtactccatactcctttccttttcctcctattgaaactgttcctataaactttataaaattaatcagagaagaagagagggtgagaaacataaataatccaagcttgcaccacattcagcattaatcactaggtcactttgcttgctgaccccttcctcatagttgtttggctattgcttcagaattatgtggagtctgttacaagattatagttccccttaactgctctatagataacagcttgaacattatgaaatgctaagttttcccttcgagacattctttcaggtcctgcatactgatgaaactactgatgtcagctggtctgaaggaccctaccagaagctaaatcatcaaagaatgcaatttccatatcctaatgattcaatctcccttaccctgaccaatcagtggcccaaattttccagccccttgcctcccagaaccccagcccagaactcttcagagatttaagaatctcctcctacctcctgactcagcaccatgtaatcattaaactctctgctgcaaaaaaaaaaaaaaa

SEQ ID NO: 5398 - DNA, 4546 bp, Homo sapiens
gatttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatatttcatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccacgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaatgtctttttctcacttatttttatgtacaatattgatagtgagaggtatgtctattataataaagattatggcacagtaaaaaaaaaaaaaaaaaa

SEQ ID NO: 5399 - DNA, 5229 bp, Homo sapiens
agaaagctgcggcgcgagtccgcggggccgacctcggagacgcagctggggccgggcgcggcttggcgggagggtctgcagcgccgagggaggctgctggtgcgtgaggaagagagctagagactggacaggggaggcagagcagcgtcagagccgcgcaggggacgggagtgagagcaggagcgacgcagagcggccgtcgccgtgcccgggtctcagggcgcctggctgaagtgagcatggcttcagtggcctgggccgtcctcaaggtgctgctgcttctccccactcagacttggagccccgtgggagcaggaaatccacctgactgtgatgccccactggcctctgccttgcctaggtcatccttcagcagctcctcagagctgtccagcagccacggcccggggttttcaaggcttaatcgaagagatggagctggtggctggactccacttgtgtcaaataaataccaatggctgcaaattgaccttggagagagaatggaggtcactgctgtcgccacccaaggaggatatgggagctctgactgggtgaccagctacctcctgatgttcagtgatggtgggagaaactggaagcagtatcgccgagaagaaagcatctggggttttccaggaaacacaaacgcagacagtgtggtgcactacagactccagcctccctttgaagccaggttcctgcgctttctccctttagcctggaaccctaggggcaggattgggatgcggatcgaagtgtacggatgtgcatataaatctgaggtggtttattttgatggacaaagtgctctgctgtatagacttgataaaaaacctttaaaaccaataagagacgttatttctttgaaatttaaagccatgcagagcaatggaattctacttcacagagaaggacaacatggaaatcacattactctggaattaattaaaggaaagcttgtcttttttcttaattcaggcaatgctaagctgccttccactattgctcctgtgaccctcaccctgggcagcctgctggacgaccagcactggcattccgtcctcatcgagctcctcgacacgcaggtcaacttcaccgtggacaaacacactcatcatttccaagcaaagggagattccagttacttggatcttaattttgagatcagctttgggggaattccgacacccggaagatcgcgggcattcagacgtaaaagctttcatgggtgtttagaaaatctttattataatggagtggatgttaccgaattagccaagaaacacaaaccacagatcctcatgatgggaaatgtgtccttctcatgtccacagccacagactgtccctgtgacttttctgagctccaggagttatctggctctgccaggcaactctggggaggacaaagtgtctgtcacttttcaatttcgaacgtggaacagagcaggacatttgcttttcggcgaacttcgacgtggttcagggagtttcgtcctctttcttaaggatggcaagctcaaactgagtctcttccagccgggacagtcaccaaggaatgtcacagcaggtgctggattaaacgatgggcagtggcactctgtgtccttctctgccaagtggagccatatgaatgtggtggtggacgatgacacagctgttcagcccctggtggctgtgctcattgattcaggtgacacctattattttggaggctgcctggacaacagctctggctctggatgtaaaagccccctgggagggtttcagggctgcctaaggctcatcaccattggtgacaaagcggtggatcccatcttagtacagcagggggcgctggggagtttcagggacctccagatagactcctgcggcatcacagacaggtgcttgcccagctactgtgagcatgggggcgagtgttcccagtcgtgggacaccttctcctgtgactgtctaggcacaggctatacgggcgagacctgccattcctctctctacgagcagtcttgtgaagcccacaagcaccgagggaacccgtctgggctttactatattgatgcagatggaagtggccccctgggaccatttcttgtgtactgcaatatgacagcagacgccgcgtggacggtggtgcagcacggtggccccgacgcggtgaccctccgaggtgcccccagcgggcacccgcgctcggctgtgtccttcgcgtacgcagcgggcgcggggcagctgcggtccgcggtgaacctggcggagcgctgcgagcagcggctggctctgcgctgcgggacggcgcggcgcccggactcacgagatggaaccccactgagctggtgggttggaagaaccaatgaaacacacacttcctggggaggttctctgcctgatgctcaaaagtgtacttgtggattagaggggaactgcattgattctcagtattactgcaactgtgatgctggccggaatgaatggactagtgacacaatagtcctttcccaaaaggagcacctgccagtcactcagattgtgatgacagacgcaggccgaccacattccgaagcagcttatacactggggccactgctctgccgcggagatcagtcattctggaattcagcttccttcaacactgagacttcataccttcatttccctgctttccacggagaactcactgctgacgtgtgcttcttttttaagaccacagtttcctccggggtgtttatggagaacctggggatcacagatttcatcaggattgagctgcgtgctcccacagaagtgaccttttccttcgatgtggggaatggaccttgtgaggtcacggtgcagtcacccactccctttaatgacaatcagtggcaccacgtgagggcagagagaaatgttaaaggagcgtctcttcaagttgatcagcttcctcagaagatgcagcctgcccctgctgatgggcacgttcgtttacagctcaacagccagctcttcattggtggaacggccaccagacagagaggctttctaggatgcattcggtctctgcagttgaacggggtggccctggatctggaagaaagagccacagtgacgccaggagtggagccagggtgtgcaggacactgcagcacctatggacacttgtgtcgcaatggagggagatgcagagagaaacgcaggggggtcacctgtgactgtgccttctcagcctatgatgggccgttctgctccaatgagatttccgcatattttgcaactggctcctcaatgacataccattttcaagaacattacactttaagtgaaaactccagctctctcgtttcttcattacacagagatgtaacattgaccagagaaatgatcacactgagcttccgaaccacacgaactccgagcttattgctgtatgtgagctctttctatgaggaatacctttcagttatcctcgccaacaatggaagtttgcagattaggtacaagctagatagacatcaaaatcctgatgcatttacctttgattttaaaaacatggctgatgggcaacttcaccaagtgaagattaacagagaagaagctgtggtcatggtagaggttaaccagagcacaaagaaacaagtcatcttgtcctcagggacagaattcaacgccgtcaaatctctcatattgggaaaggttttagaggctgccggcgcggacccggacacaaggcgggcggcgactagtggcttcactggctgcctctcggcggtgcgcttcggccgcgctgctcccctgaaggcggcgctgcgccccagcggcccctcccgggtcaccgtccgcggccacgtggcccctatggcccgctgcgcagcgggggcggcgtccggctccccggcgcgggaactggctccccgactcgcggggggcgcaggtcgttctggaccagcggatgagggagagcccttggttaatgcagacagaagagactctgctgtcatcggaggtgtgatagcagtggtgatatttattttgctttgcatcactgccatagccatacgcatctatcaacagagaaagttacgcaaagaaaatgagtcaaaagtctcaaaaaaagaagagtgctaggacagctctaaacagtgagctcgatgtgcaaaacgcagtccatgaaaaccagaaagagcgagtcttctgattggcagctgtggctgtctctatcatcgtgactgtggacttccctgctgttgccatcagggtgcacacaagcaggtgcagtgctgtcacctggctgaagacctgcagcctcggagcctctgggaggtccctttctccctcggtgaaacacagtcctccacatcaatttccaaacaatgaattaggtatggccattcatcactgttcagtagtttccccgtccaaaggctctcttccaaaactgcagtttgatctgtgttaataattgtggggttttagatgagaaaatggctataaagctgtggccctactttattttttaaaaatgacagaacttttgttcagatgtaaaagacaaaattgcactttaatgttttttgttacttgaaaacatatctgggatccctttttttggtcctctgctgatatttataaaacaagaaatgcttcttggactaccttcactggcatttccatagtcctggaatccagagccaagtggcctatctaaaattcacagcccttttattctcctgtgtgatggttaatacaacacagttgaagcctggaaacactaccattatttttggtgtattgctttttctaattgactgtttttaatgattttgatacattttaatgttgaaattaatattgaatgttagctatgaaattttagtattgaattttataatggaacagaacattggtaggtaacaagatgcaagaggatgtcaatacaagattgtctgcctgtttttctttgtaatttgtaattacagtttttgtaacttgtgattatgtttttaactaaatttaccaccagatacaaacaatacttcttacacagagttatcctttatttatatcattaagacgtgaatgaaacatcatcctaacttacttccccaagatattgagaggtcatatctgtttttctttatcattcatttctttttctaaaagttgttactgatatgcttttgatttcctatgactctattatgttgtacagaacatcttttcaatttattaaaaaaatagcttaactgaa

SEQ ID NO: 5400 - DNA, 7699 bp, Homo sapiens
ggcgctgagcgagctcggagcccgcgctgtgcgcctgcggccggggcgccccgccgagcgccggtgccccggctcccgggccgccttcgccgcgcgggaaggattcttcaaaattaacagaaaccaattcgggccagctgaagagaaaaaataaaggtggctcccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagctccagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccagctgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatctgggaaatttggacaggtctttcgacttgtagaaaagaaaactcgaaaagtctgggcagggaagttcttcaaggcatattcagcaaaagagaaagagaatatccggcaggagattagcatcatgaactgcctccaccaccctaagctggtccagtgtgtggatgcctttgaagaaaaggccaacatcgtcatggtcctggagatcgtgtcaggaggggagctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaaaaaaaaaaaaaaaaa

SEQ ID NO: 5401 - DNA, 7632 bp, Homo sapiens
ggcgctgagcgagctcggagcccgcgctgtgcgcctgcggccggggcgccccgccgagcgccggtgccccggctcccgggccgccttcgccgcgcgggaaggattcttcaaaattaacagaaaccaatttgggccagctgaagagaaaaaataaaggtggctcccggctgcctctgctgcagttcagagcaacttcaggagcttcccagccgagagcttcaggacgcctttcctgtcccactggcccagttgccacaacaaacaacagagaagacggtgaccatgggggatgtgaagctggttgcctcgtcacacatttccaaaacctccctcagtgtggatccctcaagagttgactccatgcccctgacagaggcccctgctttcattttgccccctcggaacctctgcatcaaagaaggagccaccgccaagttcgaagggcgggtccggggttacccagagccccaggtgacatggcacagaaacgggcaacccatcaccagcgggggccgcttcctgctggattgcggcatccgggggactttcagccttgtgattcatgctgtccatgaggaggacaggggaaagtatacctgtgaagccaccaatggcagtggtgctcgccaggtgacagtggagttgacagtagaaggaagttttgcgaagcagcttggtcagcctgttgtttccaaaaccttaggggatagattttcagcttcagcagtggagacccgtcctagcatctggggggagtgcccaccaaagtttgctaccaagctgggccgagttgtggtcaaagaaggacagatgggacgattctcctgcaagatcactggccggccccaaccgcaggtcacctggctcaagggaaatgttccactgcagccgagtgcccgtgtgtctgtgtctgagaagaacggcatgcaggttctggaaatccatggagtcaaccaagatgacgtgggagtgtacacgtgcctggtggtgaacgggtcggggaaggcctcgatgtcagctgaactttccatccaaggtttggacagtgccaataggtcatttgtgagagaaacaaaagccaccaattcagatgtcaggaaagaggtgaccaatgtaatctcaaaggagtcgaagctggacagtctggaggctgcagccaaaagcaagaactgctccagcccccagagaggtggctccccaccctgggctgcaaacagccagcctcagcccccaagggagtccaagctggagtcatgcaaggactcgcccagaacggccccgcagaccccggtccttcagaagacttccagctccatcaccctgcaggccgcaagagttcagccggaaccaagagcaccaggcctgggggtcctatcaccttctggagaagagaggaagaggccagctcctccccgtccagccaccttccccaccaggcagcctggcctggggagccaagatgttgtgagcaaggctgctaacaggagaatccccatggagggccagagggattcagcattccccaaatttgagagcaagccccaaagccaggaggtcaaggaaaatcaaactgtcaagttcagatgtgaagtttccgggattccaaagcctgaagtggcctggttcctggaaggcacccccgtgaggagacaggaaggcagcattgaggtttatgaagatgctggctcccattacctctgcctgctgaaagcccggaccagggacagtgggacatacagctgcactgcttccaacgcccaaggccaggtgtcctgtagctggaccctccaagtggaaaggcttgccgtgatggaggtggccccctccttctccagtgtcctgaaggactgcgctgttattgagggccaggattttgtgctgcagtgctccgtacgggggaccccagtgccccggatcacttggctgctgaatgggcagcccatccagtacgctcgctccacctgcgaggccggcgtggctgagctccacatccaggatgccctgccggaggaccatggcacctacacctgcctagctgagaatgccttggggcaggtgtcctgcagcgcctgggtcaccgtccatgaaaagaagagtagcaggaagagtgagtaccttctgcctgtggctcccagcaagcccactgcacccatcttcctgcagggcctctctgatctcaaagtcatggatggaagccaggtcactatgactgtccaagtgtcagggaatccaccccctgaagtcatctggctgcacaatgggaatgagatccaagagtcagaggacttccactttgaacagagaggaactcagcacagcctttgtatccaggaagtgttcccggaggacacgggcacgtacacctgcgaggcctggaacagcgctggagaggtccgcacccaggccgtgctcacggtacaagagcctcacgatggcacccagccctggttcatcagtaagcctcgctcagtgacagcctccctgggccagagtgtcctcatctcctgcgccatagctggtgacccctttcctaccgtgcactggctcagagatggcaaagccctctgcaaagacactggccacttcgaggtgcttcagaatgaggacgtgttcaccctggttctaaagaaggtgcagccctggcatgccggccagtatgagatcctgctcaagaaccgggttggcgaatgcagttgccaggtgtcactgatgctacagaacagctctgccagagcccttccacgggggagggagcctgccagctgcgaggacctctgtggtggaggagttggtgctgatggtggtggtagtgaccgctatgggtccctgaggcctggctggccagcaagagggcagggttggctagaggaggaagacggcgaggacgtgcgaggggtgctgaagaggcgcgtggagacgaggcagcacactgaggaggcgatccgccagcaggaggtggagcagctggacttccgagacctcctggggaagaaggtgagtacaaagaccctatcggaagacgacctgaaggagatcccagccgagcagatggatttccgtgccaacctgcagcggcaagtgaagccaaagactgtgtctgaggaagagaggaaggtgcacagcccccagcaggtcgattttcgctctgtcctggccaagaaggggacttccaagacccccgtgcctgagaaggtgccaccgccaaaacctgccaccccggattttcgctcagtgctgggtggcaagaagaaattaccagcagagaatggcagcagcagtgccgagaccctgaatgccaaggcagtggagagttccaagcccctgagcaatgcacagccttcagggcccttgaaacccgtgggcaacgccaagcctgctgagaccctgaagccaatgggcaacgccaagcctgccgagaccctgaagcccatgggcaatgccaagcctgatgagaacctgaaatccgctagcaaagaagaactcaagaaagacgttaagaatgatgtgaactgcaagagaggccatgcagggaccacagataatgaaaagagatcagagagccaggggacagccccagccttcaagcagaagctgcaagatgttcatgtggcagagggcaagaagctgctgctccagtgccaggtgtcttctgaccccccagccaccatcatctggacgctgaacggaaagaccctcaagaccaccaagttcatcatcctctcccaggaaggctcactctgctccgtctccatcgagaaggcactgcctgaggacagaggcttatacaagtgtgtagccaagaatgacgctggccaggcggagtgctcctgccaagtcaccgtggatgatgctccagccagtgagaacaccaaggccccagagatgaaatcccggaggcccaagagctctcttcctcccgtgctaggaactgagagtgatgcgactgtgaaaaagaaacctgcccccaagacacctccgaaggcagcaatgccccctcagatcatccagttccctgaggaccagaaggtacgcgcaggagagtcagtggagctgtttggcaaagtgacaggcactcagcccatcacctgtacctggatgaagttccgaaagcagatccaggaaagcgagcacatgaaggtggagaacagcgagaatggcagcaagctcaccatcctggccgcgcgccaggagcactgcggctgctacacactgctggtggagaacaagctgggcagcaggcaggcccaggtcaacctcactgtcgtggataagccagaccccccagctggcacaccttgtgcctctgacattcggagctcctcactgaccctgtcctggtatggctcctcatatgatgggggcagtgctgtacagtcctacagcatcgagatctgggactcagccaacaagacgtggaaggaactagccacatgccgcagcacctctttcaacgtccaggacctgctgcctgaccacgaatataagttccgtgtacgtgcaatcaacgtgtatggaaccagtgagccaagccaggagtctgaactcacaacggtaggagagaaacctgaagagccgaaggatgaagtggaggtgtcagatgatgatgagaaggagcccgaggttgattaccggacagtgacaatcaatactgaacaaaaagtatctgacttctacgacattgaggagagattaggatcctgtttgagcgcatcattgacgaggactttgagctgacggagcgtgagtgcatcaagtacatgcggcagatctcggagggagtggagtacatccacaagcagggcatcgtgcacctggacctcaagccggagaacatcatgtgtgtcaacaagacgggcaccaggatcaagctcatcgactttggtctggccaggaggctggagaatgcggggtctctgaaggtcctctttggcaccccagaatttgtggctcctgaagtgatcaactatgagcccatcggctacgccacagacatgtggagcatcggggtcatctgctacatcctagtcagtggcctttcccccttcatgggagacaacgataacgaaaccttggccaacgttacctcagccacctgggacttcgacgacgaggcattcgatgagatctccgacgatgccaaggatttcatcagcaatctgctgaagaaagatatgaaaaaccgcctggactgcacgcagtgccttcagcatccatggctaatgaaagataccaagaacatggaggccaagaaactctccaaggaccggatgaagaagtacatggcaagaaggaaatggcagaaaacgggcaatgctgtgagagccattggaagactgtcctctatggcaatgatctcagggctcagtggcaggaaatcctcaacagggtcaccaaccagcccgctcaatgcagaaaaactagaatctgaagaagatgtgtcccaagctttccttgaggctgttgctgaggaaaagcctcatgtaaaaccctatttctctaagaccattcgcgatttagaagttgtggagggaagtgctgctagatttgactgcaagattgaaggatacccagaccccgaggttgtctggttcaaagatgaccagtcaatcagggagtcccgccacttccagatagactacgatgaggacgggaactgctctttaattattagtgatgtttgcggggatgacgatgccaagtacacctgcaaggctgtcaacagtcttggagaagccacctgcacagcagagctcattgtggaaacgatggaggaaggtgaaggggaaggggaagaggaagaagagtgaaacaaagccagagaaaagcagtttctaagtcatattaaaaggactatttctctaaaactcaaaaaaaaaaaaaaaactcaagatagtaaaagcacctagtgtgatagattatcggttaggtcatttgtgggttgattcttcagaaacagcagttgatacctagcagcgttattgatgggcattaatctatgttagttggcaccttaagatactagtgcagctagatttcatttagggaaatcaccagtaacttgactgaccaattgattttagagagaaagtaaccaaaccaaatatttatctgggcaaagtcataaattctccacttgaatgcgctcatgaaaaataaggccaaaacaagagttctgggccacagctcagcccagagggttcctggggatgggaggcctctctctccccaccccctgactctagagaactgggttttctcccagtactccagcaattcatttctgaaagcagttgagccactttattccaaagtacactgcagatgttcaaactctccatttctctttccccttccacctgccagttttgctgactctcaacttgtcatgagtgtaagcattaaggacattatgcttcttcgattctgaagacaggtccctgctcatggatgactctggcttccttaggaaaatatttttcttccaaaatcagtaggaaatctaaacttatcccctctttgcagatgtctagcagcttcagacatttggttaagaacccatgggaaaaaaaaaatccttgctaatgtggtttcctttgtaaaccaggattcttatttgtgctgttatagaatatcagctctgaacgtgtggtaaagatttttgtgtttgaatataggagaaatcagtttgctgaaaagttagtcttaattatctattggccacgatgaaacagatttcaactgataaagagctggagaactccatgtactttggaatctcctccaagatagccagagtttaatacatcttcattctcaacactctccaaagaacttgacctaccttatgggttccatatttttcttcttaaatgtgcatcaatcatgccttgcccccaacctttaaatatattcttagacctggtaaatgcactcagacttgcgtctttaggaatttttaactttctttcactacattggcacttaaattttttctttataaagctttttgaaggtcataaacaaagaccataattgatgatagacctaatacatttcctctgtgtgtgtgtgtaacattccaaatactttttttttcttttccactgtttgtaaggtgcaacaatttaatatttttaagggactttttaagagttccttaagaaccaatttaaaattacttcagtgcaatcctacacagtatcaacattagaattttgatattagtcttatgttatcttccattctatttttatctgctttttgctgctagtttcaaactgccagtatttttccttttgcttttaaaatagttacaatatttttcatgatagccacagtattgccacagtttattataataaagggtttttatttgatttagcgcattcaaagcttttttctatcacttttgtgttcagaatataacctttgtgtgcgtgtatgttgtgtgtgtgcatgtgtggcgtatatgtgtgttacaggttaatgccttcttggaattgtgttaatgttctcttggtttattatgccatcagaatggtaaatgagaacactacaactgtagtcagctcacaatttttaaataaaggataccacagtgcatgctgtttgttcaaaaaaaaaaaaaaaaaa

SEQ ID NO: 5402 - DNA, 2767 bp, Homo sapiens
tcatttgtaggctgaactaatgactgccgccataagaagacagagagaactgagtatcctcccaaaggtgacactggaagcaatgaacaccacagtgatgcaaggcttcaacagatctgagcggtgccccagagacactcggatagtacagctggtattcccagccctctacacagtggttttcttgaccggcatcctgctgaatactttggctctgtgggtgtttgttcacatccccagctcctccaccttcatcatctacctcaaaaacactttggtggccgacttgataatgacactcatgcttcctttcaaaatcctctctgactcacacctggcaccctggcagctcagagcttttgtgtgtcgtttttcttcggtgatattttatgagaccatgtatgtgggcatcgtgctgttagggctcatagcctttgacagattcctcaagatcatcagacctttgagaaatatttttctaaaaaaacctgtttttgcaaaaacggtctcaatcttcatctggttctttttgttcttcatctccctgccaaatacgatcttgagcaacaaggaagcaacaccatcgtctgtgaaaaagtgtgcttccttaaaggggcctctggggctgaaatggcatcaaatggtaaataacatatgccagtttattttctggactgtttttatcctaatgcttgtgttttatgtggttattgcaaaaaaagtatatgattcttatagaaagtccaaaagtaaggacagaaaaaacaacaaaaagctggaaggcaaagtatttgttgtcgtggctgtcttctttgtgtgttttgctccatttcattttgccagagttccatatactcacagtcaaaccaacaataagactgactgtagactgcaaaatcaactgtttattgctaaagaaacaactctctttttggcagcaactaacatttgtatggatcccttaatatacatattcttatgtaaaaaattcacagaaaagctaccatgtatgcaagggagaaagaccacagcatcaagccaagaaaatcatagcagtcagacagacaacataaccttaggctgacaactgtacatagggttaacttctatttattgatgagacttccgtagataatgtggaaatcaaatttaaccaagaaaaaaagattggaacaaatgctctcttacattttattatcctcgtgtacagaaaagattatataaaatttaaatccacatagatctattcataagctgaatgaaccattactaagagaatgcaacaggatacaaatggccactagaggtcattatttctttctttctttttttttttttttaatttcaagagcatttcactttaacattttggaaaagactaaggagaaacgtatatccctacaaacctcccctccaaacaccttctcacattcttttccacaattcacataacactactgcttttgtgccccttaaatgtagatatgtgctgaaagaaaaaaaaaacgcccaactcttgaagtccattgctgaaaactgcagccaggggttgaaagggatgcagacttgaagagtctgaggaactgaagtgggtcagcaagacctctgaaatcctgggtaaaggattttctccttacaattacaaacagcctctttcacattacaataatataccataggaggcacaagcaccattattaagccactttgcttacaccttaagtgtgtacaattcaagtgtgagaatgctgtgttaactattctttggaattctccttctgtccagcaaatactctaatgatggttaaacatggcacctactcagcaatgccttcctggaccacaacccctatccccctgccccaccctcctcattaaaaacaaatacttctactgtttgggtgtgtgatagggttctcaatgcagatctcccttttctagttagctatattcttgactgcatccgctaaaaatgttaaagcttcttgagagacagacatgccagattttcttggtatctcccataatacgacctacagtccatggtctacagatgttttaaatagaattgctattctcgatacatacaaagacgtaattgctgacccacaatcagtaacatccatattgagagatttttcaaaggatggtgaccctgcttgtatttatttaccttggtattttttcttgcatccttctgtgattcaaaaaagtaaaatgtggctttctgaaatgatggataagagtctacatcttctagaaaaaatacataaaggagtagttaagctctgtaaatgtgccacgagctccaacacgaccatcgtagggtgaagcccacgttttcttccatggcctcaaaggccctagaacttgcctacctttctggccttacctcctagctacttatccatctcttgaactttatactcttgtataaatttctaactttcagaaaatgccatactctgttttggcaccacacatgtatatttccccctggtacacttggaagactcttatccatctgtgaaaccctatgttgtcatcacttggtccatgaaatattacctggccaatatcccaccatcacctcaaacccaatcaccccctcctctgtatgctgtcacacctatattattaaacttatcacattgcattgtaattacttcctgacctttgtatctactcttttagtaactgatgtatatatctgaaaggagagattgtttcattgtgcaatcaataaatgtttgataaaataaagccc

SEQ ID NO: 5403 - DNA, 744 bp, Homo sapiens
aaacgcgggcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatggtatatgaagacctgaggtataagctctcgctagagttccccagtggctacccttacaatgcgcccacagtgaagttcctcacgccctgctatcaccccaacgtggacacccagggtaacatatgcctggacatcctgaaggaaaagtggtctgccctgtatgatgtcaggaccattctgctctccatccagagccttctaggagaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaaaaaaaaaaaaaaaaaaaaaaa

SEQ ID NO: 5404 - DNA, 520 bp, Homo sapiens
aaacgcgggcgggcgggcccgcagtcctgcagttgcagtcgtgttctccgagttcctgtctctctgccaacgccgcccggatggcttcccaaaaccgcgacccagccgccactagcgtcgccgccgcccgtaaaggagctgagccgagcgggggcgccgcccggggtccggtgggcaaaaggctacagcaggagctgatgaccctcatgaacccaacattgatagtcccttgaacacacatgctgccgagctctggaaaaaccccacagcttttaagaagtacctgcaagaaacctactcaaagcaggtcaccagccaggagccctgacccaggctgcccagcctgtccttgtgtcgtctttttaatttttccttagatggtctgtcctttttgtgatttctgtataggactctttatcttgagctgtggtatttttgttttgtttttgtcttttaaattaagcctcggttgagcccttgtatattaaataaatgcatttttgtccttttttagacaaaa

SEQ ID NO: 5405 - DNA, 2617 bp, Homo sapiens
ctcgggccgctgcgctcctggccagctccccccagcgcctgggaggcgacccccagtgcgcccgggttcaaaggcccggcgaggcagttccagcccctctggggggcggggaggcgacgggggtggtgcagaagccagaaaagcccgagccacagccggccagctccgcgcagggatgggcagcgcgctctgaaagtttatgaccgccgcagccaactcctggccggagctggagacgcagcgagcgatcggccggcctcgaacccccacagctggagggcgaggccagctgtacccggccccagtgccctttcgcggccacaagcggccgtcctcctggtccggtgctccggcgcctgatctaggttcatggagccggggctgtggctccttttcgggctcacagtgacctccgccgcaggattcgtgccttgctcccagtctggggatgctggcaggcgcggcgtgtcccaggcccccactgcagccagatctgagggggactgtgaagagactgtggctggccctggcgaggagactgtggctggccctggcgaggggactgtggccccgacagcactgcagggtccaagccctggaagccctgggcaggagcaggcggccgagggggcccctgagcaccaccgatccaggcgctgcacgtgcttcacctacaaggacaaggagtgtgtctactattgccacctggacatcatttggatcaacactcccgaacagacggtgccctatggactgtccaactacagaggaagcttccggggcaagaggtctgcggggccacttccagggaatctgcagctctcacatcggccacacttgcgctgcgcttgtgtggggagatatgacaaggcctgcctgcacttttgcacccaaactctggacgtcagcagacaggttgaagtcaaggaccaacaaagcaagcaggctttagacctccaccatccaaagctcatgcccggcagtggactcgccctcgctccatctacctgcccccgctgcctctttcaggaaggagccccttaggaggacaggcctgcagcatcctggtctcgggaggcttctgtcattgctcacacacagttcagatttccacctctttatagacaagaagtgaatttgcctggggcagaacacccacccaaagagtccccacttaacaataccccccccccacggcaagaatgcccaaatccgaatgaccccagttttcctaatgagtaaaatgatcccagatgtgccccagagcatgacgcctgcagctccggtttcatgcaggaaattggttttggagagttttggcaagttggaaagccacttactggcttttgacatgacttctcttggagaataagtggactccaagctaactctttgcaaatgtaaacacatgtccatcttgtaataaatgcaaaatgcccgtgcagcagaagcatgcgactttcatatccttgcctagaataggctgcatggtgtatgtcagtgagggccacgaggcgtcggctttagacacagatcatagctctacaggagtttatgaatttgaagcttatgggattttggcagagaaattttcagctgtgcttgatacccaccaaaagaatgtatctcgaaagaatgaaggaagaagaaaaaaggatccttgatgtttgtgacaagaaaatgagaaagttagtatctgcaatacagagcttgttcctgttcagtgactgaccctctgtattctgtatagacaccaggccgatacacagtggagttcccaggccttgtttgcaggaagccgactgtaaagacagccccagctcaaggctattaggttgaatatttgctttcatgagtaaatgtggatctttggggaatggcttcaaaataagtcacgaacacaaattctttgtaaattatgtaaattcctgtttatataaattggcaacaacttataccgtctgacagttcaaaatctctttcagctgcgctcttcccaccgagccgagcttactgtgagtgtggagatgttatcccaccatgtaaagtcgcctgcgcaggggagggctgcccatctccccaacccagtcacagagagataggaaacggcatttgagtgggtgtccagggccccgtagagagacatttaagatggtgtatgacagagcattggccttgaccaaatgttaaatcctctgtgtgtatttcataagttattacaggtataaaagtgatgacctatcatgaggaaatgaaagtggctgatttgctggtaggattttgtacagtttagagaagcgattatttattgtgaaactgttctccactccaactcctttatgtggatctgttcaaagtagtcactgtatatacgtatagagaggtagataggtaggtagattttaaattgcattctgaatacaaactcatactccttagagcttgaattacatttttaaaatgcatatgtgctgtttggcaccgtggcaagatggtatcagagagaaacccatcaattgctcaaatactcagaaagtactgtcaaaagcctaataaaaaacctaaagtttgctctgaaaaaaaaaaaaaaaaaaaaaaaaaaaaaaaaaaaaaaaaa

SEQ ID NO: 5406 - DNA, 354 bp, Homo sapiens
  misc_feature (134)..(134): n is a, c, g, or t
  misc_feature (161)..(161): n is a, c, g, or t
  misc_feature (180)..(180): n is a, c, g, or t
  misc_feature (193)..(193): n is a, c, g, or t
  misc_feature (233)..(233): n is a, c, g, or t
  misc_feature (250)..(250): n is a, c, g, or t
  misc_feature (286)..(286): n is a, c, g, or t
  misc_feature (313)..(313): n is a, c, g, or t
  misc_feature (344)..(344): n is a, c, g, or t
gcagtggagaaggagttggaccagtcaacatctctgttgtcacaagcagtgtttcctctggatatggcagtggcagtggctatggcggtggcctcggtggaggtcttggcggcggctcggtggaggtcttgccngagtagcagctccagcgtgcaaatttntctccaccacctcctcctnccggaagagcttnaagagctaagaacctgctgcaagtcactgccttccaagtncagcaacccagcccatnggagattgcctcttctagggagttggtcaagccatnttttattccttttcttggagagtagtntaggaccaagccattttcagaaccacatttntttggttccc

SEQ ID NO: 5407 - DNA, 365 bp, Homo sapiens
ggcaggaccagcagaacattccagattggatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctgggccctgagcgcaccattcccatcacccgtgaaggagaagcctgctgttcaccgcagcccccaaggaattaggttgc

SEQ ID NO: 5408 - DNA, 486 bp, Homo sapiens
  misc_feature (71)..(71): n is a, c, g, or t
  misc_feature (350)..(350): n is a, c, g, or t
  misc_feature (355)..(355): n is a, c, g, or t
  misc_feature (390)..(390): n is a, c, g, or t
  misc_feature (414)..(414): n is a, c, g, or t
  misc_feature (437)..(437): n is a, c, g, or t
  misc_feature (465)..(465): n is a, c, g, or t
gcccgacgactccactcaccagctgctgcagccccatcacgactgctgccaacgccaggagcagcctgctntggtgggccagtcaggggtgaggagagcccccgacagtcctgtcctggaagcagtgtgggaccctccatttcactcagggcccccatgctgcttgggccttgtgcagttgaagaggtggacagtcctgactcctgccaaagacataaggagtcctacccgttgaggttggagagggaaaataaagaagcttgccacctaacagggagttcacccagggaaagcaccgcacaggcttggcgcggggacagacttccttaacctggggggcctctgcagtnggcanggcgaggcttgcagggaggcccacagattaagttnggcaagagggaaggatcccagggnacatggtttcattcacgagcttnaagggaacagcaaggggcacggtttttnacagcttgggagacaaccaca

SEQ ID NO: 5409 - DNA, 316 bp, Homo sapiens
  misc_feature (102)..(102): n is a, c, g, or t
  misc_feature (121)..(121): n is a, c, g, or t
  misc_feature (269)..(269): n is a, c, g, or t
cacagatcagcaccatgaagcttctcacgggcctggttttctgctccttggtcctgagtgtcagcagccgaagcttcttttcgttccttggcgaggcttttnatggggctcgggacatgtngagagcctactctgacatgagagaagccaattacatcggctcagacaaatacttccatgctcgggggaactatgatgctgccaaaaggggacctgggggtgcctgggccgcagaagtgatcaggctgaagtgccatggcatgatcatngctcactgcaacctcgacctcccggggtctcaagagatcctcccatt

SEQ ID NO: 5410 - DNA, 234 bp, Homo sapiens
cgtaattatccacaggttaatgtaatcaacttcaccaccagctggtctgatggcctggctttgaatgctctcatccatagtcataggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaaca

SEQ ID NO: 5411 - DNA, 437 bp, Homo sapiens
  misc_feature (302)..(302): n is a, c, g, or t
  misc_feature (361)..(361): n is a, c, g, or t
  misc_feature (386)..(386): n is a, c, g, or t
  misc_feature (398)..(398): n is a, c, g, or t
  misc_feature (405)..(405): n is a, c, g, or t
  misc_feature (423)..(423): n is a, c, g, or t
  misc_feature (430)..(430): n is a, c, g, or t
agtatgtcactgccatccggaatctacgggaaggcacatgccagaagccccaacagatgaatgcaagcctgtgaagtggtgtgcgctgagccaccacgacgaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataaggagcgataattnttgaggatacaccagaggccagggtattttgctgttagcagtggttgaaggaattcagnttctgacctcacctgggacattctngaaaggcaagangtcctgncataacggcattttgcangaaccantagcttg

SEQ ID NO: 5412 - DNA, 1051 bp, Homo sapiens
cgggggagtgcttcatggtgaaagacctttcaaacccctcgagatacttgtgcaagtgccaacctggattcactggagcaagatgtactgagaatgtgcccatgaaagtccaaaaccaagaaaagcatcttgggattgaatttattgaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccg

SEQ ID NO: 5413 - DNA, 886 bp, Homo sapiens
gtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgccaacctggattcactggagcaagatgtactgagaatgtgcccatgaaagtccaaaaccaagaaagtgcccaaatgagtttactggtgatcgctgccaaaactacgtaatggccagcttctacagtacgtccactccctttctgtctctgcctgaataggagcatgctcagttggtgctgctttcttgttgctgcatctcccctcagattccacctagagctagatgtgtcttaccagatctaatattgactgcctctgcctgtcgcatgagaacattaacaaaagcaattgtattacttcctctgttcgcgactagttggctctgagatactaataggtgtgtgaggctccggatgtttctggaattgatattgaatgatgtgatacaaattgatagtcaatatcaagcagtgaaatatgataataaaggcatttcaaagtctcacttttattgataaaataaaaatcattctactgaacagtccatcttctttatacaatgaccacatcctgaaaagggtgttgctaagctgtaaccgatatgcacttgaaatgatggtaagttaattttgattcagaatgtgttatttgtcacaaataaacataataaaagg

SEQ ID NO: 5414 - DNA, 415 bp, Homo sapiens
ttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaagtatcagcccccatctaccaacaagaacacgaagtctcagagaaggaaaggaagtacatttgaagaacgca

SEQ ID NO: 5415 - DNA, 447 bp, Homo sapiens
  misc_feature (3)..(3): n is a, c, g, or t
  misc_feature (15)..(15): n is a, c, g, or t
atntcggaacgaggngtgaactgtgacaaagcaaactgctcaaccacctgctttaatggagggacctgtttctaccctggaaaatgtatttgccctccaggactagagggagagcagtgtgaaatcagcaaatgcccacaaccctgtcgaaatggaggtaaatgcattggtaaaagcaaatctgtctgcgagcctggctgtggtgcacatggaacctgccatgaacccaacaaatgccaatgtcaagaaggttggcatggaagacactgcaataaaaggtacgaagccagcctcatacatgcccttaggccaagcaggcgcccagctcaggcagcacacgccttcacttaaaaaggccgaggagcggggggatccacctgaatccaatttacatctgggttgaactcccgacatctggaaacgttttaagttacaccaagttcatag

SEQ ID NO: 5416 - DNA, 452 bp, Homo sapiens
  misc_feature (12)..(12): n is a, c, g, or t
  misc_feature (28)..(28): n is a, c, g, or t
  misc_feature (37)..(37): n is a, c, g, or t
  misc_feature (40)..(40): n is a, c, g, or t
  misc_feature (52)..(52): n is a, c, g, or t
  misc_feature (66)..(66): n is a, c, g, or t
  misc_feature (72)..(72): n is a, c, g, or t
  misc_feature (75)..(75): n is a, c, g, or t
  misc_feature (81)..(81): n is a, c, g, or t
  misc_feature (85)..(86): n is a, c, g, or t
  misc_feature (93)..(93): n is a, c, g, or t
  misc_feature (95)..(95): n is a, c, g, or t
  misc_feature (101)..(101): n is a, c, g, or t
  misc_feature (111)..(111): n is a, c, g, or t
  misc_feature (121)..(121): n is a, c, g, or t
  misc_feature (124)..(124): n is a, c, g, or t
  misc_feature (133)..(133): n is a, c, g, or t
  misc_feature (149)..(150): n is a, c, g, or t
  misc_feature (152)..(154): n is a, c, g, or t
  misc_feature (160)..(160): n is a, c, g, or t
  misc_feature (163)..(164): n is a, c, g, or t
  misc_feature (178)..(179): n is a, c, g, or t
  misc_feature (189)..(189): n is a, c, g, or t
  misc_feature (193)..(194): n is a, c, g, or t
  misc_feature (205)..(206): n is a, c, g, or t
  misc_feature (208)..(208): n is a, c, g, or t
  misc_feature (215)..(215): n is a, c, g, or t
  misc_feature (217)..(217): n is a, c, g, or t
  misc_feature (219)..(220): n is a, c, g, or t
  misc_feature (223)..(223): n is a, c, g, or t
  misc_feature (231)..(231): n is a, c, g, or t
  misc_feature (237)..(239): n is a, c, g, or t
  misc_feature (243)..(243): n is a, c, g, or t
  misc_feature (246)..(246): n is a, c, g, or t
  misc_feature (258)..(259): n is a, c, g, or t
  misc_feature (261)..(261): n is a, c, g, or t
  misc_feature (266)..(267): n is a, c, g, or t
  misc_feature (271)..(271): n is a, c, g, or t
  misc_feature (281)..(281): n is a, c, g, or t
  misc_feature (288)..(288): n is a, c, g, or t
  misc_feature (295)..(296): n is a, c, g, or t
  misc_feature (307)..(307): n is a, c, g, or t
  misc_feature (312)..(312): n is a, c, g, or t
  misc_feature (323)..(323): n is a, c, g, or t
  misc_feature (328)..(328): n is a, c, g, or t
  misc_feature (335)..(335): n is a, c, g, or t
  misc_feature (338)..(338): n is a, c, g, or t
  misc_feature (341)..(344): n is a, c, g, or t
  misc_feature (350)..(350): n is a, c, g, or t
  misc_feature (352)..(352): n is a, c, g, or t
  misc_feature (355)..(356): n is a, c, g, or t
  misc_feature (358)..(358): n is a, c, g, or t
  misc_feature (362)..(362): n is a, c, g, or t
  misc_feature (364)..(364): n is a, c, g, or t
  misc_feature (378)..(379): n is a, c, g, or t
  misc_feature (383)..(384): n is a, c, g, or t
  misc_feature (442)..(442): n is a, c, g, or t
cctagccaccanggacatcgccatccancacccctgnatncgccgccccttntttcctttccactnccccanccncctctntgannagttctncngagagnacctgttggngtctgatctnttnccgaccgtnctacttccctgagtcnntnnnaccttnggnnaccctccttcctgnnggcagccagntggnntgagactgganncncagagangncnntgnagaagganaggttnnntgtnaanctggatgtgaannanttctnnccanaggaactcanagttaangtgttgnnatatgtgattnaggtncactgggaaanatgangatcgcnagnatnnnnatggtntnatnncnaggnanttccacaggaaatnncggnntccagctgatgtagaccctctcacctttacttcatccctgtcatcttgatggggggtnctcactgtga

SEQ ID NO: 5417 - DNA, 1603 bp, Homo sapiens
acccccatgcattggttgcaccctcagatagtacccatgagcttcactgttcagcctcggggcccaggcgcttcctggaatctctccttggccggggttaaaatgcagttcccgctcaaaatgcttcataggttgatagaagtccagatcctgaggaaatctccagctaaatgctcaaaatataaaaactgaagctcacatttgcgaagagcagcagcatggatggattttatgaccagcaagtgccttacatggtcaccaatagtcagcgtgggagaaattgtaacgagaaaccaacaaatgtcaggaaaagaaaattcattaacagagatgtggctcatgattcagaagaactctttcaagatctaagtcaattacaggaaacatggcttgcagaagtggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagcttccctcctttgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccggcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtg

SEQ ID NO: 5418 - DNA, 2823 bp, Homo sapiens
tatgtaaggcggccaaggctgacctggtatttatggtggatggatcctggagcattggagatgaaaatttcaataagatcatcagctttctatacagcactgttggagccctgaacaagattggcacagatggaacccaagttgcaatggttcagttcactgatgatcccagaacagaatttaaactaaatgcttacaaaaccaaagagactcttcttgatgcaattaaacacatttcatacaaaggaggaaatacaaaaacaggaaaagcaattaagtatgttcgagataccttgttcactgcagagtcaggtacaagaaggggcatcccaaaggttatcgtggttataactgatggaagatcacaagatgatgtgaacaaaatctccagggagatgcaattagatggctatagcatttttgcaattggtgtggccgatgcagattactcggagttggttagcattggcagtaagcccagcgcacgccatgtcttctttgtggatgactttgacgcctttaagaaaatcgaagatgagttaattacttttgtctgcgaaacagcatcagcaacctgtccagtggtacacaaggatggcattgatcttgcaggatttaagatgatggaaatgtttggtttggttgaaaaagatttttcatcagtggaaggggtttctatggagcctggtaccttcaatgtgtttccatgttaccaactccataaagatgccctggtttcccagccaaccaggtacttgcacccagaaggattgccctccgactacacaatcagttttctattccggattcttcctgacactccacaggagccatttgctctttgggagattttaaataaaaattctgacccattggttggggttattttagacaatggtgggaaaactctaacatatttcaactatgaccagagtggggattttcaaactgttactttcgaaggacctgaaattaggaaaattttttatggaagctttcacaagctacacattgttgtcagtgagactttggtcaaagtggttattgactgcaagcaagtgggtgagaaggcaatgaacgcatcagctaatatcacgtcagatggtgtagaagtgctagggaaaatggttcgatcaagaggaccaggtggaaactctgcaccgttccagttacagatgtttgatattgtttgctccacatcatgggccaatacagacaaatgctgtgaacttccaggcctgagagatgatgagtcttgcccagaccttccccattcctgctcctgttctgaaaccaatgaagtggctctgggaccagcgggcccaccaggtggtccaggactccgaggaccaaagggccagcaaggtgaaccgggtccaaagggaccagatggccctcggggtgaaattggtctgccaggacctcagggtccacctggacctcaaggaccaagtggtctgtccattcaaggaatgcccggaatgccaggagaaaaaggagagaaaggagatactggccttccaggtccacagggtatcccaggaggcgttggttcaccaggacgtgatggctcaccaggccagaggggccttccgggaaaggatggatcctcgggacctccaggaccaccagggccaataggcattcctggcacccctggagtcccagggatcacaggaagcatgggaccgcaaggcgccctgggaccacctggtgtccctggagcaaagggggaacgaggagagcggggtgacctgcagtctcaagccatggtgagatcagtggcgcgtcaagtatgcgaacagctcatccagagtcacatggccaggtacactgccatcctcaaccagattcccagccactcctcatccatccggactgtccaagggcctcctggggagcctgggaggccaggctcacctggagcccctggtgaacaaggacccccaggaacaccaggcttccccggaaatgcaggcgtaccagggaccccaggagaacgaggtctaactggtatcaaaggagaaaaaggaaatccaggcgttggaacccaaggtccaagaggcccccctggaccagcaggaccttcaggggagagtcggcctggcagccctgggccccctggctctcctggaccaagaggcccaccaggtcatctgggggttcctggaccccaaggtccttctggccagcctggatattgtgacccctcatcatgttctgcctatggtgtgagagatctgatcccctacaatgattaccagcactgaagtggaaatcctccactctggttccattggccccagacatttagctgtggatacagaactgtcctgtcaaccaccaccaccaccaagcccctgcccctaacaatggacactctgcttccctgcttcttctgcatccctgccttcccactttcaaacctcttgcccactctgctccaaacatgatggagtgataacatcggaacttaaccaaatcatatatgtctattttaatagacactgactgctccatgtcagcctggatagaggtatatgacgtgtgccaagaatttatcccagactcccctgtgtgacagcttcataataaagttacttaactgtgcctcttcctccttcctctccccacacaggatggatgggcatctttctccttgaccaccctactctcccttcctcccctgatcacctcccctccctgctctcccctggtgatggacttctaacatgagatttttttaaaaaatttctatttcttttataattttgctgagttttcagggtttcttctgtaaataaaacataatatttaaaaaaa

SEQ ID NO: 5419 - DNA, 3727 bp, Homo sapiens
agttgagattaatctacaggaggaggagaagaatcatccacaccactcttcgccacccggctgggagcaattccagaaggcagggtctgcttgggcagttgagaggccttgggtcatgccgcttattgaaaccatcagcaggaggagtttggataaagctgaagttccacttaggcgctcggtgatccatctgggaagacagtggccacagcccaacaggaggccggggaacctggaccccaccagccaagctttgagaagcagataggcttgaatgagcatggaatgtatctatttaaaaagcagctggaagtctgtcaagtgcattctggaaatggattcaggctaacagagtgttctgaatagagacgcctaaaacaagtaagtatgatctgttatcaatgcattatcactttatggtatacgattgattttcttaagtatgtgattgtagtgtctataattttgtgtttttgtacttagcaaccctttttcatatagatggaatcagaataaatttcatcctagttctatttccaaaatattattggtgcccctagttgtactgcctgagtgttgtcagatcaaggcttacaaactcacgggcgatgctgcagaatgagtgacaacagataatgccaattgcccagattgaatccagcaagaaatgacattggaatggctctaccttgtggagggaactgtccagtgcagaggacctgcctgagtattgcttacaatacatctttctggttataatgaagccatttatttgtttacatctttattattgccactttcctccactggcttggaaatccttagagcctagaacaatgctgggcttggagcaggtgcttgaaagcatattaccaaaatgaatgaataaatgaatgaatgaaagaataggcgaagatgctggtgcagacctcggtcttttgtgagcttggtgagtgtgaaccagagtctgagatccccggtttccctgattagacactgaggatcagacgttggaagcaccactgtcctgtaaggccccttctcacccagctcggcagcctttgctacacccctgtctttattaactgtcctctgtgagtccaccttgaaaggttctcacttacttgctttttctctctgcaggagccaaagacatagcaatggagaacgtgggtggtacagccctccaccctggcgagcagcacattagaatcacgtaggagcttaaaaagtactgactggcctggtctttttcggtgtgaaggtgggatgcaggcttcctggggttttcctctcgtacagccagagttgagaaccatctgagtagcgcttgtcacacttctggccacatcagaatcgtctgagggacttgttcactgcaggttgctgggtcccatctctagcctctgatccagtagcctggggtggggcacaggatgtcctgctgctggggtctgggcagcgctatgagaactgctgacgttggagctcgatcaggtggtccctcactccctgacccagggcatttgctgcttcctgtctctgccattcttttctcaacctggggcacttgcttttctcgctatgctgccctgccctttgctgaggcctgggctatccctggcagggtgcagaaaaaaaatttttaagttacttttctcagcccaaaggagactggaatgcttcacaagggattctacttgacaggcaattggaccacccaaatggcaaactaaaagcatagaagcggacaccagaggctcctggacctgagatgtggccctggaagtgaccagatgtggtctcaagagatgggggcccagggctaggaatgccgccatccggggaggccctagagcagagcagagcagctgtgggctggtgccaagctcactcctgcttctctctgcacgtctccctcattcttttctctctgaactgtgacccttttggcccctctgagtaccaggtgggacaaggtgacccctcagcacttgagtttacaccttagatgtgtaggtcctcacagaggccaacttatctccttctgggaccaaattccaaattcctaaagaaaaaacaaaccaaaaacggatatgataaacctatctcagtggtcagcccctggggcgcaaacattcccctgagtcagggaagggtgactgtaacacaggtatcattatgatttaggtgtggcaagactagcaggtcaggggtgcctgccattgaaaagactgtcatacagttcccgggtggaaggggtgtgccaggaggggcagccagaaggcagatggagggaagctgcctttatggtgtttctgctgggaggcacaggtgcggtggaggaagcaggcttaggattggttcgtgtgaatgtcttcagtgggctctggttatctggtacctggcccggggtgatgagggtagatagaggcccagaaggtgagagcctaatacccagagcggtcgggggggtgggtaggctcagggctggttggtttgggaagcatgtttgtgggcccgttggttaccgtctcaaggaatgggctaggcctgggtgtggctgtccttctaggatcagcaaggcagcaaatatcaaagcaccagaatacacaaagtaaaagactacattaatacagggtagtttacaaagaaatgggaaattgttggttctgagctgggtggggattgaaacggtgttccctgcagatccatttaaagtctctctgtaaatacgcgttggtgtgtaactgttccttgtctctaacctcagccagcccctcccatgccaggtgaggggtcttcccacctcccttttcctctctgggtgtccctccattatgatctggggaccaaggctggctgtagcagtgtgcctccatggcctagggcggttggcaaatgcaatttcttcggcagtgctggataaagtgggatgatgcagtgaccacacataatgtcatttctgatgaaagctggcatgccagcccgtgacaggacacagaggagcgtggattccccttcatggttgacttcagccaaggccatcatccccgctgccaaagcctgccctgattgcctgccctgggggagagaagtgttttgaagatgacaaatcaaagtcaggtcctgcatggagtttgcgtgcctgacagcctggctagcacaggaggacatgcaggtggaatttgtgcaagcctgttattttctgtaacacaatacacactgagaaggcaatgggtaccttggaccctgcaggccaattcaagcaccatcactacttttcagaagtgtggggcatagatgtcaactgagcctagcaagatgtcctatgttaccaagagactattagaaagcagagcaggtctcaagattcaatgaaacaattgcctggaagctggaagataatatggaagctagggatataatagagtatgttgctgggaacggtggctcctgcctgtaatcgcagcactttgggaggctgaggtaggggggatcacttgagcccaggagttggaggccagcctgggcaacacagcaagaccccatttctataaataattaaaaaaaaaattagctgggtgttgtggtgcatgcctgtattcttaactactccagaggctgaggtgggaggatggcttgagtccagaagttcaaggttacagtgaactacgattgagccacactgcattccagctgggtaacagagggagactctgtctct

SEQ ID NO: 5420 - DNA, 4678 bp, Homo sapiens
gcacacagagcagcataaagcccagttgctttgggaagtgtttgggaccagatggattgtagggagtagggtacaatacagtctgttctcctccagctccttctttctgcaacatggggaagaacaaactccttcatccaagtctggttcttctcctcttggtcctcctgcccacagacgcctcagtctctggaaaaccgcagtatatggttctggtcccctccctgctccacactgagaccactgagaagggctgtgtccttctgagctacctgaatgagacagtgactgtaagtgcttccttggagtctgtcaggggaaacaggagcctcttcactgacctggaggcggagaatgacgtactccactgtgtcgccttcgctgtcccaaagtcttcatccaatgaggaggtaatgttcctcactgtccaagtgaaaggaccaacccaagaatttaagaagcggaccacagtgatggttaagaacgaggacagtctggtctttgtccagacagacaaatcaatctacaaaccagggcagacagtgaaatttcgtgttgtctccatggatgaaaactttcaccccctgaatgagttgattccactagtatacattcaggatcccaaaggaaatcgcatcgcacaatggcagagtttccagttagagggtggcctcaagcaattttcttttcccctctcatcagagcccttccagggctcctacaaggtggtggtacagaagaaatcaggtggaaggacagagcaccctttcaccgtggaggaatttgttcttcccaagtttgaagtacaagtaacagtgccaaagataatcaccatcttggaagaagagatgaatgtatcagtgtgtggcctatacacatatgggaagcctgtccctggacatgtgactgtgagcatttgcagaaagtatagtgacgcttccgactgccacggtgaagattcacaggctttctgtgagaaattcagtggacagctaaacagccatggctgcttctatcagcaagtaaaaaccaaggtcttccagctgaagaggaaggagtatgaaatgaaacttcacactgaggcccagatccaagaagaaggaacagtggtggaattgactggaaggcagtccagtgaaatcacaagaaccataaccaaactctcatttgtgaaagtggactcacactttcgacagggaattcccttctttgggcaggtgcgcctagtagatgggaaaggcgtccctataccaaataaagtcatattcatcagaggaaatgaagcaaactattactccaatgctaccacggatgagcatggccttgtacagttctctatcaacaccaccaatgttatgggtacctctcttactgttagggtcaattacaaggatcgtagtccctgttacggctaccagtgggtgtcagaagaacacgaagaggcacatcacactgcttatcttgtgttctccccaagcaagagctttgtccaccttgagcccatgtctcatgaactaccctgtggccatactcagacagtccaggcacattatattctgaatggaggcaccctgctggggctgaagaagctctccttctattatctgataatggcaaagggaggcattgtccgaactgggactcatggactgcttgtgaagcaggaagacatgaagggccatttttccatctcaatccctgtgaagtcagacattgctcctgtcgctcggttgctcatctatgctgttttacctaccggggacgtgattggggattctgcaaaatatgatgttgaaaattgtctggccaacaaggtggatttgagcttcagcccatcacaaagtctcccagcctcacacgcccacctgcgagtcacagcggctcctcagtccgtctgcgccctccgtgctgtggaccaaagcgtgctgctcatgaagcctgatgctgagctctcggcgtcctcggtttacaacctgctaccagaaaaggacctcactggcttccctgggcctttgaatgaccaggacgatgaagactgcatcaatcgtcataatgtctatattaatggaatcacatatactccagtatcaagtacaaatgaaaaggatatgtacagcttcctagaggacatgggcttaaaggcattcaccaactcaaagattcgtaaacccaaaatgtgtccacagcttcaacagtatgaaatgcatggacctgaaggtctacgtgtaggtttttatgagtcagatgtaatgggaagaggccatgcacgcctggtgcatgttgaagagcctcacacggagaccgtacgaaagtacttccctgagacatggatctgggatttggtggtggtaaactcagcaggtgtggctgaggtaggagtaacagtccctgacaccatcaccgagtggaaggcaggggccttctgcctgtctgaagatgctggacttggtatctcttccactgcctctctccgagccttccagcccttctttgtggagctcacaatgccttactctgtgattcgtggagaggccttcacactcaaggccacggtcctaaactaccttcccaaatgcatccgggtcagtgtgcagctggaagcctctcccgccttcctagctgtcccagtggagaaggaacaagcgcctcactgcatctgtgcaaacgggcggcaaactgtgtcctgggcagtaaccccaaagtcattaggaaatgtgaatttcactgtgagcgcagaggcactagagtctcaagagctgtgtgggactgaggtgccttcagttcctgaacacggaaggaaagacacagtcatcaagcctctgttggttgaacctgaaggactagagaaggaaacaacattcaactccctactttgtccatcaggtggtgaggtttctgaagaattatccctgaaactgccaccaaatgtggtagaagaatctgcccgagcttctgtctcagttttgggagacatattaggctctgccatgcaaaacacacaaaatcttctccagatgccctatggctgtggagagcagaatatggtcctctttgctcctaacatctatgtactggattatctaaatgaaacacagcagcttactccagagatcaagtccaaggccattggctatctcaacactggttaccagagacagttgaactacaaacactatgatggctcctacagcacctttggggagcgatatggcaggaaccagggcaacacctggctcacagcctttgttctgaagacttttgcccaagctcgagcctacatcttcatcgatgaagcacacattacccaagccctcatatggctctcccagaggcagaaggacaatggctgtttcaggagctctgggtcactgctcaacaatgccataaagggaggagtagaagatgaagtgaccctctccgcctatatcaccatcgcccttctggagattcctctcacagtcactcaccctgttgtccgcaatgccctgttttgcctggagtcagcctggaagacagcacaagaaggggaccatggcagccatgtatataccaaagcactgctggcctatgcttttgccctggcaggtaaccaggacaagaggaaggaagtactcaagtcacttaatgaggaagctgtgaagaaagacaactctgtccattgggagcgccctcagaaacccaaggcaccagtggggcatttttacgaaccccaggctccctctgctgaggtggagatgacatcctatgtgctcctcgcttatctcacggcccagccagccccaacctcggaggacctgacctctgcaaccaacatcgtgaagtggatcacgaagcagcagaatgcccagggcggtttctcctccacccaggacacagtggtggctctccatgctctgtccaaatatggagcagccacatttaccaggactgggaaggctgcacaggtgactatccagtcttcagggacattttccagcaaattccaagtggacaacaacaaccgcctgttactgcagcaggtctcattgccagagctgcctggggaatacagcatgaaagtgacaggagaaggatgtgtctacctccagacatccttgaaatacaatattctcccagaaaaggaagagttcccctttgctttaggagtgcagactctgcctcaaacttgtgatgaacccaaagcccacaccagcttccaaatctccctaagtgtcagttacacagggagccgctctgcctccaacatggcgatcgttgatgtgaagatggtctctggcttcattcccctgaagccaacagtgaaaatgcttgaaagatctaaccatgtgagccggacagaagtcagcagcaaccatgtcttgatttaccttgataaggtgtcaaatcagacactgagcttgttcttcacggttctgcaagatgtcccagtaagagatctgaaaccagccatagtgaaagtctatgattactacgagacggatgagtttgcaattgctgagtacaatgctccttgcagcaaagatcttggaaatgcttgaagaccacaaggctgaaaagtgctttgctggagtcctgttctcagagctccacagaagacacgtgtttttgtatctttaaagacttgatgaataaacactttttctggtcaatgtcaaaaaaaaaaaaaaaaaaaaaaaaa

SEQ ID NO: 5421 - DNA, 14069 bp, Homo sapiens
cgttaaatgcaaacgctgctctggctcatgtgtttgctccgaggtataggttttgttcgactgacgtatcagatagtcagagtggttaccacaccgacgttgtagcagctgcataataaatgactgaaagaatcatgttaggcatgcccacctaacctaacttgaatcatgcgaaaggggagctgttggaattcaaatagactttctggttcccagcagtcggcagtaatagaatgctttcaggaagatgacagaatcaggagaaagatgctgttttgcactatcttgatttgttacagcagccaacttattggcatgatggagtgacaggaaaaacagctggcatggaagatgaaagagaagatgttcaaaagaaaacattcacaaaatgggtaaatgcacaattttctaagtttgggaagcagcatattgagaacctcttcagtgacctacaggatgggaggcgcctcctagacctcctcgaaggcctgacagggcaaaaactgccaaaagaaaaaggatccacaagagttcatgccctgaacaatgtcaacaaggcactgcgggttttgcagaacaataatgttgatttagtgaatattggaagtactgacatcgtagatggaaatcataaactgactcttggtttgatttggaatataatcctccactggcaggtcaaaaatgtaatgaaaaatatcatggctggattgcaacaaaccaacagtgaaaagattctcctgagctgggtccgacaatcaactcgtaattatccacaggttaatgtaatcaacttcaccaccagctggtctgatggcctggctttgaatgctctcatccatagtcataggccagacctatttgactggaatagtgtggtttgccagcagtcagccacacaacgactggaacatgcattcaacatcgccagatatcaattaggcatagagaaactactcgatcctgaagatgttgataccacctatccagataagaagtccatcttaatgtacatcacatcactcttccaagttttgcctcaacaagtgagcattgaagccatccaggaagtggaaatgttgccaaggccacctaaagtgactaaagaagaacattttcagttacatcatcaaatgcactattctcaacagatcacggtcagtctagcacagggatatgagagaacttcttcccctaagcctcgattcaagagctatgcctacacacaggctgcttatgtcaccacctctgaccctacacggagcccatttccttcacagcatttggaagctcctgaagacaagtcatttggcagttcattgatggagagtgaagtaaacctggaccgttatcaaacagctttagaagaagtattatcgtggcttctttctgctgaggacacattgcaagcacaaggagagatttctaatgatgtggaagtggtgaaagaccagtttcatactcatgaggggtacatgatggatttgacagcccatcagggccgggttggtaatattctacaattgggaagtaagctgattggaacaggaaaattatcagaagatgaagaaactgaagtacaagagcagatgaatctcctaaattcaagatgggaatgcctcagggtagctagcatggaaaaacaaagcaatttacatagagttttaatggatctccagaatcagaaactgaaagagttgaatgactggctaacaaaaacagaagaaagaacaaggaaaatggaggaagagcctcttggacctgatcttgaagacctaaaacgccaagtacaacaacataaggtgcttcaagaagatctagaacaagaacaagtcagggtcaattctctcactcacatggtggtggtagttgatgaatctagtggagatcacgcaactgctgctttggaagaacaacttaaggtattgggagatcgatgggcaaacatctgtagatggacagaagaccgctgggttcttttacaagacatccttctcaaatggcaacgtcttactgaagaacagtgcctttttagtgcatggctttcagaaaaagaagatgcagtgaacaagattcacacaactggctttaaagatcaaaatgaaatgttatcaagtcttcaaaaactggccgttttaaaagcggatctagaaaagaaaaagcaatccatgggcaaactgtattcactcaaacaagatcttctttcaacactgaagaataagtcagtgacccagaagacggaagcatggctggataactttgcccggtgttgggataatttagtccaaaaacttgaaaagagtacagcacagatttcacaggctgtcaccaccactcagccatcactaacacagacaactgtaatggaaacagtaactacggtgaccacaagggaacagatcctggtaaagcatgctcaagaggaacttccaccaccacctccccaaaagaagaggcagattactgtggattctgaaattaggaaaaggttggatgttgatataactgaacttcacagctggattactcgctcagaagctgtgttgcagagtcctgaatttgcaatctttcggaaggaaggcaacttctcagacttaaaagaaaaagtcaatgccatagagcgagaaaaagctgagaagttcagaaaactgcaagatgccagcagatcagctcaggccctggtggaacagatggtgaatgagggtgttaatgcagatagcatcaaacaagcctcagaacaactgaacagccggtggatcgaattctgccagttgctaagtgagagacttaactggctggagtatcagaacaacatcatcgctttctataatcagctacaacaattggagcagatgacaactactgctgaaaactggttgaaaatccaacccaccaccccatcagagccaacagcaattaaaagtcagttaaaaatttgtaaggatgaagtcaaccggctatcaggtcttcaacctcaaattgaacgattaaaaattcaaagcatagccctgaaagagaaaggacaaggacccatgttcctggatgcagactttgtggcctttacaaatcattttaagcaagtcttttctgatgtgcaggccagagagaaagagctacagacaatttttgacactttgccaccaatgcgctatcaggagaccatgagtgccatcaggacatgggtccagcagtcagaaaccaaactctccatacctcaacttagtgtcaccgactatgaaatcatggagcagagactcggggaattgcaggctttacaaagttctctgcaagagcaacaaagtggcctatactatctcagcaccactgtgaaagagatgtcgaagaaagcgccctctgaaattagccggaaatatcaatcagaatttgaagaaattgagggacgctggaagaagctctcctcccagctggttgagcattgtcaaaagctagaggagcaaatgaataaactccgaaaaattcagaatcacatacaaaccctgaagaaatggatggctgaagttgatgtttttctgaaggaggaatggcctgcccttggggattcagaaattctaaaaaagcagctgaaacagtgcagacttttagtcagtgatattcagacaattcagcccagtctaaacagtgtcaatgaaggtgggcagaagataaagaatgaagcagagccagagtttgcttcgagacttgagacagaactcaaagaacttaacactcagtgggatcacatgtgccaacaggtctatgccagaaaggaggccttgaagggaggtttggagaaaactgtaagcctccagaaagatctatcagagatgcacgaatggatgacacaagctgaagaagagtatcttgagagagattttgaatataaaactccagatgaattacagaaagcagttgaagagatgaagagagctaaagaagaggcccaacaaaaagaagcgaaagtgaaactccttactgagtctgtaaatagtgtcatagctcaagctccacctgtagcacaagaggccttaaaaaaggaacttgaaactctaaccaccaactaccagtggctctgcactaggctgaatgggaaatgcaagactttggaagaagtttgggcatgttggcatgagttattgtcatacttggagaaagcaaacaagtggctaaatgaagtagaatttaaacttaaaaccactgaaaacattcctggcggagctgaggaaatctctgaggtgctagattcacttgaaaatttgatgcgacattcagaggataacccaaatcagattcgcatattggcacagaccctaacagatggcggagtcatggatgagctaatcaatgaggaacttgagacatttaattctcgttggagggaactacatgaagaggctgtaaggaggcaaaagttgcttgaacagagcatccagtctgcccaggagactgaaaaatccttacacttaatccaggagtccctcacattcattgacaagcagttggcagcttatattgcagacaaggtggacgcagctcaaatgcctcaggaagcccagaaaatccaatctgatttgacaagtcatgagatcagtttagaagaaatgaagaaacataatcaggggaaggaggctgcccaaagagtcctgtctcagattgatgttgcacagaaaaaattacaagatgtctccatgaagtttcgattattccagaaaccagccaattttgagcagcgtctacaagaaagtaagatgattttagatgaagtgaagatgcacttgcctgcattggaaacaaagagtgtggaacaggaagtagtacagtcacagctaaatcattgtgtgaacttgtataaaagtctgagtgaagtgaagtctgaagtggaaatggtgataaagactggacgtcagattgtacagaaaaagcagacggaaaatcccaaagaacttgatgaaagagtaacagctttgaaattgcattataatgagctgggagcaaaggtaacagaaagaaagcaacagttggagaaatgcttgaaattgtcccgtaagatgcgaaaggaaatgaatgtcttgacagaatggctggcagctacagatatggaattgacaaagagatcagcagttgaaggaatgcctagtaatttggattctgaagttgcctggggaaaggctactcaaaaagagattgagaaacagaaggtgcacctgaagagtatcacagaggtaggagaggccttgaaaacagttttgggcaagaaggagacgttggtggaagataaactcagtcttctgaatagtaactggatagctgtcacctcccgagcagaagagtggttaaatcttttgttggaataccagaaacacatggaaacttttgaccagaatgtggaccacatcacaaagtggatcattcaggctgacacacttttggatgaatcagagaaaaagaaaccccagcaaaaagaagacgtgcttaagcgtttaaaggcagaactgaatgacatacgcccaaaggtggactctacacgtgaccaagcagcaaacttgatggcaaaccgcggtgaccactgcaggaaattagtagagccccaaatctcagagctcaaccatcgatttgcagccatttcacacagaattaagactggaaaggcctccattcctttgaaggaattggagcagtttaactcagatatacaaaaattgcttgaaccactggaggctgaaattcagcagggggtgaatctgaaagaggaagacttcaataaagatatgaatgaagacaatgagggtactgtaaaagaattgttgcaaagaggagacaacttacaacaaagaatcacagatgagagaaagcgagaggaaataaagataaaacagcagctgttacagacaaaacataatgctctcaaggatttgaggtctcaaagaagaaaaaaggctctagaaatttctcatcagtggtatcagtacaagaggcaggctgatgatctcctgaaatgcttggatgacattgaaaaaaaattagccagcctacctgagcccagagatgaaaggaaaataaaggaaattgatcgggaattgcagaagaagaaagaggagctgaatgcagtgcgtaggcaagctgagggcttgtctgaggatggggccgcaatggcagtggagccaactcagatccagctcagcaagcgctggcgggaaattgagagcaaatttgctcagtttcgaagactcaactttgcacaaattcacactgtccgtgaagaaacgatgatggtgatgactgaagacatgcctttggaaatttcttatgtgccttctacttatttgactgaaatcactcatgtctcacaagccctattagaagtggaacaacttctcaatgctcctgacctctgtgctaaggactttgaagatctctttaagcaagaggagtctctgaagaatataaaagatagtctacaacaaagctcaggtcggattgacattattcatagcaagaagacagcagcattgcaaagtgcaacgcctgtggaaagggtgaagctacaggaagctctctcccagcttgatttccaatgggaaaaagttaacaaaatgtacaaggaccgacaagggcgatttgacagatctgttgagaaatggcggcgttttcattatgatataaagatatttaatcagtggctaacagaagctgaacagtttctcagaaagacacaaattcctgagaattgggaacatgctaaatacaaatggtatcttaaggaactccaggatggcattgggcagcggcaaactgttgtcagaacattgaatgcaactggggaagaaataattcagcaatcctcaaaaacagatgccagtattctacaggaaaaattgggaagcctgaatctgcggtggcaggaggtctgcaaacagctgtcagacagaaaaaagaggctagaagaacaaaagaatatcttgtcagaatttcaaagagatttaaatgaatttgttttatggttggaggaagcagataacattgctagtatcccacttgaacctggaaaagagcagcaactaaaagaaaagcttgagcaagtcaagttactggtggaagagttgcccctgcgccagggaattctcaaacaattaaatgaaactggaggacccgtgcttgtaagtgctcccataagcccagaagagcaagataaacttgaaaataagctcaagcagacaaatctccagtggataaaggtttccagagctttacctgagaaacaaggagaaattgaagctcaaataaaagaccttgggcagcttgaaaaaaagcttgaagaccttgaagagcagttaaatcatctgctgctgtggttatctcctattaggaatcagttggaaatttataaccaaccaaaccaagaaggaccatttgacgttcaggaaactgaaatagcagttcaagctaaacaaccggatgtggaagagattttgtctaaagggcagcatttgtacaaggaaaaaccagccactcagccagtgaagaggaagttagaagatctgagctctgagtggaaggcggtaaaccgtttacttcaagagctgagggcaaagcagcctgacctagctcctggactgaccactattggagcctctcctactcagactgttactctggtgacacaacctgtggttactaaggaaactgccatctccaaactagaaatgccatcttccttgatgttggaggtacctgctctggcagatttcaaccgggcttggacagaacttaccgactggctttctctgcttgatcaagttataaaatcacagagggtgatggtgggtgaccttgaggatatcaacgagatgatcatcaagcagaaggcaacaatgcaggatttggaacagaggcgtccccagttggaagaactcattaccgctgcccaaaatttgaaaaacaagaccagcaatcaagaggctagaacaatcattacggatcgaattgaaagaattcagaatcagtgggatgaagtacaagaacaccttcagaaccggaggcaacagttgaatgaaatgttaaaggattcaacacaatggctggaagctaaggaagaagctgagcaggtcttaggacaggccagagccaagcttgagtcatggaaggagggtccctatacagtagatgcaatccaaaagaaaatcacagaaaccaagcagttggccaaagacctccgccagtggcagacaaatgtagatgtggcaaatgacttggccctgaaacttctccgggattattctgcagatgataccagaaaagtccacatgataacagagaatatcaatgcctcttggagaagcattcataaaagggtgagtgagcgagaggctgctttggaagaaactcatagattactgcaacagttccccctggacctggaaaagtttcttgcctggcttacagaagctgaaacaactgccaatgtcctacaggatgctacccgtaaggaaaggctcctagaagactccaagggagtaaaagagctgatgaaacaatggcaagacctccaaggtgaaattgaagctcacacagatgtttatcacaacctggatgaaaacagccaaaaaatcctgagatccctggaaggttccgatgatgcagtcctgttacaaagacgtttggataacatgaacttcaagtggagtgaacttcggaaaaagtctctcaacattaggtcccatttggaagccagttctgaccagtggaagcgtctgcacctttctctgcaggaacttctggtgtggctacagctgaaagatgatgaattaagccggcaggcacctattggaggcgactttccagcagttcagaagcagaacgatgtacatagggccttcaagagggaattgaaaactaaagaacctgtaatcatgagtactcttgagactgtacgaatatttctgacagagcagcctttggaaggactagagaaactctaccaggagcccagagagctgcctcctgaggagagagcccagaatgtcactcggcttctacgaaagcaggctgaggaggtcaatactgagtgggaaaaattgaacctgcactccgctgactggcagagaaaaatagatgagacccttgaaagactccaggaacttcaagaggccacggatgagctggacctcaagctgcgccaagctgaggtgatcaagggatcctggcagcccgtgggcgatctcctcattgactctctccaagatcacctcgagaaagtcaaggcacttcgaggagaaattgcgcctctgaaagagaacgtgagccacgtcaatgaccttgctcgccagcttaccactttgggcattcagctctcaccgtataacctcagcactctggaagacctgaacaccagatggaagcttctgcaggtggccgtcgaggaccgagtcaggcagctgcatgaagcccacagggactttggtccagcatctcagcactttctttccacgtctgtccagggtccctgggagagagccatctcgccaaacaaagtgccctactatatcaaccacgagactcaaacaacttgctgggaccatcccaaaatgacagagctctaccagtctttagctgacctgaataatgtcagattctcagcttataggactgccatgaaactccgaagactgcagaaggccctttgcttggatctcttgagcctgtcagctgcatgtgatgccttggaccagcacaacctcaagcaaaatgaccagcccatggatatcctgcagattattaattgtttgaccactatttatgaccgcctggagcaagagcacaacaatttggtcaacgtccctctctgcgtggatatgtgtctgaactggctgctgaatgtttatgatacgggacgaacagggaggatccgtgtcctgtcttttaaaactggcatcatttccctgtgtaaagcacatttggaagacaagtacagataccttttcaagcaagtggcaagttcaacaggattttgtgaccagcgcaggctgggcctccttctgcatgattctatccaaattccaagacagttgggtgaagttgcatcctttgggggcagtaacattgagccaagtgtccggagctgcttccaatttgctaataataagccagagatcgaagcggccctcttcctagactggatgagactggaaccccagtccatggtgtggctgcccgtcctgcacagagtggctgctgcagaaactgccaagcatcaggccaaatgtaacatctgcaaagagtgtccaatcattggattcaggtacaggagtctaaagcactttaattatgacatctgccaaagctgctttttttctggtcgagttgcaaaaggccataaaatgcactatcccatggtggaatattgcactccgactacatcaggagaagatgttcgagactttgccaaggtactaaaaaacaaatttcgaaccaaaaggtattttgcgaagcatccccgaatgggctacctgccagtgcagactgtcttagagggggacaacatggaaactcccgttactctgatcaacttctggccagtagattctgcgcctgcctcgtcccctcagctttcacacgatgatactcattcacgcattgaacattatgctagcaggctagcagaaatggaaaacagcaatggatcttatctaaatgatagcatctctcctaatgagagcatagatgatgaacatttgttaatccagcattactgccaaagtttgaaccaggactcccccctgagccagcctcgtagtcctgcccagatcttgatttccttagagagtgaggaaagaggggagctagagagaatcctagcagatcttgaggaagaaaacaggaatctgcaagcagaatatgaccgtctaaagcagcagcacgaacataaaggcctgtccccactgccgtcccctcctgaaatgatgcccacctctccccagagtccccgggatgctgagctcattgctgaggccaagctactgcgtcaacacaaaggccgcctggaagccaggatgcaaatcctggaagaccacaataaacagctggagtcacagttacacaggctaaggcagctgctggagcaaccccaggcagaggccaaagtgaatggcacaacggtgtcctctccttctacctctctacagaggtccgacagcagtcagcctatgctgctccgagtggttggcagtcaaacttcggactccatgggtgaggaagatcttctcagtcctccccaggacacaagcacagggttagaggaggtgatggagcaactcaacaactccttccctagttcaagaggaagaaatacccctggaaagccaatgagagaggacacaatgtaggaagtcttttccacatggcagatgatttgggcagagcgatggagtccttagtatcagtcatgacagatgaagaaggagcagaataaatgttttacaactcctgattcccgcatggtttttataatattcatacaacaaagaggattagacagtaagagtttacaagaaataaatctatatttttgtgaagggtagtggtattatactgtagatttcagtagtttctaagtctgttattgttttgttaacaatggcaggttttacacgtctatgcaattgtacaaaaaagttataagaaaactacatgtaaaatcttgatagctaaataacttgccatttctttatatggaacgcattttgggttgtttaaaaatttataacagttataaagaaagattgtaaactaaagtgtgctttataaaaaaaagttgtttataaaaacccctaaaaacaaaacaaacacacacacacacacatacacacacacacacaaaactttgaggcagcgcattgttttgcatccttttggcgtgatatccatatgaaattcatggctttttctttttttgcatattaaagataagacttcctctaccaccacaccaaatgactactacacactgctcatttgagaactgtcagctgagtggggcaggcttgagttttcatttcatatatctatatgtctataagtatataaatactatagttatatagataaagagatacgaatttctatagactgactttttccattttttaaatgttcatgtcacatcctaatagaaagaaattacttctagtcagtcatccaggcttacctgcttggtctagaatggatttttcccggagccggaagccaggaggaaactacaccacactaaaacattgtctacagctccagatgtttctcattttaaacaactttccactgacaacgaaagtaaagtaaagtattggatttttttaaagggaacatgtgaatgaatacacaggacttattatatcagagtgagtaatcggttggttggttgattgattgattgattgatacattcagcttcctgctgctagcaatgccacgatttagatttaatgatgcttcagtggaaatcaatcagaaggtattctgaccttgtgaacatcagaaggtattttttaactcccaagcagtagcaggacgatgatagggctggagggctatggattcccagcccatccctgtgaaggagtaggccactctttaagtgaaggattggatgattgttcataatacataaagttctctgtaattacaactaaattattatgccctcttctcacagtcaaaaggaactgggtggtttggtttttgttgcttttttagatttattgtcccatgtgggatgagtttttaaatgccacaagacataatttaaaataaataaactttgggaaaaggtgtaagacagtagccccatcacatttgtgatactgacaggtatcaacccagaagcccatgaactgtgtttccatcctttgcatttctctgcgagtagttccacacaggtttgtaagtaagtaagaaagaaggcaaattgattcaaatgttacaaaaaaacccttcttggtggattagacaggttaaatatataaacaaacaaacaaaaattgctcaaaaaagaggagaaaagctcaagaggaaaagctaaggactggtaggaaaaagctttactctttcatgccattttatttctttttgatttttaaatcattcattcaatagataccaccgtgtgacctataattttgcaaatctgttacctctgacatcaagtgtaattagcttttggagagtgggctgacatcaagtgtaattagcttttggagagtgggttttgtccattattaataattaattaattaacatcaaacacggcttctcatgctatttctacctcactttggttttggggtgttcctgataattgtgcacacctgagttcacagcttcaccacttgtccattgcgttattttctttttcctttataattctttctttttccttcataattttcaaaagaaaacccaaagctctaaggtaacaaattaccaaattacatgaagatttggtttttgtcttgcatttttttcctttatgtgacgctggaccttttctttacccaaggatttttaaaactcagatttaaaacaaggggttactttacatcctactaagaagtttaagtaagtaagtttcattctaaaatcagaggtaaatagagtgcataaataattttgttttaatctttttgtttttcttttagacacattagctctggagtgagtctgtcataatatttgaacaaaaattgagagctttattgctgcattttaagcataattaatttggacattatttcgtgttgtgttctttataaccaccgagtattaaactgtaaatcataatgtaactgaagcataaacatcacatggcatgttttgtcattgttttcaggtactgagttcttacttgagtatcataatatattgtgttttaacaccaacactgtaacatttacgaattatttttttaaacttcagttttactgcattttcacaacatatcagacttcaccaaatatatgccttactattgtattatagtactgctttactgtgtatctcaataaagcacgcagttatgttac

SEQ ID NO: 5422 - DNA, 2160 bp, Homo sapiens
ctttaatgggaaggccattttttggtttcagttacggtaaatctctctggatttcagccaaattctttcagagttcaaaagtacaaagctctttaggaggtttgttcttttgaaacattttttcagaggttaaaaattaaatttcaaaagaatacctggagtggaaaagagttctcagcagagacaaagaccccgaacacctccaacatgaagcttcttcatgttttcctgttatttctgtgcttccacttaaggttttgcaaggtcacttatacatctcaagaggatctggtggagaaaaagtgcttagcaaaaaaatatactcacctctcctgcgataaagtcttctgccagccatggcagagatgcattgagggcacctgtgtttgtaaactaccgtatcagtgcccaaagaatggcactgcagtgtgtgcaactaacaggagaagcttcccaacatactgtcaacaaaagagtttggaatgtcttcatccagggacaaagtttttaaataacggaacatgcacagccgaaggaaagtttagtgtttccttgaagcatggaaatacagattcagagggaatagttgaagtaaaacttgtggaccaagataagacaatgttcatatgcaaaagcagctggagcatgagggaagccaacgtggcctgccttgaccttgggtttcaacaaggtgctgatactcaaagaaggtttaagttgtctgatctctctataaattccactgaatgtctacatgtgcattgccgaggattagagaccagtttggctgaatgtacttttactaagagaagaactatgggttaccaggatttcgctgatgtggtttgttatacacagaaagcagattctccaatggatgacttctttcagtgtgtgaatgggaaatacatttctcagatgaaagcctgtgatggtatcaatgattgtggagaccaaagtgatgaactgtgttgtaaagcatgccaaggcaaaggcttccattgcaaatcgggtgtttgcattccaagccagtatcaatgcaatggtgaggtggactgcattacaggggaagatgaagttggctgtgcaggctttgcatctgtggctcaagaagaaacagaaattttgactgctgacatggatgcagaaagaagacggataaaatcattattacctaaactatcttgtggagttaaaaacagaatgcacattcgaaggaaacgaattgtgggaggaaagcgagcacaactgggagacctcccatggcaggtggcaattaaggatgccagtggaatcacctgtgggggaatttatattggtggctgttggattctgactgctgcacattgtctcagagccagtaaaactcatcgttaccaaatatggacaacagtagtagactggatacaccccgaccttaaacgtatagtaattgaatacgtggatagaattattttccatgaaaactacaatgcaggcacttaccaaaatgacatcgctttgattgaaatgaaaaaagacggaaacaaaaaagattgtgagctgcctcgttccatccctgcctgtgtcccctggtctccttacctattccaacctaatgatacatgcatcgtttctggctggggacgagaaaaagataacgaaagagtcttttcacttcagtggggtgaagttaaactaataagcaactgctctaagttttacggaaatcgtttctatgaaaaagaaatggaatgtgcaggtacatatgatggttccatcgatgcctgtaaaggggactctggaggccccttagtctgtatggatgccaacaatgtgacttatgtctggggtgttgtgagttggggggaaaactgtggaaaaccagagttcccaggtgtttacaccaaagtggccaattattttgactggattagctaccatgtaggaaggccttttatttctcagtacaatgtataaaattgtgatctctctcttcattctattctttttctctcaagagttccatttaatggaaataaaacggtataattaataattctctaggggggaaaaatgaagcaaatctcactggatatttttaaaggtctccacagagtttatgccatattggaattttgttgtataattctcaaataaatattttggtgaagcatacaa

SEQ ID NO: 5423 - DNA, 5190 bp, Homo sapiens
tctgggggctcggctttgccgcgctcgctgcacttgggcgagagctggaacgtggaccagagctcggatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctgttatgcactgatccgggctttgtcaaatggacttttgagatcctggatgaaacgaatgagaataagcagaatgaatggatcacggaaaaggcagaagccaccaacaccggcaaatacacgtgcaccaacaaacacggcttaagcaattccatttatgtgtttgttagagatcctgccaagcttttccttgttgaccgctccttgtatgggaaagaagacaacgacacgctggtccgctgtcctctcacagacccagaagtgaccaattattccctcaaggggtgccaggggaagcctcttcccaaggacttgaggtttattcctgaccccaaggcgggcatcatgatcaaaagtgtgaaacgcgcctaccatcggctctgtctgcattgttctgtggaccaggagggcaagtcagtgctgtcggaaaaattcatcctgaaagtgaggccagccttcaaagctgtgcctgttgtgtctgtgtccaaagcaagctatcttcttagggaaggggaagaattcacagtgacgtgcacaataaaagatgtgtctagttctgtgtactcaacgtggaaaagagaaaacagtcagactaaactacaggagaaatataatagctggcatcacggtgacttcaattatgaacgtcaggcaacgttgactatcagttcagcgagagttaatgattctggagtgttcatgtgttatgccaataatacttttggatcagcaaatgtcacaacaaccttggaagtagtagataaaggattcattaatatcttccccatgataaacactacagtatttgtaaacgatggagaaaatgtagatttgattgttgaatatgaagcattccccaaacctgaacaccagcagtggatctatatgaacagaaccttcactgataaatgggaagattatcccaagtctgagaatgaaagtaatatcagatacgtaagtgaacttcatctaacgagattaaaaggcaccgaaggaggcacttacacattcctagtgtccaattctgacgtcaatgctgccatagcatttaatgtttatgtgaatacaaaaccagaaatcctgacttacgacaggctcgtgaatggcatgctccaatgtgtggcagcaggattcccagagcccacaatagattggtatttttgtccaggaactgagcagagatgctctgcttctgtactgccagtggatgtgcagacactaaactcatctgggccaccgtttggaaagctagtggttcagagttctatagattctagtgcattcaagcacaatggcacggttgaatgtaaggcttacaacgatgtgggcaagacttctgcctattttaactttgcatttaaaggtaacaacaaagagcaaatccatccccacaccctgttcactcctttgctgattggtttcgtaatcgtagctggcatgatgtgcattattgtgatgattctgacctacaaatatttacagaaacccatgtatgaagtacagtggaaggttgttgaggagataaatggaaacaattatgtttacatagacccaacacaacttccttatgatcacaaatgggagtttcccagaaacaggctgagttttgggaaaaccctgggtgctggagctttcgggaaggttgttgaggcaactgcttatggcttaattaagtcagatgcggccatgactgtcgctgtaaagatgctcaagccgagtgcccatttgacagaacgggaagccctcatgtctgaactcaaagtcctgagttaccttggtaatcacatgaatattgtgaatctacttggagcctgcaccattggagggcccaccctggtcattacagaatattgttgctatggtgatcttttgaattttttgagaagaaaacgtgattcatttatttgttcaaagcaggaagatcatgcagaagctgcactttataagaatcttctgcattcaaaggagtcttcctgcagcgatagtactaatgagtacatggacatgaaacctggagtttcttatgttgtcccaaccaaggccgacaaaaggagatctgtgagaataggctcatacatagaaagagatgtgactcccgccatcatggaggatgacgagttggccctagacttagaagacttgctgagcttttcttaccaggtggcaaagggcatggctttcctcgcctccaagaattgtattcacagagacttggcagccagaaatatcctccttactcatggtcggatcacaaagatttgtgattttggtctagccagagacatcaagaatgattctaattatgtggttaaaggaaacgctcgactacctgtgaagtggatggcacctgaaagcattttcaactgtgtatacacgtttgaaagtgacgtctggtcctatgggatttttctttgggagctgttctctttaggaagcagcccctatcctggaatgccggtcgattctaagttctacaagatgatcaaggaaggcttccggatgctcagccctgaacacgcacctgctgaaatgtatgacataatgaagacttgctgggatgcagatcccctaaaaagaccaacattcaagcaaattgttcagctaattgagaagcagatttcagagagcaccaatcatatttactccaacttagcaaactgcagccccaaccgacagaagcccgtggtagaccattctgtgcggatcaattctgtcggcagcaccgcttcctcctcccagcctctgcttgtgcacgacgatgtctgagcagaatcagtgtttgggtcacccctccaggaatgatctcttcttttggcttccatgatggttattttcttttctttcaacttgcatccaactccaggatagtgggcaccccactgcaatcctgtctttctgagcacactttagtggccgatgatttttgtcatcagccaccatcctattgcaaaggttccaactgtatatattcccaatagcaacgtagcttctaccatgaacagaaaacattctgatttggaaaaagagagggaggtatggactgggggccagagtcctttccaaggcttctccaattctgcccaaaaatatggttgatagtttacctgaataaatggtagtaatcacagttggccttcagaaccatccatagtagtatgatgatacaagattagaagctgaaaacctaagtcctttatgtggaaaacagaacatcattagaacaaaggacagagtatgaacacctgggcttaagaaatctagtatttcatgctgggaatgagacataggccatgaaaaaaatgatccccaagtgtgaacaaaagatgctcttctgtggaccactgcatgagcttttatactaccgacctggtttttaaatagagtttgctattagagcattgaattggagagaaggcctccctagccagcacttgtatatacgcatctataaattgtccgtgttcatacatttgaggggaaaacaccataaggtttcgtttctgtatacaaccctggcattatgtccactgtgtatagaagtagattaagagccatataagtttgaaggaaacagttaataccattttttaaggaaacaatataaccacaaagcacagtttgaacaaaatctcctcttttagctgatgaacttattctgtagattctgtggaacaagcctatcagcttcagaatggcattgtactcaatggatttgatgctgtttgacaaagttactgattcactgcatggctcccacaggagtgggaaaacactgccatcttagtttggattcttatgtagcaggaaataaagtataggtttagcctccttcgcaggcatgtcctggacaccgggccagtatctatatatgtgtatgtacgtttgtatgtgtgtagacaaatatttggaggggtatttttgccctgagtccaagagggtcctttagtacctgaaaagtaacttggctttcattattagtactgctcttgtttcttttcacatagctgtctagagtagcttaccagaagcttccatagtggtgcagaggaagtggaaggcatcagtccctatgtatttgcagttcacctgcacttaaggcactctgttatttagactcatcttactgtacctgttccttagaccttccataatgctactgtctcactgaaacatttaaattttaccctttagactgtagcctggatattattcttgtagtttacctctttaaaaacaaaacaaaacaaaacaaaaaactccccttcctcactgcccaatataaaaggcaaatgtgtacatggcagagtttgtgtgttgtcttgaaagattcaggtatgttgcctttatggtttcccccttctacatttcttagactacatttagagaactgtggccgttatctggaagtaaccatttgcactggagttctatgctctcgcacctttccaaagttaacagattttggggttgtgttgtcacccaagagattgttgtttgccatactttgtctgaaaaattcctttgtgtttctattgacttcaatgatagtaagaaaagtggttgttagttatagatgtctaggtacttcaggggcacttcattgagagttttgtcttggatattcttgaaagtttatatttttataattttttcttacatcagatgtttctttgcagtggcttaatgtttgaaattattttgtggctttttttgtaaatattgaaatgtagcaataatgtcttttgaatattcccaagcccatgagtccttgaaaatattttttatatatacagtaactttatgtgtaaatacataagcggcgtaagtttaaaggatgttggtgttccacgtgttttattcctgtatgttgtccaattgttgacagttctgaagaattctaataaaatgtacatatataaatcaaaaaaaaaaaaaaaa

SEQ ID NO: 5424 - DNA, 4093 bp, Homo sapiens
cagaggtgaggctgttgtttaaaaacctggagccgggaggggagacccccacattcaagaggagctttcaggcgatctggagaaagaacggcagaacacacagcaaggaaaggtcctttctggggatcaccccattggctgaagatgagaccattcttcctcttgtgttttgccctgcctggcctcctgcatgcccaacaagcctgctcccgtggggcctgctatccacctgttggggacctgcttgttgggaggacccggtttctccgagcttcatctacctgtggactgaccaagcctgagacctactgcacccagtatggcgagtggcagatgaaatgctgcaagtgtgactccaggcagcctcacaactactacagtcaccgagtagagaatgtggcttcatcctccggccccatgcgctggtggcagtcacagaatgatgtgaaccctgtctctctgcagctggacctggacaggagattccagcttcaagaagtcatgatggagttccaggggcccatgcccgccggcatgctgattgagcgctcctcagacttcggtaagacctggcgagtgtaccagtacctggctgccgactgcacctccaccttccctcgggtccgccagggtcggcctcagagctggcaggatgttcggtgccagtccctgcctcagaggcctaatgcacgcctaaatggggggaaggtccaacttaaccttatggatttagtgtctgggattccagcaactcaaagtcaaaaaattcaagaggtgggggagatcacaaacttgagagtcaatttcaccaggctggcccctgtgccccaaaggggctaccaccctcccagcgcctactatgctgtgtcccagctccgtctgcaggggagctgcttctgtcacggccatgctgatcgctgcgcacccaagcctggggcctctgcaggcccctccaccgctgtgcaggtccacgatgtctgtgtctgccagcacaacactgccggcccaaattgtgagcgctgtgcacccttctacaacaaccggccctggagaccggcggagggccaggacgcccatgaatgccaaaggtgcgactgcaatgggcactcagagacatgtcactttgaccccgctgtgtttgccgccagccagggggcatatggaggtgtgtgtgacaattgccgggaccacaccgaaggcaagaactgtgagcggtgtcagctgcactatttccggaaccggcgcccgggagcttccattcaggagacctgcatctcctgcgagtgtgatccggatggggcagtgccaggggctccctgtgacccagtgaccgggcagtgtgtgtgcaaggagcatgtgcagggagagcgctgtgacctatgcaagccgggcttcactggactcacctacgccaacccgcagggctgccaccgctgtgactgcaacatcctggggtcccggagggacatgccgtgtgacgaggagagtgggcgctgcctttgtctgcccaacgtggtgggtcccaaatgtgaccagtgtgctccctaccactggaagctggccagtggccagggctgtgaaccgtgtgcctgcgacccgcacaactccctcagcccacagtgcaaccagttcacagggcagtgcccctgtcgggaaggctttggtggcctgatgtgcagcgctgcagccatccgccagtgtccagaccggacctatggagacgtggccacaggatgccgagcctgtgactgtgatttccggggaacagagggcccgggctgcgacaaggcatcaggccgctgcctctgccgccctggcttgaccgggccccgctgtgaccagtgccagcgaggctactgtaatcgctacccggtgtgcgtggcctgccacccttgcttccagacctatgatgcggacctccgggagcaggccctgcgctttggtagactccgcaatgccaccgccagcctgtggtcagggcctgggctggaggaccgtggcctggcctcccggatcctagatgcaaagagtaagattgagcagatccgagcagttctcagcagccccgcagtcacagagcaggaggtggctcaggtggccagtgccatcctctccctcaggcgaactctccagggcctgcagctggatctgcccctggaggaggagacgttgtcccttccgagagacctggagagtcttgacagaagcttcaatggtctccttactatgtatcagaggaagagggagcagtttgaaaaaataagcagtgctgatccttcaggagccttccggatgctgagcacagcctacgagcagtcagcccaggctgctcagcaggtctccgacagctcgcgccttttggaccagctcagggacagccggagagaggcagagaggctggtgcggcaggcgggaggaggaggaggcaccggcagccccaagcttgtggccctgaggctggagatgtcttcgttgcctgacctgacacccaccttcaacaagctctgtggcaactccaggcagatggcttgcaccccaatatcatgccctggtgagctatgtccccaagacaatggcacagcctgtggctcccgctgcaggggtgtccttcccagggccggtggggccttcttgatggcggggcaggtggctgagcagctgcggggcttcaatgcccagctccagcggaccaggcagatgattagggcagccgaggaatctgcctcacagattcaatccagtgcccagcgcttggagacccaggtgagcgccagccgctcccagatggaggaagatgtcagacgcacacggctcctaatccagcaggtccgggacttcctaacagaccccgacactgatgcagccactatccaggaggtcagcgaggccgtgctggccctgtggctgcccacagactcagctactgttctgcagaagatgaatgagatccaggccattgcagccaggctccccaacgtggacttggtgctgtcccagaccaagcaggacattgcgcgtgcccgccggttgcaggctgaggctgaggaagccaggagccgagcccatgcagtggagggccaggtggaagatgtggttgggaacctgcggcaggggacagtggcactgcaggaagctcaggacaccatgcaaggcaccagccgctcccttcggcttatccaggacagggttgctgaggttcagcaggtactgcggccagcagaaaagctggtgacaagcatgaccaagcagctgggtgacttctggacacggatggaggagctccgccaccaagcccggcagcagggggcagaggcagtccaggcccagcagcttgcggaaggtgccagcgagcaggcattgagtgcccaagagggatttgagagaataaaacaaaagtatgctgagttgaaggaccggttgggtcagagttccatgctgggtgagcagggtgcccggatccagagtgtgaagacagaggcagaggagctgtttggggagaccatggagatgatggacaggatgaaagacatggagttggagctgctgcggggcagccaggccatcatgctgcgctcagcggacctgacaggactggagaagcgtgtggagcagatccgtgaccacatcaatgggcgcgtgctctactatgccacctgcaagtgatgctacagcttccagcccgttgccccactcatctgccgcctttgcttttggttgggggcagattgggttggaatgctttccatctccaggagactttcatgcagcctaaagtacagcctggaccacccctggtgtgtagctagtaagattaccctgagctgcagctgagcctgagccaatgggacagttacacttgacagacaaagatggtggagattggcatgccattgaaactaagagctctcaagtcaaggaagctgggctgggcagtatcccccgcctttagttctccactggggaggaatcctggaccaagcacaaaaacttaacaaaagtgatgtaaaaatgaaaagccaaataaaaatctttggaaaagagcctggaggttcaacgaggaaaaaaaaaaaaaaaaaaaaaaaaaaaaaaaaaa

SEQ ID NO: 5425 - DNA, 2812 bp, Homo sapiens
ctaaaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtgaaaaaaaaaaaaaaaaaaaaaaaaaaaaaaaaaaaaaaaaaaaaaaaaaaaaaaaaaa

SEQ ID NO: 5426 - DNA, 5073 bp, Homo sapiens
ggctcctgaggcgcacagcgccgagcgcggcgccgcgcacccgcgcgccggacgccagtgaccgcgatggtgaactccagtcgcgtgcagcctcagcagcccggggacgccaagcggccgcccgcgccccgcgcgccggacccgggccggctgatggctggctgcgcggccgtgggcgccagcctcgccgccccgggcggcctctgcgagcagcggggcctggagatcgagatgcagcgcatccggcaggcggccgcgcgggaccccccggccggagccgcggcctccccttctcctccgctctcgtcgtgctcccggcaggcgtggagccgcgataaccccggcttcgaggccgaggaggaggaggaggaggtggaaggggaagaaggcggaatggtggtggagatggacgtagagtggcgcccgggcagccggaggtcggccgcctcctcggccgtgagctccgtgggcgcgcggagccgggggcttgggggctaccacggcgcgggccacccgagcgggaggcggcgccggcgagaggaccagggcccgccgtgccccagcccagtcggcggcggggacccgctgcatcgccacctccccctggaagggcagccgccccgagtggcctgggcggagaggctggttcgcgggctgcgaggtctctggggaacaagactcatggaggaaagcagcactaaccgagagaaataccttaaaagtgttttacgggaactggtcacatacctcctttttctcatagtcttgtgcatcttgacctacggcatgatgagctccaatgtgtactactacacccggatgatgtcacagctcttcctagacacccccgtgtccaaaacggagaaaactaactttaaaactctgtcttccatggaagacttctggaagttcacagaaggctccttattggatgggctgtactggaagatgcagcccagcaaccagactgaagctgacaaccgaagtttcatcttctatgagaacctgctgttaggggttccacgaatacggcaactccgagtcagaaatggatcctgctctatcccccaggacttgagagatgaaattaaagagtgctatgatgtctactctgtcagtagtgaagatagggctccctttgggccccgaaatggaaccgcttggatctacacaagtgaaaaagacttgaatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcaggttattggttgaattcccagcaacaggtggtgtgattccatcttggcaatttcagcctttaaagctgatccgatatgtcacaacttttgatttcttcctggcagcctgtgagattatcttttgtttctttatcttttactatgtggtggaagagatattggaaattcgcattcacaaactacactatttcaggagtttctggaattgtctggatgttgtgatcgttgtgctgtcagtggtagctataggaattaacatatacagaacatcaaatgtggaggtgctactacagtttctggaagatcaaaatactttccccaactttgagcatctggcatattggcagatacagttcaacaatatagctgctgtcacagtattttttgtctggattaagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatcttcactcaattccgtatcattttgggcgatatcaactttgcagagattgaggaagctaatcgagttttgggaccaatttatttcactacatttgtgttctttatgttcttcattcttttgaatatgtttttggctatcatcaatgatacttactctgaagtgaaatctgacttggcacagcagaaagctgaaatggaactctcagatcttatcagaaagggctaccataaagctttggtcaaactaaaactgaaaaaaaataccgtggatgacatttcagagagtctgcggcaaggaggaggcaagttaaactttgacgaacttcgacaagatctcaaagggaagggccatactgatgcagagattgaggcaatattcacaaagtacgaccaagatggagaccaagaactgaccgaacatgaacatcagcagatgagagacgacttggagaaagagagggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttacccatggttcaaagatttttttttctttttctcatataagaaatctaggtgtaaatattgagtacagaaaaaaaatcttcatgatgtgtattgagcggtacgcccagttgccaccatgactgagtcttctcagttgacaatgaagtagccttttaaagctagaaaactgtcaaagggcttctgagtttcatttccagtcacaaaaatcagtattgttatttttttccaagagtgtgaaggaaaatggggcattcctttccactctggcatagttcatgagcttaatacatagctttcttttaagaaaggagccttttttttcaactagcttcctggggtaaacttttctaaaagataaaatggaaaggaactccaaactatgatagaatctgtgtgaatggttaagatgaatgttaaatactatgcttttttgtaagttgatcgtatctgatgtctgtgggactaactgtatcacttaatttttaccttattttggctctaatttgaataagctgagtaaaaccaccaaagatcagttataggataaaatggcatctctaaccataacacaggagaattggaaggagccctaagttgtcactcagtttaatttcttttaatggttagtttagcctaaagatttatctgcatattctttttcccatgtggctctactcatttgcaactgaatttaatgttataactcatctagtgagaccaacttactaaatttttagtatgcactgaaagtttttatccaacaattatgttcattttaagcaaaattttaagaaagttttgaaattcataaagcatttggttttaaactattttaagaatatagtactcggtcaggtatgacggctcacgcctgtaatcccagcactttgggaggccgaaacaggcgaatcacttgagcccaggagttcaagaccaacatgggcaatgtggcgaaactccatctctacaaaaaatgcaaaaataaaaaatatagtactcaagtattcttgatcctgtgtttcaaaactagaatttgtaatgcaaatggagctcagtctaataaaaaagaggttttggtattaaaagttcatacattagacagtatcagccaaaatttgagttagcaacactgttttctttacgagagggtctcacccaaatttatggggagaaatctatttctcaaaaaaaaaaatcttcttttacagaaatgttgagtaaggtgacattttgagcgctaataagcaaaagagcatgcagtgctgttgaataaccctcacttggagaaccaagagaatcctgtcgtttaatgctatattttaatttcacaagttgttcatttaactggtagaatgtcagtccaatctccaatgagaacatgagcaaatagacctttccaggttgaaagtgaaacatactgggtttctgtaagtttttcctcatggcttcatctctatctttactttctcttgaatatgctacacaaagttctttattactacatactaaagtttgcattccagggatattgactgtacatatttatgtatatgtaccatgttgttacatgtaaacaaacttcaatttgaagtgcagctattatgtggtatccatgtgtatcgaccatgtgccatatatcaattatggtcactagaaagtctctttatgatactttttattgtactgtttttcatttcacttgcaaaattttgcagaattcctcctttctacccataaattacatatatttttcttctttagtcatggagaactccccccctcatctcttccctattatctttccctgtgtactggtattattaaaaagacattacatacgcaagtctttctcgacaatcaagaatgttattaatgtgtaatactgagcactttacttcttaataaaaacttgatatagtagcaaaaaaaaaaaaaaaaaa

SEQ ID NO: 5427 - DNA, 2755 bp, Homo sapiens
attaaagatgatttttacagtcaatgagccacgtcagggagcgatggcacccgcaggcggtatcaactgatgcaagtgttcaagcgaatctcaactcgttttttccggtgactcattcccggccctgcttggcagcgctgcaccctttaacttaaacctcggccggccgcccgccgggggcacagagtgtgcgccgggccgcgcggcaattggtccccgcgccgacctccgcccgcgagcgccgccgcttcccttccccgccccgcgtccctccccctcggccccgcgcgtcgcctgtcctccgagccagtcgctgacagccgcggcgccgcgagcttctcctctcctcacgaccgaggcagagcagtcattatggcgaaccttggctgctggatgctggttctctttgtggccacatggagtgacctgggcctctgcaagaagcgcccgaagcctggaggatggaacactgggggcagccgatacccggggcagggcagccctggaggcaaccgctacccacctcagggcggtggtggctgggggcagcctcatggtggtggctgggggcagcctcatggtggtggctgggggcagccccatggtggtggctggggacagcctcatggtggtggctggggtcaaggaggtggcacccacagtcagtggaacaagccgagtaagccaaaaaccaacatgaagcacatggctggtgctgcagcagctggggcagtggtggggggccttggcggctacatgctgggaagtgccatgagcaggcccatcatacatttcggcagtgactatgaggaccgttactatcgtgaaaacatgcaccgttaccccaaccaagtgtactacaggcccatggatgagtacagcaaccagaacaactttgtgcacgactgcgtcaatatcacaatcaagcagcacacggtcaccacaaccaccaagggggagaacttcaccgagaccgacgttaagatgatggagcgcgtggttgagcagatgtgtatcacccagtacgagagggaatctcaggcctattaccagagaggatcgagcatggtcctcttctcctctccacctgtgatcctcctgatctctttcctcatcttcctgatagtgggatgaggaaggtcttcctgttttcaccatctttctaatctttttccagcttgagggaggcggtatccacctgcagcccttttagtggtggtgtctcactctttcttctctctttgtcccggataggctaatcaatacccttggcactgatgggcactggaaaacatagagtagacctgagatgctggtcaagccccctttgattgagttcatcatgagccgttgctaatgccaggccagtaaaagtataacagcaaataaccattggttaatctggacttatttttggacttagtgcaacaggttgaggctaaaacaaatctcagaacagtctgaaatacctttgcctggatacctctggctccttcagcagctagagctcagtatactaatgccctatcttagtagagatttcatagctatttagagatattttccattttaagaaaacccgacaacatttctgccaggtttgttaggaggccacatgatacttattcaaaaaaatcctagagattcttagctcttgggatgcaggctcagcccgctggagcatgagctctgtgtgtaccgagaactggggtgatgttttacttttcacagtatgggctacacagcagctgttcaacaagagtaaatattgtcacaacactgaacctctggctagaggacatattcacagtgaacataactgtaacatatatgaaaggcttctgggacttgaaatcaaatgtttgggaatggtgcccttggaggcaacctcccattttagatgtttaaaggaccctatatgtggcattcctttctttaaactataggtaattaaggcagctgaaaagtaaattgccttctagacactgaaggcaaatctcctttgtccatttacctggaaaccagaatgattttgacatacaggagagctgcagttgtgaaagcaccatcatcatagaggatgatgtaattaaaaaatggtcagtgtgcaaagaaaagaactgcttgcatttctttatttctgtctcataattgtcaaaaaccagaattaggtcaagttcatagtttctgtaattggcttttgaatcaaagaatagggagacaatctaaaaaatatcttaggttggagatgacagaaatatgattgatttgaagtggaaaaagaaattctgttaatgttaattaaagtaaaattattccctgaattgtttgatattgtcacctagcagatatgtattacttttctgcaatgttattattggcttgcactttgtgagtattctatgtaaaaatatatatgtatataaaatatatattgcataggacagacttaggagttttgtttagagcagttaacatctgaagtgtctaatgcattaacttttgtaaggtactgaatacttaatatgtgggaaacccttttgcgtggtccttaggcttacaatgtgcactgaatcgtttcatgtaagaatccaaagtggacaccattaacaggtctttgaaatatgcatgtactttatattttctatatttgtaactttgcatgttcttgttttgttatataaaaaaattgtaaatgtttaatatctgactgaaattaaacgagcgaagatgagcaccaaaaaaaaaaaaaaaa

SEQ ID NO: 5428 - DNA, 3309 bp, Homo sapiens
ctgcagggggggggggggggggggggggggggggggggcgcagcacggctcagaccgaggcgcacaggctcgcagctccgggcgcctagcgcccggtccccgccgcgacgcgccaccgtccctgccggcgcctccgcgccttcgaaatgagggtcctgggtgggcgctgcggggcgccgctggcgtgtctcctcctagtgcttcccgtctcagaggcaaaccttctgtcaaagcaacaggcttcacaagtcctggttaggaagcgtcgtgcaaattctttacttgaagaaaccaaacagggtaatcttgaaagagaatgcatcgaagaactgtgcaataaagaagaagccagggaggtctttgaaaatgacccggaaacggattatttttatccaaaatacttagtttgtcttcgctcttttcaaactgggttattcactgctgcacgtcagtcaactaatgcttatcctgacctaagaagctgtgtcaatgccattccagaccagtgtagtcctctgccatgcaatgaagatggatatatgagctgcaaagatggaaaagcttcttttacttgcacttgtaaaccaggttggcaaggagaaaagtgtgaatttgacataaatgaatgcaaagatccctcaaatataaatggaggttgcagtcaaatttgtgataatacacctggaagttaccactgttcctgtaaaaatggttttgttatgctttcaaataagaaagattgtaaagatgtggatgaatgctctttgaagccaagcatttgtggcacagctgtgtgcaagaacatcccaggagattttgaatgtgaatgccccgaaggctacagatataatctcaaatcaaagtcttgtgaagatatagatgaatgctctgagaacatgtgtgctcagctttgtgtcaattaccctggaggttacacttgctattgtgatgggaagaaaggattcaaacttgcccaagatcagaagagttgtgaggttgtttcagtgtgccttcccttgaaccttgacacaaagtatgaattactttacttggcggagcagtttgcaggggttgttttatatttaaaatttcgtttgccagaaatcagcagattttcagcagaatttgatttccggacatatgattcagaaggcgtgatactgtacgcagaatctatcgatcactcagcgtggctcctgattgcacttcgtggtggaaagattgaagttcagcttaagaatgaacatacatccaaaatcacaactggaggtgatgttattaataatggtctatggaatatggtgtctgtggaagaattagaacatagtattagcattaaaatagctaaagaagctgtgatggatataaataaacctggacccctttttaagccggaaaatggattgctggaaaccaaagtatactttgcaggattccctcggaaagtggaaagtgaactcattaaaccgattaaccctcgtctagatggatgtatacgaagctggaatttgatgaagcaaggagcttctggaataaaggaaattattcaagaaaaacaaaataagcattgcctggttactgtggagaagggctcctactatcctggttctggaattgctcaatttcacatagattataataatgtatccagtgctgagggttggcatgtaaatgtgaccttgaatattcgtccatccacgggcactggtgttatgcttgccttggtttctggtaacaacacagtgccctttgctgtgtccttggtggactccacctctgaaaaatcacaggatattctgttatctgttgaaaatactgtaatatatcggatacaggccctaagtctatgttccgatcaacaatctcatctggaatttagagtcaacagaaacaatctggagttgtcgacaccacttaaaatagaaaccatctcccatgaagaccttcaaagacaacttgccgtcttggacaaagcaatgaaagcaaaagtggccacatacctgggtggccttccagatgttccattcagtgccacaccagtgaatgccttttataatggctgcatggaagtgaatattaatggtgtacagttggatctggatgaagccatttctaaacataatgatattagagctcactcatgtccatcagtttggaaaaagacaaagaattcttaaggcatcttttctctgcttataataccttttccttgtgtgtaattatacttatgtttcaataacagctgaagggttttatttacaatgtgcagtctttgattattttgtggtcctttcctgggatttttaaaaggtcctttgtcaaggaaaaaaattctgttgtgatataaatcacagtaaagaaattcttacttctcttgctatctaagaatagtgaaaaataacaattttaaatttgaatttttttcctacaaatgacagtttcaatttttgtttgtaaaactaaattttaattttatcatcatgaactagtgtctaaatacctatgtttttttcagaaagcaaggaagtaaactcaaacaaaagtgcgtgtaattaaatactattaatcataggcagatactattttgtttatgtttttgtttttttcctgatgaaggcagaagagatggtggtctattaaatatgaattgaatggagggtcctaatgccttatttcaaaacaattcctcagggggaccagctttggcttcatctttctcttgtgtggcttcacatttaaaccagtatctttattgaattagaaaacaagtgggacatattttcctgagagcagcacaggaatcttcttcttggcagctgcagtctgtcaggatgagatatcagattaggttggataggtggggaaatctgaagtgggtacattttttaaattttgctgtgtgggtcacacaaggtctacattacaaaagacagaattcagggatggaaaggagaatgaacaaatgtgggagttcatagttttccttgaatccaacttttaattaccagagtaagttgccaaaatgtgattgttgaagtacaaaaggaactatgaaaaccagaacaaattttaacaaaaggacaaccacagagggatatagtgaatatcgtatcattgtaatcaaagaagtaaggaggtaagattgccacgtgcctgctggtactgtgatgcatttcaagtggcagttttatcacgtttgaatctaccattcatagccagatgtgtatcagatgtttcactgacagtttttaacaataaattcttttcactgtattttatatcacttataataaatcggtgtataatttt

SEQ ID NO: 5429 - DNA, 2984 bp, Homo sapiens
taactgagcgaggagcaattgattaatagctcggcgaggggactcactgactgttataataacactacaccagcaactcctggcttcccagcagccggaacacagacaggagagagtcagtggcaaatagacatttttcttatttcttaaaaaacagcaacttgtttgctacttttatttctgttgatttttttttcttggtgtgtgtggtggttgtttttaagtgtggagggcaaaaggagataccatcccaggctcagtccaacccctctccaaaacggcttttctgacactccaggtagcgagggagttgggtctccaggttgtgcgaggagcaaatgatgaccgccaaggccgtagacaaaatcccagtaactctcagtggttttgtgcaccagctgtctgacaacatctacccggtggaggacctcgccgccacgtcggtgaccatctttcccaatgccgaactgggaggcccctttgaccagatgaacggagtggccggagatggcatgatcaacattgacatgactggagagaagaggtcgttggatctcccatatcccagcagctttgctcccgtctctgcacctagaaaccagaccttcacttacatgggcaagttctccattgaccctcagtaccctggtgccagctgctacccagaaggcataatcaatattgtgagtgcaggcatcttgcaaggggtcacttccccagcttcaaccacagcctcatccagcgtcacctctgcctcccccaacccactggccacaggacccctgggtgtgtgcaccatgtcccagacccagcctgacctggaccacctgtactctccgccaccgcctcctcctccttattctggctgtgcaggagacctctaccaggacccttctgcgttcctgtcagcagccaccacctccacctcttcctctctggcctacccaccacctccttcctatccatcccccaagccagccacggacccaggtctcttcccaatgatcccagactatcctggattctttccatctcagtgccagagagacctacatggtacagctggcccagaccgtaagccctttccctgcccactggacaccctgcgggtgccccctccactcactccactctctacaatccgtaactttaccctggggggccccagtgctggggtgaccggaccaggggccagtggaggcagcgagggaccccggctgcctggtagcagctcagcagcagcagcagccgccgccgccgccgcctataacccacaccacctgccactgcggcccattctgaggcctcgcaagtaccccaacagacccagcaagacgccggtgcacgagaggccctacccgtgcccagcagaaggctgcgaccggcggttctcccgctctgacgagctgacacggcacatccgaatccacactgggcataagcccttccagtgtcggatctgcatgcgcaacttcagccgcagtgaccacctcaccacccatatccgcacccacaccggtgagaagcccttcgcctgtgactactgtggccgaaagtttgcccggagtgatgagaggaagcgccacaccaagatccacctgagacagaaagagcggaaaagcagtgccccctctgcatcggtgccagccccctctacagcctcctgctctgggggcgtgcagcctgggggtaccctgtgcagcagtaacagcagcagtcttggcggagggccgctcgccccttgctcctctcggacccggacaccttgagatgagactcaggctgatacaccagctcccaaaggtcccggaggccctttgtccactggagctgcacaacaaacactaccaccctttcctgtccctctctccctttgttgggcaaagggctttggtggagctagcactgccccctttccacctagaagcaggttcttcctaaaacttagcccattctagtctctcttaggtgagttgactatcaacccaaggcaaaggggaggctcagaaggaggtggtgtggggatcccctggccaagagggctgaggtctgaccctgctttaaagggttgtttgactaggttttgctaccccacttccccttattttgacccatcacaggtttttgaccctggatgtcagagttgatctaagacgttttctacaataggttgggagatgctgatcccttcaagtggggacagcaaaaagacaagcaaaactgatgtgcactttatggcttgggactgatttgggggacattgtacagtgagtgaagtatagcctttatgccacactctgtggccctaaaatggtgaatcagagcatatctagttgtctcaacccttgaagcaatatgtattatatactcagagaacagaagtgcaatgtgatgggaggaacgtagcaatatctgctccttttcgagttgtttgagaaatgtaggctattttttcagtgtatatccactcagattttgtgtatttttgatgtacccacactgttctctaaattctgaatctttgggaaaaaatgtaaagcatttatgatctcagaggttaacttatttaagggggatgtacatattctctgaaactaggatgcatgcaattgtgttggaagtgtccttggtcgccttgtgtgatgtagacaaatgttacaaggctgcatgtaaatgggttgccttattatggagaaaaaaatcactccctgagtttagtatggctgtatatttatgcctattaatatttggaattttttttagaaagtatatttttgtatgctttgttttgtgacttaaaagtgttacctttgtagtcaaatttcagataagaatgtacataatgttaccggagctgatttgtttggtcattagctcttaatagttgtgaaaaaataaatctattctaacgcaaaaccactaactgaagttcagatataatggatggtttgtgactatagtgtaaataaatacttttcaacaat

SEQ ID NO: 5430 - DNA, 2059 bp, Homo sapiens
ccgcaggcgctcggggttggagccagcgaccgtcggtagcagcatggctctcctctttctcctaccccttgtcatgcagggtgtgagcagggctgagatgggcaccgcggatctggggccgtcctcagtgcctacaccaactaatgttacaattgaatcctataacatgaaccctatcgtatattgggagtaccagatcatgccacaggtccctgtttttaccgtagaggtaaagaactatggtgttaagaattcagaatggattgatgcctgcatcaatatttctcatcattattgtaatatttctgatcatgttggtgatccatcaaattctctttgggtcagagttaaagccagggttggacaaaaagaatctgcctatgcaaagtcagaagaatttgctgtatgccgagatggaaaaattggaccacctaaactggatatcagaaaggaggagaagcaaatcatgattgacatatttcacccttcagtttttgtaaatggagacgagcaggaagtcgattatgatcccgaaactacctgttacattagggtgtacaatgtgtatgtgagaatgaacggaagtgagatccagtataaaatactcacgcagaaggaagatgattgtgacgagattcagtgccagttagcgattccagtatcctcactgaattctcagtactgtgtttcagcagaaggagtcttacatgtgtggggtgttacaactgaaaagtcaaaagaagtttgtattaccattttcaatagcagtataaaaggttctctttggattccagttgttgctgctttactactctttctagtgcttagcctggtattcatctgtttttatattaagaaaattaatccattgaaggaaaaaagcataatattacccaagtccttgatctctgtggtaagaagtgctactttagagacaaaacctgaatcaaaatatgtatcactcatcacgtcataccagccattttccttagaaaaggaggtggtctgtgaagagccgttgtctccagcaacagttccaggcatgcataccgaagacaatccaggaaaagtggaacatacagaagaactttctagtataacagaagtggtgactactgaagaaaatattcctgacgtggtcccgggcagccatctgactccaatagagagagagagttcttcacctttaagtagtaaccagtctgaacctggcagcatcgctttaaactcgtatcactccagaaattgttctgagagtgatcactccagaaatggttttgatactgattccagctgtctggaatcacatagctccttatctgactcagaatttcccccaaataataaaggtgaaataaaaacagaaggacaagagctcataaccgtaataaaagcccccacctcctttggttatgataaaccacatgtgctagtggatctacttgtggatgatagcggtaaagagtccttgattggttatagaccaacagaagattccaaagaattttcatgagatcagctaagttgcaccaactttgaagtctgattttcctggacagttttctgctttaatttcatgaaaagattatgatctcagaaattgtatcttagttggtatcaaccaaatggagtgacttagtgtacatgaaagcgtaaagaggatgtgtggcattttcacttttggcttgtaaagtacagacttttttttttttttaaacaaaaaaagcattgtaacttatgaacctttacatccagataggttaccagtaacggaacatatccagtactcctggttcctaggtgagcaggtgatgccccagggacctttgtagccacttcactttttttcttttctctgccttggtatagcatatgtgttttgtaagtttatgcatacagtaattttaagtaatttcagaagaaattctcgaagcttttcaaaattggacttaaaatctaattcaaactaatagaattaatggaatatgtaaatagaaacgtgtatattttttatgaaacattacagttagagatttttaaataaagaattttaaaactc

SEQ ID NO: 5431 - DNA, 1512 bp, Homo sapiens
ctcctctccagcccttctcctgtgtgcctgcctcctgccgccgccaccatgaccacctccatccgccagttcacctcctccagctccatcaagggctcctccggcctggggggcggctcgtcccgcacctcctgccggctgtctggcggcctgggtgccggctcctgcaggctgggatctgctggcggcctgggcagcaccctcgggggtagcagctactccagctgctacagctttggctctggtggtggctatggcagcagctttgggggtgttgatgggctgctggctggaggtgagaaggccaccatgcagaacctcaatgaccgcctggcctcctacctggacaaggtgcgtgccctggaggaggccaacactgagctggaggtgaagatccgtgactggtaccagaggcaggccccggggcccgcccgtgactacagccagtactacaggacaattgaggagctgcagaacaagatcctcacagccaccgtggacaatgccaacatcctgctacagattgacaatgcccgtctggctgctgatgacttccgcaccaagtttgagacagagcaggccctgcgcctgagtgtggaggccgacatcaatggcctgcgcagggtgctggatgagctgaccctggccagagccgacctggagatgcagattgagaacctcaaggaggagctggcctacctgaagaagaaccacgaggaggagatgaacgccctgcgaggccaggtgggtggtgagatcaatgtggagatggacgctgccccaggcgtggacctgagccgcatcctcaacgagatgcgtgaccagtatgagaagatggcagagaagaaccgcaaggatgccgaggattggttcttcagcaagacagaggaactgaaccgcgaggtggccaccaacagtgagctggtgcagagtggcaagagtgagatctcggagctccggcgcaccatgcaggccttggagatagagctgcagtcccagctcagcatgaaagcatccctggagggcaacctggcggagacagagaaccgctactgcgtgcagctgtcccagatccaggggctgattggcagcgtggaggagcagctggcccagcttcgctgcgagatggagcagcagaaccaggaatacaaaatcctgctggatgtgaagacgcggctggagcaggagattgccacctaccgccgcctgctggagggagaggatgcccacctgactcagtacaagaaagaaccggtgaccacccgtcaggtgcgtaccattgtggaagaggtccaggatggcaaggtcatctcctcccgcgagcaggtccaccagaccacccgctgaggactcagctaccccggccggccacccaggaggcagggagcagccgccccatctgccccacagtctccggcctctccagcctcagccccctgcttcagtcccttccccatgcttccttgcctgatgacaataaagcttgttgactcagctaaaaaaaaaaaaaaa

SEQ ID NO: 5432 - DNA, 2320 bp, Homo sapiens
tcgacagctctctcgcccagcccagttctggaagggataaaaagggggcatcaccgttcctgggtaacagagccaccttctgcgtcctgctgagctctgttctctccagcacctcccaacccactagtgcctggttctcttgctccaccaggaacaagccaccatgtctcgccagtcaagtgtgtccttccggagcgggggcagtcgtagcttcagcaccgcctctgccatcaccccgtctgtctcccgcaccagcttcacctccgtgtcccggtccgggggtggcggtggtggtggcttcggcagggtcagccttgcgggtgcttgtggagtgggtggctatggcagccggagcctctacaacctggggggctccaagaggatatccatcagcactagtggtggcagcttcaggaaccggtttggtgctggtgctggaggcggctatggctttggaggtggtgccggtagtggatttggtttcggcggtggagctggtggtggctttgggctcggtggcggagctggctttggaggtggcttcggtggccctggctttcctgtctgccctcctggaggtatccaagaggtcactgtcaaccagagtctcctgactcccctcaacctgcaaatcgaccccagcatccagagggtgaggaccgaggagcgcgagcagatcaagaccctcaacaataagtttgcctccttcatcgacaaggtgcggttcctggagcagcagaacaaggttctggacaccaagtggaccctgctgcaggagcagggcaccaagactgtgaggcagaacctggagccgttgttcgagcagtacatcaacaacctcaggaggcagctggacagcatcgtgggggaacggggccgcctggactcagagctgagaaacatgcaggacctggtggaagacttcaagaacaagtatgaggatgaaatcaacaagcgtaccactgctgagaatgagtttgtgatgctgaagaaggatgtagatgctgcctacatgaacaaggtggagctggaggccaaggttgatgcactgatggatgagattaacttcatgaagatgttctttgatgcggagctgtcccagatgcagacgcatgtctctgacacctcagtggtcctctccatggacaacaaccgcaacctggacctggatagcatcatcgctgaggtcaaggcccagtatgaggagattgccaaccgcagccggacagaagccgagtcctggtatcagaccaagtatgaggagctgcagcagacagctggccggcatggcgatgacctccgcaacaccaagcatgagatctctgagatgaaccggatgatccagaggctgagagccgagattgacaatgtcaagaaacagtgcgccaatctgcagaacgccattgcggatgccgagcagcgtggggagctggccctcaaggatgccaggaacaagctggccgagctggaggaggccctgcagaaggccaagcaggacatggcccggctgctgcgtgagtaccaggagctcatgaacaccaagctggccctggacgtggagatcgccacttaccgcaagctgctggagggcgaggaatgcagactcagtggagaaggagttggaccagtcaacatctctgttgtcacaagcagtgtttcctctggatatggcagtggcagtggctatggcggtggcctcggtggaggtcttggcggcggcctcggtggaggtcttgccggaggtagcagtggaagctactactccagcagcagtgggggtgtcggcctaggtggtgggctcagtgtggggggctctggcttcagtgcaagcagtggccgagggctgggggtgggctttggcagtggcgggggtagcagctccagcgtcaaatttgtctccaccacctcctcctcccggaagagcttcaagagctaagaacctgctgcaagtcactgccttccaagtgcagcaacccagcccatggagattgcctcttctaggcagttgctcaagccatgttttatccttttctggagagtagtctagaccaagccaattgcagaaccacattctttggttcccaggagagccccattcccagcccctggtctcccgtgccgcagttctatattctgcttcaaatcagccttcaggtttcccacagcatggcccctgctgacacgagaacccaaagttttcccaaatctaaatcatcaaaacagaatccccaccccaatcccaaattttgttttggttctaactacctccagaatgtgttcaataaaatgcttttataatataaaaaaaaaaaaaaaaaaa

SEQ ID NO: 5433 - DNA, 2060 bp, Homo sapiens
ctattgatctggactcctggataggcagctggaccaacggacggatgccatgagggctctgctgctcctggggttcctgctggtgagcttggagtcaacactttcgattccaccttgggaagcccccaaggagcataagtacaaagctgaagagcacacagtcgttctcactgtcaccggggagccctgccacttccccttccagtaccaccggcagctgtaccacaaatgtacccacaagggccggccaggccctcagccctggtgtgctaccacccccaactttgatcaggaccagcgatggggatactgtttggagcccaagaaagtgaaagaccactgcagcaaacacagcccctgccagaaaggagggacctgtgtgaacatgccaagcggcccccactgtctctgtccacaacacctcactggaaaccactgccagaaagagaagtgctttgagcctcagcttctccggtttttccacaagaatgagatatggtatagaactgagcaagcagctgtggccagatgccagtgcaagggtcctgatgcccactgccagcggctggccagccaggcctgccgcaccaacccgtgcctccatgggggtcgctgcctagaggtggagggccaccgcctgtgccactgcccggtgggctacaccggagccttctgcgacgtggacaccaaggcaagctgctatgatggccgcgggctcagctaccgcggcctggccaggaccacgctctcgggtgcgccctgtcagccgtgggcctcggaggccacctaccggaacgtgactgccgagcaagcgcggaactggggactgggcggccacgccttctgccggaacccggacaacgacatccgcccgtggtgcttcgtgctgaaccgcgaccggctgagctgggagtactgcgacctggcacagtgccagaccccaacccaggcggcgcctccgaccccggtgtcccctaggcttcatgtcccactcatgcccgcgcagccggcaccgccgaagcctcagcccacgacccggaccccgcctcagtcccagaccccgggagccttgccggcgaagcgggagcagccgccttccctgaccaggaacggcccactgagctgcgggcagcggctccgcaagagtctgtcttcgatgacccgcgtcgttggcgggctggtggcgctacgcggggcgcacccctacatcgccgcgctgtactggggccacagtttctgcgccggcagcctcatcgccccctgctgggtgctgacggccgctcactgcctgcaggaccggcccgcacccgaggatctgacggtggtgctcggccaggaacgccgtaaccacagctgtgagccgtgccagacgttggccgtgcgctcctaccgcttgcacgaggccttctcgcccgtcagctaccagcacgacctggctctgttgcgccttcaggaggatgcggacggcagctgcgcgctcctgtcgccttacgttcagccggtgtgcctgccaagcggcgccgcgcgaccctccgagaccacgctctgccaggtggccggctggggccaccagttcgagggggcggaggaatatgccagcttcctgcaggaggcgcaggtaccgttcctctccctggagcgctgctcagccccggacgtgcacggatcctccatcctccccggcatgctctgcgcagggttcctcgagggcggcaccgatgcgtgccagggtgattccggaggcccgctggtgtgtgaggaccaagctgcagagcgccggctcaccctgcaaggcatcatcagctggggatcgggctgtggtgaccgcaacaagccaggcgtctacaccgatgtggcctactacctggcctggatccgggagcacaccgtttcctgattgctcagggactcatctttccctccttggtgattccgcagtgagagagtggctggggcatggaaggcaagattgtgtcccattcccccagtgcggccagctccgcgccaggatggcgcaggaactcaataaagtgctttgaaaatgctgagaaaaaaaaaaa

SEQ ID NO: 5434 - DNA, 1634 bp, Homo sapiens
acccgagcaccttctcttcactcagccaactgctcgctcgctcacctccctcctctgcaccatgactacctgcagccgccagttcacctcctccagctccatgaagggctcctgcggcatcgggggcggcatcgggggcggctccagccgcatctcctccgtcctggccggagggtcctgccgcgcccccagcacctacgggggcggcctgtctgtctcatcctcccgcttctcctctgggggagcctacgggctggggggcggctatggcggtggcttcagcagcagcagcagcagctttggtagtggctttgggggaggatatggtggtggccttggtgctggcttgggtggtggctttggtggtggctttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcctgctgagatcaaagactacagtccctacttcaagaccattgaggacctgaggaacaagattctcacagccacagtggacaatgccaatgtccttctgcagattgacaatgcccgtctggccgcggatgacttccgcaccaagtatgagacagagttgaacctgcgcatgagtgtggaagccgacatcaatggcctgcgcagggtgctggacgaactgaccctggccagagctgacctggagatgcagattgagagcctgaaggaggagctggcctacctgaagaagaaccacgaggaggagatgaatgccctgagaggccaggtgggtggagatgtcaatgtggagatggacgctgcacctggcgtggacctgagccgcattctgaacgagatgcgtgaccagtatgagaagatggcagagaagaaccgcaaggatgccgaggaatggttcttcaccaagacagaggagctgaaccgcgaggtggccaccaacagcgagctggtgcagagcggcaagagcgagatctcggagctccggcgcaccatgcagaacctggagattgagctgcagtcccagctcagcatgaaagcatccctggagaacagcctggaggagaccaaaggtcgctactgcatgcagctggcccagatccaggagatgattggcagcgtggaggagcagctggcccagctccgctgcgagatggagcagcagaaccaggagtacaagatcctgctggacgtgaagacgcggctggagcaggagatcgccacctaccgccgcctgctggagggcgaggacgcccacctctcctcctcccagttctcctctggatcgcagtcatccagagatgtgacctcctccagccgccaaatccgcaccaaggtcatggatgtgcacgatggcaaggtggtgtccacccacgagcaggtccttcgcaccaagaactgaggctgcccagccccgctcaggcctaggaggccccccgtgtggacacagatcccactggaagatcccctctcctgcccaagcacttcacagctggaccctgcttcaccctcaccccctcctggcaatcaatacagcttcattatctgagttgcat

SEQ ID NO: 5435 - DNA, 7321 bp, Homo sapiens
ttttgtagataaatgtgaggattttctctaaatccctcttctgtttgctaaatctcactgtcactgctaaattcagagcagatagagcctgcgcaatggaataaagtcctcaaaattgaaatgtgacattgctctcaacatctcccatctctctggatttctttttgcttcattattcctgctaaccaattcattttcagactttgtacttcagaagcaatgggaaaaatcagcagtcttccaacccaattatttaagtgctgcttttgtgatttcttgaaggtgaagatgcacaccatgtcctcctcgcatctcttctacctggcgctgtgcctgctcaccttcaccagctctgccacggctggaccggagacgctctgcggggctgagctggtggatgctcttcagttcgtgtgtggagacaggggcttttatttcaacaagcccacagggtatggctccagcagtcggagggcgcctcagacaggcatcgtggatgagtgctgcttccggagctgtgatctaaggaggctggagatgtattgcgcacccctcaagcctgccaagtcagctcgctctgtccgtgcccagcgccacaccgacatgcccaagacccagaaggaagtacatttgaagaacgcaagtagagggagtgcaggaaacaagaactacaggatgtaggaagaccctcctgaggagtgaagagtgacatgccaccgcaggatcctttgctctgcacgagttacctgttaaactttggaacacctaccaaaaaataagtttgataacatttaaaagatgggcgtttcccccaatgaaatacacaagtaaacattccaacattgtctttaggagtgatttgcaccttgcaaaaatggtcctggagttggtagattgctgttgatcttttatcaataatgttctatagaaaagaaaaaaaaaatatatatatatatatatcttagtccctgcctctcaagagccacaaatgcatgggtgttgtatagatccagttgcactaaattcctctctgaatcttggctgctggagccattcattcagcaaccttgtctaagtggtttatgaattgtttccttatttgcacttctttctacacaactcgggctgtttgttttacagtgtctgataatcttgttagtctatacccaccacctcccttcataacctttatatttgccgaatttggcctcctcaaaagcagcagcaagtcgtcaagaagcacaccaattctaacccacaagattccatctgtggcatttgtaccaaatataagttggatgcattttattttagacacaaagctttatttttccacatcatgcttacaaaaaagaataatgcaaatagttgcaactttgaggccaatcatttttaggcatatgttttaaacatagaaagtttcttcaactcaaaagagttccttcaaatgatgagttaatgtgcaacctaattagtaactttcctctttttattttttccatatagagcactatgtaaatttagcatatcaattatacaggatatatcaaacagtatgtaaaactctgttttttagtataatggtgctattttgtagtttgttatatgaaagagtctggccaaaacggtaatacgtgaaagcaaaacaataggggaagcctggagccaaagatgacacaaggggaagggtactgaaaacaccatccatttgggaaagaaggcaaagtccccccagttatgccttccaagaggaacttcagacacaaaagtccactgatgcaaattggactggcgagtccagagaggaaactgtggaatggaaaaagcagaaggctaggaattttagcagtcctggtttctttttctcatggaagaaatgaacatctgccagctgtgtcatggactcaccactgtgtgaccttgggcaagtcacttcacctctctgtgcctcagtttcctcatctgcaaaatgggggcaatatgtcatctacctacctcaaaggggtggtataaggtttaaaaagataaagattcagattttttttaccctgggttgctgtaagggtgcaacatcagggcgcttgagttgctgagatgcaaggaattctataaataacccattcatagcatagctagagattggtgaattgaatgctcctgacatctcagttcttgtcagtgaagctatccaaataactggccaactagttgttaaaagctaacagctcaatctcttaaaacacttttcaaaatatgtgggaagcatttgattttcaatttgattttgaattctgcatttggttttatgaatacaaagataagtgaaaagagagaaaggaaaagaaaaaggagaaaaacaaagagatttctaccagtgaaaggggaattaattactctttgttagcactcactgactcttctatgcagttactacatatctagtaaaacctcgtttaatactataaataatattctattcattttgaaaaacacaatgattccttcttttctaggcaatataaggaaagtgatccaaaatttgaaatattaaaataatatctaataaaaagtcacaaagttatcttctttaacaaactttactcttattcttagctgtatatacatttttttaaaagtttgttaaaatatgcttgactagagtttccagttgaaaggcaaaaacttccatcacaacaagaaatttcccatgcctgctcagaagggtagcccctagctctctgtgaatgtgttttatccattcaactgaaaattggtatcaagaaagtccactggttagtgtactagtccatcatagcctagaaaatgatccctatctgcagatcaagattttctcattagaacaatgaattatccagcattcagatctttctagtcaccttagaactttttggttaaaagtacccaggcttgattatttcatgcaaattctatattttacattcttggaaagtctatatgaaaaacaaaaataacatcttcagtttttctcccactgggtcacctcaaggatcagaggccaggaaaaaaaaaaaaaagactccctggatctctgaatatatgcaaaaagaaggccccatttagtggagccagcaatcctgttcagtcaacaagtattttaactctcagtccaacattatttgaattgagcacctcaagcatgcttagcaatgttctaatcactatggacagatgtaaaagaaactatacatcatttttgccctctgcctgttttccagacatacaggttctgtggaataagatactggactcctcttcccaagatggcacttctttttatttcttgtccccagtgtgtaccttttaaaattattccctctcaacaaaactttataggcagtcttctgcagacttaacgtgttttctgtcatagttagatgtgataattctaagagtgtctatgacttatttccttcacttaattctatccacagtcaaaaatcccccaaggaggaaagctgaaagatgcactgccatattatctttcttaactttttccaacacataatcctctccaactggattataaataaattgaaaataactcattataccaattcactattttattttttaatgaattaaaactagaaaacaaattgatgcaaaccctggaagtcagttgattactatatactacagcagaatgactcagatttcatagaaaggagcaaccaaaatgtcacaacccaaaactttacaagctttgcttcagaattagattgctttataattcttgaatgaggcaatttcaagatatttgtaaaagaacagtaaacattggtaagaatgagctttcaactcataggcttatttccaatttaattgaccatactggatacttaggtcaaatttctgttctctcttccccaaataatattaaagtattatttgaactttttaagatgaggcagttcccctgaaaaagttaatgcagctctccatcagaatccactcttctagggatatgaaaatctcttaacacccaccctacatacacagacacacacacacacacacacacacacacacacacacacattcaccctaaggatccaatggaatactgaaaagaaatcacttccttgaaaattttattaaaaaacaaacaaacaaacaaaaagcctgtccacccttgagaatccttcctctccttggaacgtcaatgtttgtgtagatgaaaccatctcatgctctgtggctccagggtttctgttactattttatgcacttgggagaaggcttagaataaaagatgtagcacattttgctttcccatttattgtttggccagctatgccaatgtggtgctattgtttctttaagaaagtacttgactaaaaaaaaaagaaaaaaagaaaaaaaagaaagcatagacatatttttttaaagtataaaaacaacaattctatagatagatggcttaataaaatagcattaggtctatctagccaccaccacctttcaactttttatcactcacaagtagtgtactgttcaccaaattgtgaatttgggggtgcaggggcaggagttggaaattttttaaagttagaaggctccattgttttgttggctctcaaacttagcaaaattagcaatatattatccaatcttctgaacttgatcaagagcatggagaataaacgcgggaaaaaagatcttataggcaaatagaagaatttaaaagataagtaagttccttattgatttttgtgcactctgctctaaaacagatattcagcaagtggagaaaataagaacaaagagaaaaaatacatagatttacctgcaaaaaatagcttctgccaaatcccccttgggtattctttggcatttactggtttatagaagacattctcccttcacccagacatctcaaagagcagtagctctcatgaaaagcaatcactgatctcatttgggaaatgttggaaagtatttccttatgagatgggggttatctactgataaagaaagaatttatgagaaattgttgaaagagatggctaacaatctgtgaagattttttgtttcttgtttttgttttttttttttttttactttatacagtctttatgaatttcttaatgttcaaaatgacttggttcttttcttctttttttatatcagaatgaggaataataagttaaacccacatagactctttaaaactataggctagatagaaatgtatgtttgacttgttgaagctataatcagactatttaaaatgttttgctatttttaatcttaaaagattgtgctaatttattagagcagaacctgtttggctctcctcagaagaaagaatctttccattcaaatcacatggctttccaccaatattttcaaaagataaatctgatttatgcaatggcatcatttattttaaaacagaagaattgtgaaagtttatgcccctcccttgcaaagaccataaagtccagatctggtaggggggcaacaacaaaaggaaaatgttgttgattcttggttttggattttgttttgttttcaatgctagtgtttaatcctgtagtacatatttgcttattgctattttaatattttataagaccttcctgttaggtattagaaagtgatacatagatatcttttttgtgtaatttctatttaaaaaagagagaagactgtcagaagctttaagtgcatatggtacaggataaagatatcaatttaaataaccaattcctatctggaacaatgcttttgttttttaaagaaacctctcacagataagacagaggcccaggggatttttgaagctgtctttattctgcccccatcccaacccagcccttattattttagtatctgcctcagaattttatagagggctgaccaagctgaaactctagaattaaaggaacctcactgaaaacatatatttcacgtgttccctctttttttttttcctttttgtgagatggggtctcgcactgtcccccaggctggagtgcagtggcatgatctcggctcactgcaacctccacctcctgggtttaagcgattctcctgcctcagcctcctgagtagctgggattacaggcacccaccactatgcccggctaattttttggatttttaatagagacggggttttaccatgttggccaggttggtctcaaactcctgaccttgtgatttgcccgcctcagcctcccaaattgctgggattacaggcatgagccaccacaccctgcccatgtgttccctcttaatgtatgattacatggatcttaaacatgatccttctctcctcattcttcaactatctttgatggggtctttcaaggggaaaaaaatccaagcttttttaaagtaaaaaaaaaaaaagagaggacacaaaaccaaatgttactgctcaactgaaatatgagttaagatggagacagagtttctcctaataaccggagctgaattacctttcactttcaaaaacatgaccttccacaatccttagaatctgcctttttttatattactgaggcctaaaagtaaacattactcattttattttgcccaaaatgcactgatgtaaagtaggaaaaataaaaacagagctctaaaatccctttcaagccacccattgaccccactcaccaactcatagcaaagtcacttctgttaatcccttaatctgattttgtttggatatttatcttgtacccgctgctaaacacactgcaggagggactctgaaacctcaagctgtctacttacatcttttatctgtgtctgtgtatcatgaaaatgtctattcaaaatatcaaaacctttcaaatatcacgcagcttatattcagtttacataaaggccccaaataccatgtcagatctttttggtaaaagagttaatgaactatgagaattgggattacatcatgtattttgcctcatgtatttttatcacacttataggccaagtgtgataaataaacttacagacactgaattaatttcccctgctactttgaaaccagaaaataatgactggccattcgttacatctgtcttagttgaaaagcatattttttattaaattaattctgattgtatttgaaattattattcaattcacttatggcagaggaatatcaatcctaatgacttctaaaaatgtaactaattgaatcattatcttacatttactgtttaataagcatattttgaaaatgtatggctagagtgtcataataaaatggtatatctttctttagtaattacattaaaattagtcatgtttgattaattagttc

SEQ ID NO: 5436 - DNA, 1399 bp, Homo sapiens
agtgtgaaatcttcagagaagaatttctctttagttctttgcaagaaggtagagataaagacactttttcaaaaatggcaatggtatcagaattcctcaagcaggcctggtttattgaaaatgaagagcaggaatatgttcaaactgtgaagtcatccaaaggtggtcccggatcagcggtgagcccctatcctaccttcaatccatcctcggatgtcgctgccttgcataaggccataatggttaaaggtgtggatgaagcaaccatcattgacattctaactaagcgaaacaatgcacagcgtcaacagatcaaagcagcatatctccaggaaacaggaaagcccctggatgaaacacttaagaaagcccttacaggtcaccttgaggaggttgttttagctctgctaaaaactccagcgcaatttgatgctgatgaacttcgtgctgccatgaagggccttggaactgatgaagatactctaattgagattttggcatcaagaactaacaaagaaatcagagacattaacagggtctacagagaggaactgaagagagatctggccaaagacataacctcagacacatctggagattttcggaacgctttgctttctcttgctaagggtgaccgatctgaggactttggtgtgaatgaagacttggctgattcagatgccagggccttgtatgaagcaggagaaaggagaaaggggacagacgtaaacgtgttcaataccatccttaccaccagaagctatccacaacttcgcagagtgtttcagaaatacaccaagtacagtaagcatgacatgaacaaagttctggacctggagttgaaaggtgacattgagaaatgcctcacagctatcgtgaagtgcgccacaagcaaaccagctttctttgcagagaagcttcatcaagccatgaaaggtgttggaactcgccataaggcattgatcaggattatggtttcccgttctgaaattgacatgaatgatatcaaagcattctatcagaagatgtatggtatctccctttgccaagccatcctggatgaaaccaaaggagattatgagaaaatcctggtggctctttgtggaggaaactaaacattcccttgatggtctcaagctatgatcagaagactttaattatatattttcatcctataagcttaaataggaaagtttcttcaacaggattacagtgtagctacctacatgctgaaaaatatagcctttaaatcatttttatattataactctgtataatagagataagtccattttttaaaaatgttttccccaaaccataaaaccctatacaagttgttctagtaacaatacatgagaaagatgtctatgtagctgaaaataaaatgacgtcacaagac

SEQ ID NO: 5437 - DNA, 5152 bp, Homo sapiens
cgccatcgtcttcaatgcttctctgaacagcctttaggaagagtgcgagagaaagagagagagcgcgcgccagggagaggagaaaagaagatgaggattatttccagacagattgtcttgttattttctggattttggggactcgccatgggagcctttccgagcagcgtgcaaataggtggtctcttcatccgaaacacagatcaggaatacactgcttttcgattagcaatttttcttcataacaccagccccaatgcgtcggaagctccttttaatttggtacctcatgtggacaacattgagacagccaacagttttgctgtaacaaacgccttctgttcccagtattctagaggagtatttgccatttttggactctatgataagaggtcggtacataccttgacctcattctgcagcgccttacatatctccctcatcacaccaagtttccctactgagggggagagccagtttgtgctgcaactaagaccttcgttacgaggagcactcttgagtttgctggatcactacgaatggaactgttttgtcttcctgtatgacacagacaggggatactcgatactccaagctattatggaaaaagcaggacaaaatggttggcatgtcagcgctatatgtgtggaaaattttaatgatgtcagctataggcaacttctagaagaacttgacagaagacaagagaagaagtttgtaatagactgtgagatagagagacttcaaaacatattagaacagattgtaagtgttggaaagcatgttaaaggctaccattatatcattgcaaacttgggattcaaggatatttctcttgagaggtttatacatggtggagccaatgttactggattccagttggtggattttaatacacctatggtaatcaaactaatggatcgctggaagaaactagatcagagagagtatccaggatctgagactcctccaaagtacacctctgctctgacttatgatggagtccttgtgatggctgaaactttccgaagtcttaggaggcagaaaattgatatctcaaggagaggaaatgctggggattgtctggcaaatcctgctgctccatggggccagggaattgacatggagaggacactcaaacaggttcgaattcaagggctgacagggaatgttcagtttgaccactatggacgtagagtcaattacacaatggatgtgtttgagctgaaaagcacaggacctagaaaggttggttactggaatgatatggataagttagtcttgattcaagatgtaccaactcttggcaatgacacagctgctattgagaacagaacagtggttgtaaccacaattatggaatccccatatgttatgtacaagaaaaatcatgaaatgtttgaaggaaatgacaagtatgaaggatactgtgtagatttggcatctgaaattgcaaaacatattggtatcaagtataaaattgccattgtccctgatggaaaatatggagcaagggatgcagacacaaaaatctggaatgggatggtaggagaacttgtttatgggaaagcagagattgctattgcccctctgacaatcactttggtacgagaggaggtcattgacttttctaagcccttcatgagtttgggcatatctatcatgatcaaaaagcctcagaaatccaaaccaggagtgttttccttcttggatcctctggcctatgagatttggatgtgcatagtctttgcctacattggtgtcagcgtggtcttattcctagttagtagatttagtccatatgagtggcacacagaagagccagaggacggaaaggaaggacccagcgaccagcctcccaatgagtttggcatctttaacagcctctggttttccctgggtgcttttatgcagcaaggatgtgacatttcacccagatccctctcaggtcgaattgttggaggtgtttggtggttctttacactcatcattatatcatcttatactgctaacctcgctgctttcctgacggttgagcgaatggtctctcccatagaaagtgcagaagacctggccaaacaaacagaaattgcctatggaacactggattcaggatcaacaaaagaattcttcagaagatcaaaaatagcagtgtatgaaaagatgtggacctacatgcgatcagcagagccatcagtattcactaggactacagctgagggagtagctcgtgtccgcaaatccaagggcaaatttgcctttctcctggagtccactatgaatgaatacattgagcagcgaaagccatgtgacacgatgaaagtgggaggaaatctggattccaaaggctatggagtagcaacgcccaagggttcctcattaagaactcctgtaaaccttgccgttttgaaactcagtgaggcaggcgtcttagacaagctgaaaaacaaatggtggtacgataaaggtgaatgtggacccaaggactctggaagcaaggacaagacgagtgccttgagcctgagcaatgtagcaggcgtcttctacattctggttggcggcttgggcttggcaatgctggtggctttgatagagttctgttacaagtccagggcagaagcgaagagaatgaagctgaccttttctgaagccataagaaacaaagccagattatccatcactgggagtgtgggagagaatggccgcgtcttgacgcctgactgcccaaaggctgtacacactggaactgcaatcagacaaagttcaggattggctgtcattgcatcggacctaccataaaaaccaaaaaaataattgagtgccttaattaaactgttggtgactggtggaaacgcagccctgagggacacgccacgcgcgggtctttgctaaaccaatcctttggctgagagcgggaagtccgtcctaacgcgctggccggacatcagcagcagcaacgtgtgcatgagctcagctcggaaacccaaactcagattttatatcaggaaaactcacaattgaggtttttttcggggagtgggtgggggagggatctgggatgggtgtattaacagcaacaaatttcattcgagtggactcaaaaactaatcagacttatgagttagcgcattaaactgtgaagttcttgctcagaaaggcctttgtcttcaccggaaaggataaaatagttgtagaagtccgtgaacatgctaacctgtgtctccagaacatccatatagtccatggaagaaaatccagctgagaaaacaaatcactaaactgtgataagaaaataatgaacaaacatgtaaaacctgtgggaaaaaaaaataaaggaagtatgtacacttactttggagaaaacaaatactgaaacatgcttgctttttaactgacgtaaattcagtagaggacaacacaattcttttttctaaccatcttagggaacaatacattgcaataattgatataaatgccatcactgtaataaactttagagacttttttttataaaagttgttggtcatcttcttgtttgctgtaaccttcactatgtcacatgagtcgattcaccgattgcatttgtctcacaaccaggaagaaaagcaaaaggaagaaaacgtttaggttcaatcatcagtctgcggtgtagactcgaaagagatgacaggtcactcatgttaatggtattatttataatctcattctgtgtacaacattgtggtttttgtacccaccaaaaagaataaaacagcagatgttcttacaatatctacagagcttaaaagttttttcttatcgttataaaagttatttgagaaattataagactataagagagattgtattagtggtgggccatagtggaaaatgtagctagccctcattattttttgcatactaagctacccctccttttcagatctttgactcattaacagattaaactgtcaaagatggagtctttgagttggggaatgaatcactgtcctaacaacaacataccttgtaattgtgtgttgaaattttacttgactgtattttgctgcataaaattatgtgtctcttgggcttcttcccttattcctattgttccctttaaatcatatgaaggcattcataatagcttggggtagataacaaatgaagaattagtctttgttttcaactggaaattgtaaagaaaattatactcatgtttatttataaaaatcaccttatgtatgaattaaactaacatggttcaaaagaaggtttggttcatttgaaataataaataagtactctaatacagataaaaatcatgtacttagggtattggcagaaagcacaagttaggatgatttcagaagtctggccttgaaggatgagttgagttttaacaggaggagaaggtgttaagagccatatgagtgagcagtggcccaaagccatgcacatcagtggctcatttaaggaatgaatgccattagatgggctactgagagtacagggatattatggaagataaagttggaaaagctgaaggattgattttcttccatcaactctcaagatcccattcgccattcaatctctgtgctgcagtaagagcaatcttaaacagtataaatcacacacacacacacacacacacacacacacacacacaagtccctcaggaaaaattccaagctcttgagaagatcacatgagccccttcatgacctggcgcttgcttatttcttccaggacttctctcacttctatccagctattcccgtcagcaaatgaacctccaaagcagcacatggagcactgcatagactatttcctcagtgcgtaactcctccctgtctcctctttacctgagtaacttgtactcatccttcaatactccaactgaattttacttaccctgaaaagatttccatggctatccaccacccccctgcctgtgagactgagttaggtgccctttttcatgtctttcccccatcacggcacttaccatactgcgttgtaattgcctgtgtactcgtctgtataactactagactgtaagctccttgagggcagggactgtgtctatcttgttcacagttgtatccccagcacccagcacagtgcctggcatattgtaggtgcttaataaatatttgttgaatgaatg

SEQ ID NO: 5438 - DNA, 3012 bp, Homo sapiens
ttatggcgattgggcggctgcagagaccaggactcagttcccctgccctagtctgagcctagtgggtgggactcagctcagagtcagttttccagaagcaggtttcagtgcagagttttcctacacttttcctgcgctagagcagcgagcagcctggaacagacccaggcggaggacacctgtgggggagggagcgcctggaggagcttagagaccccagccgggcgtgatctcaccatgtgcggatttgcgaggcgcgccctggagctgctagagatccggaagcacagccccgaggtgtgcgaagccaccaagactgcggctcttggagaaagcgtgagcagggggccaccgcggtctccgcgcctgtctgcaccctgtcgcctgagctgcctgacagtgacaatgacatcccagttaccagtgtccttgaattgatagtggcttctgtttgtcagtctcatataagaactacagctcatcaggaggagatcgcagcagggtaagagacaccaacaccatgttctgcacgaagctcaaggatctcaagatcacaggagagtgtcctttctccttactggcaccaggtcaagttcctaacgagtcttcagaggaggcagcaggaagctcagagagctgcaaagcaaccgtgcccatctgtcaagacattcctgagaagaacatacaagaaagtcttcctcaaagaaaaaccagtcggagccgagtctatcttcacactttggcagagagtatttgcaaactgattttcccagagtttgaacggctgaatgttgcacttcagagaacattggcaaagcacaaaataaaagaaagcaggaaatctttggaaagagaagactttgaaaaaacaattgcagagcaagcagttgcagcaggagttccagtggaggttatcaaagaatctcttggtgaagaggtttttaaaatatgttacgaggaagatgaaaacatccttggggtggttggaggcacccttaaagattttttaaacagcttcagtacccttctgaaacagagcagccattgccaagaagcaggaaaaaggggcaggcttgaggacgcctccattctatgcctggataaggaggatgattttctacatgtttactacttcttccctaagagaaccacctccctgattcttcccggcatcataaaggcagctgctcacgtattatatgaaacggaagtggaagtgtcgttaatgcctccctgcttccataatgattgcagcgagtttgtgaatcagccctacttgttgtactccgttcacatgaaaagcaccaagccatccctgtcccccagcaaaccccagtcctcgctggtgattcccacatcgctattctgcaagacatttccattccatttcatgtttgacaaagatatgacaattctgcaatttggcaatggcatcagaaggctgatgaacaggagagactttcaaggaaagcctaattttgaagaatactttgaaattctgactccaaaaatcaaccagacgtttagcgggatcatgactatgttgaatatgcagtttgttgtacgagtgaggagatgggacaactctgtgaagaaatcttcaagggttatggacctcaaaggccaaatgatctacattgttgaatccagtgcaatcttgtttttggggtcaccctgtgtggacagattagaagattttacaggacgagggctctacctctcagacatcccaattcacaatgcactgagggatgtggtcttaataggggaacaagcccgagctcaagatggcctgaagaagaggctggggaagctgaaggctacccttgagcaagcccaccaagccctggaggaggagaagaaaaagacagtagaccttctgtgctccatatttccctgtgaggttgctcagcagctgtggcaagggcaagttgtgcaagccaagaagttcagtaatgtcaccatgctcttctcagacatcgttgggttcactgccatctgctcccagtgctcaccgctgcaggtcatcaccatgctcaatgcactgtacactcgcttcgaccagcagtgtggagagctggatgtctacaaggtggagaccattggcgatgcctattgtgtagctgggggattacacaaagagagtgatactcatgctgttcagatagcgctgatggccctgaagatgatggagctctctgatgaagttatgtctccccatggagaacctatcaagatgcgaattggactgcactctggatcagtttttgctggcgtcgttggagttaaaatgccccgttactgtctttttggaaacaatgtcactctggctaacaaatttgagtcctgcagtgtaccacgaaaaatcaatgtcagcccaacaacttacagattactcaaagactgtcctggtttcgtgtttacccctcgatcaagggaggaacttccaccaaacttccctagtgaaatccccggaatctgccattttctggatgcttaccaacaaggaacaaactcaaaaccatgcttccaaaagaaagatgtggaagatggcaatgccaattttttaggcaaagcatcaggaatagattagcaacctatatacctatttataagtctttggggtttgactcattgaagatgtgtagagcctctgaaagcactttagggattgtagatggctaacaagcagtattaaaatttcaggagccaagtcacaatctttctcctgtttaacatgacaaaatgtactcacttcagtacttcagctcttcaagaaaaaaaaaaaaaccttaaaaagctacttttgtgggagtatttctattatataaccagcacttactacctgtactcaaaattcagcaccttgtacatatatcagataattgtagtcaattgtacaaactgatggagtcacctgcaatctcatatcctggtggaatgccatggttattaaagtgtgtttgtgatagtgtcgtcaaaaaaaaaaaaaaaaaaaaaaaaaaaaaaaaa

SEQ ID NO: 5439 - DNA, 5869 bp, Homo sapiens
ccccctccgggctttcgcccgccctctctccctcccttttttgcccgccctggccctgcccctgcccctgccccctcctctcagcccctccgcgcccggggtgtcattgggcccgggagacgggagccaacttcaggctgctcagaggaagcccgtgcagtcagtcacctgggtgcaagagcgttgctgcctcgggctctcccgctgcagggagagcggcactcgctggcctggatgtggttggatttaggggggctccgcagcaggggtttcgtggcggtggcaagcgctgcaacaggtagacggcgagagacggaccccggccgaggcagcgatggagaccaaaggctaccacagtctccctgaaggtctagatatggaaagacggtggggtcaagtttctcaggctgtggagcgttcttccctgggacctacagagaggaccgatgagaataactacatggagattgtcaacgtaagctgtgtttccggtgctattccaaacaacagtactcaaggaagcagcaaagaaaaacaagaactactcccttgccttcagcaagacaataatcggcctgggattttaacatctgatattaaaactgagctggaatctaaggaactttcagcaactgtagctgagtccatgggtttatatatggattctgtaagagatgctgactattcctatgagcagcagaaccaacaaggaagcatgagtccagctaagatttatcagaatgttgaacagctggtgaaattttacaaaggaaatggccatcgtccttccactctaagttgtgtgaacacgcccttgagatcatttatgtctgactctgggagctccgtgaatggtggcgtcatgcgcgccgttgttaaaagccctatcatgtgtcatgagaaaagcccgtctgtttgcagccctctgaacatgacatcttcggtttgcagccctgctggaatcaactctgtgtcctccaccacagccagctttggcagttttccagtgcacagcccaatcacccagggaactcctctgacatgctcccctaatgttgaaaatcgaggctccaggtcgcacagccctgcacatgctagcaatgtgggctctcctctctcaagtccgttaagtagcatgaaatcctcaatttccagccctccaagtcactgcagtgtaaaatctccagtctccagtcccaataatgtcactctgagatcctctgtgtctagccctgcaaatattaacaactcaaggtgctctgtttccagcccttcgaacactaataacagatccacgctttccagtccggcagccagtactgtgggatctatctgtagccctgtaaacaatgccttcagctacactgcttctggcacctctgctggatccagtacattgcgggatgtggttcccagtccagacacgcaggagaaaggtgctcaagaggtcccttttcctaagactgaggaagtagagagtgccatctcaaatggtgtgactggccagcttaatattgtccagtacataaaaccagaaccagatggagcttttagcagctcatgtctaggaggaaatagcaaaataaattcggattcttcattctcagtaccaataaagcaagaatcaaccaagcattcatgttcaggcacctcttttaaagggaatccaacagtaaacccgtttccatttatggatggctcgtatttttcctttatggatgataaagactattattccctatcaggaattttaggaccacctgtgcccggctttgatggtaactgtgaaggcagcggattcccagtgggtattaaacaagaaccagatgatgggagctattacccagaggccagcatcccttcctctgctattgttggggtgaattcaggtggacagtccttccactacaggattggtgctcaaggtacaatatctttatcacgatcggctagagaccaatctttccaacacctgagttcctttcctcctgtcaatactttagtggagtcatggaaatcacacggcgacctgtcgtctagaagaagtgatgggtatccggtcttagaatacattccagaaaatgtatcaagctctactttacgaagtgtttctactggatcttcaagaccttcaaaaatatgtttggtgtgtggggatgaggcttcaggatgccattatggggtagtcacctgtggcagctgcaaagttttcttcaaaagagcagtggaagggcaacacaactatttatgtgctggaagaaatgattgcatcattgataagattcgacgaaagaattgtcctgcttgcagacttcagaaatgtcttcaagctggaatgaatttaggagcacgaaagtcaaagaagttgggaaagttaaaagggattcacgaggagcagccacagcagcagcagcccccacccccacccccacccccgcaaagcccagaggaagggacaacgtacatcgctcctgcaaaagaaccctcggtcaacacagcactggttcctcagctctccacaatctcacgagcgctcacaccttcccccgttatggtccttgaaaacattgaacctgaaattgtatatgcaggctatgacagctcaaaaccagatacagccgaaaatctgctctccacgctcaaccgcttagcaggcaaacagatgatccaagtcgtgaagtgggcaaaggtacttccaggatttaaaaacttgcctcttgaggaccaaattaccctaatccagtattcttggatgtgtctatcatcatttgccttgagctggagatcgtacaaacatacgaacagccaatttctctattttgcaccagacctagtctttaatgaagagaagatgcatcagtctgccatgtatgaactatgccaggggatgcaccaaatcagccttcagttcgttcgactgcagctcacctttgaagaatacaccatcatgaaagttttgctgctactaagcacaattccaaaggatggcctcaaaagccaggctgcatttgaagaaatgaggacaaattacatcaaagaactgaggaagatggtaactaagtgtcccaacaattctgggcagagctggcagaggttctaccaactgaccaagctgctggactccatgcatgacctggtgagcgacctgctggaattctgcttctacaccttccgagagtcccatgcgctgaaggtagagttccccgcaatgctggtggagatcatcagcgaccagctgcccaaggtggagtcggggaacgccaagccgctctacttccaccggaagtgactgcccgctgcccagaagaactttgccttaagtttccctgtgttgttccacacccagaaggacccaagaaaacctgtttttaacatgtgatggttgattcacacttgttcaacagtttctcaagtttaaagtcatgtcagaggtttggagccgggaaagctgtttttccgtggatttggcgagaccagagcagtctgaaggattccccacctccaatcccccagcgcttagaaacatgttcctgttcctcgggatgaaaagccatatctagtcaataactctgattttgatattttcacagatggaagaagttttaactatgccgtgtagtttctggtatcgttcgcttgttttaaaagggttcaaggactaacgaacgttttaaagcttacccttggtttgcacataaaacgtatagtcaatatggggcattaatattcttttgttattaaaaaaacacaaaaaaataataaaaaaatatatacagattcctgttgtgtaataacagaactcgtggcgtggggcagcagctgcctctgagccctcgctcgtccacggtcttctgcatcactggtatacacactcgttagcgtccatttcttatttaattagaatggataagatgatgttaaatgccttggtttgatttctagtatctattgtgttggctttacaaataattttttgcagtcttttgctgtgctgtacattactgtatgtataaattatgaaggacctgaaataaggtataaggatcttttgtaaatgagacacatacaaaaaaaatctttaatggttaataggatgaatgggaaagtatttttgaaagaattctattttgctggagactatttaagtactatctttgtctaaacaaggtaatttttttttgtaaagtgcaatgtcctgcatgcataatgaaccgtttacagtgtatttaagaaagggaaagctgtgccttttttagcttcatatctaatttaccattattttacagtctctgttgtaaataaccacactgaaacctcttcggttgtcttgaaacctttctactttttctgtactttttgttttgttcttggtctcccgcttggggcatttgtgggactccagcacgttttctggcttctgcttcatcctgctccatcggggaatgacacactgcggtgtctgcagctcctggaaggtgtcatttgacaacacatgtgggagaggaggtccttggagtgctgcagctttgggaaagctgcctcgtttcccttttcctctagaagcagaaccagctctacgagagtgagactgggaacttgatggctcagagagcatcttttcctcccattttagaaaatcagattttctcctgtgggaaaaaaaaattccatgcactctctctctgttaaagatcagctattcccttctgatcttggaaagaggttctgcactcctggaaccggtcacaggaacgcacagatcatggcaggatgcgctgggacggcccatcttggcaaggttcagtctgaatggcatggagaccgggagatagaggggttttagatttttaaaaggtaggttttaaaaataagttttatacataaacagttttggagaaaaattacagatcatataagcaagacagtggcactaaaatgtttaattcattaatctgtttgtttggcactgatgcaatgtatggcttttctcttgccccaaatcacaaacatatgtatctttggggaaactaacaatatgattgcactaaataaactactttgaatagaggccaaattaatcttttaaaaatgatgataatcatcaggtttactcagtgaaatcatattaattattttccaaaatctaaaagctgtagctggagaagcccatggccacgaggaagcagcaattaattagatcaacacttttctccagggttcaccatgcaggcaacattaccttgtctttcaaaagacacctgccttatgcaaggggaaacctgtgaaagctgcactcagagggaggagtttttcttacataatttgcaatttcaggaatttaatttataggcagatctttaaatacagtcaacttacggtgcacagtaatatgaaagccacactttgaaggtaataaatacacagcatgcagactgggagttgctagcaaacaaatggcttacttacaaaagcagcttttagttcagacttagtttttataaaatgggaattctgacttacttaaccaggtttgggatggagatggtctgcatcagctttttgtattaacaaagttactggctctttgtgtgtctccaggtaactttgcttgattaaacagcaaagccatattctaaattcactgttgaatgcctgtcccagtccaaattgtctgtctgctcttatttttgtaccatattgctcttaaaaatcttggtttggtacagttcataattcaccaaaagttcatataatttaaagaaacactaaattagtttaaaatgaagcaatttatatctttatgcaaaaacatatgtctgtctttgcaaaggactgtaagcagattacaataaatcctttactttaatca

SEQ ID NO: 5440 - DNA, 5643 bp, Homo sapiens
gagagcgccgagacgcgcggggcgcggagatgtgcaagtggcgaagcttgaccgagagcaggctggagcagccgcccaactcctggcgcgggatctgctgaggggtcacgattttaggtgatgggcaagtcagaaagtcagatggatataactgatatcaacactccaaagccaaagaagaaacagcgatggactccactggagatcagcctctcggtccttgtcctgctcctcaccatcatagctgtgacaatgatcgcactctatgcaacctacgatgatggtatttgcaagtcatcagactgcataaaatcagctgctcgactgatccaaaacatggatgccaccactgagccttgtacagactttttcaaatatgcttgcggaggctggttgaaacgtaatgtcattcccgagaccagctcccgttacggcaactttgacattttaagagatgaactagaagtcgttttgaaagatgtccttcaagaacccaaaactgaagatatagtagcagtgcagaaagcaaaagcattgtacaggtcttgtataaatgaatctgctattgatagcagaggtggagaacctctactcaaactgttaccagacatatatgggtggccagtagcaacagaaaactgggagcaaaaatatggtgcttcttggacagctgaaaaagctattgcacaactgaattctaaatatgggaaaaaagtccttattaatttgtttgttggcactgatgataagaattctgtgaatcatgtaattcatattgaccaacctcgacttggcctcccttctagagattactatgaatgcactggaatctataaagaggcttgtacagcatatgtggattttatgatttctgtggccagattgattcgtcaggaagaaagattgcccatcgatgaaaaccagcttgctttggaaatgaataaagttatggaattggaaaaagaaattgccaatgctacggctaaacctgaagatcgaaatgatccaatgcttctgtataacaagatgacattggcccagatccaaaataacttttcactagagatcaatgggaagccattcagctggttgaatttcacaaatgaaatcatgtcaactgtgaatattagtattacaaatgaggaagatgtggttgtttatgctccagaatatttaaccaaacttaagcccattcttaccaaatattctgccagagatcttcaaaatttaatgtcctggagattcataatggatcttgtaagcagcctcagccgaacctacaaggagtccagaaatgctttccgcaaggccctttatggtacaacctcagaaacagcaacttggagacgttgtgcaaactatgtcaatgggaatatggaaaatgctgtggggaggctttatgtggaagcagcatttgctggagagagtaaacatgtggtcgaggatttgattgcacagatccgagaagtttttattcagactttagatgacctcacttggatggatgccgagacaaaaaagagagctgaagaaaaggccttagcaattaaagaaaggatcggctatcctgatgacattgtttcaaatgataacaaactgaataatgagtacctcgagttgaactacaaagaagatgaatacttcgagaacataattcaaaatttgaaattcagccaaagtaaacaactgaagaagctccgagaaaaggtggacaaagatgagtggataagtggagcagctgtagtcaatgcattttactcttcaggaagaaatcagatagtcttcccagccggcattctgcagccccccttctttagtgcccagcagtccaactcattgaactatgggggcatcggcatggtcataggacacgaaatcacccatggcttcgatgacaatggcagaaactttaacaaagatggagacctcgttgactggtggactcaacagtctgcaagtaactttaaggagcaatcccagtgcatggtgtatcagtatggaaacttttcctgggacctggcaggtggacagcaccttaatggaattaatacactgggagaaaacattgctgataatggaggtcttggtcaagcatacagagcctatcagaattatattaaaaagaatggcgaagaaaaattacttcctggacttgacctaaatcacaaacaactatttttcttgaactttgcacaggtgtggtgtggaacctataggccagagtatgcggttaactccattaaaacagatgtgcacagtccaggcaatttcaggattattgggactttgcagaactctgcagagttttcagaagcctttcactgccgcaagaattcatacatgaatccagaaaagaagtgccgggtttggtgatcttcaaaagaagcattgcagcccttggctagacttgccaacaccacagaaatggggaattctctaatcgaaagaaaatgggccctaggggtcactgtactgacttgagggtgattaacagagagggcaccatcacaatacagataacattaggttgtcctagaaagggtgtggagggaggaagggggtctaaggtctatcaagtcaatcatttctcactgtgtacataatgcttaatttctaaagataatattactgtttatttctgtttctcatatggtctaccagtttgctgatgtccctagaaaacaatgcaaaacctttgaggtagaccaggatttctaatcaaaagggaaaagaagatgttgaagaatacagttaggcaccagaagaacagtaggtgacactatagtttaaaacacattgcctaactactagtttttacttttatttgcaacatttacagtccttcaaaatccttccaaagaattcttatacacattggggccttggagcttacatagttttaaactcatttttgccatacatcagttattcattctgtgatcatttattttaagcactcttaaagcaaaaaatgaatgtctaaaattgttttttgttgtacctgctttgactgatgctgagattcttcaggcttcctgcaattttctaagcaatttcttgctctatctctcaaaacttggtatttttcagagatttatataaatgtaaaaataataatttttatatttaattattaactacatttatgagtaactattattataggtaatcaatgaatattgaagtttcagcttaaaataaacagttgtgaaccaagatctataaagcgatatacagatgaaaatttgagactatttaaacttataaatcatattgatgaaaagatttaagcacaaactttagggtaaaaattgccattggacagttgtctagagatatatatacttgtggttttcaaattggactttcaaaattaaatctgtccctgagagtgtctctgataaaagggcaaatctgcacctatgtagctctgcatctcctgtcttttcaggtttgtcatcagatggaaatattttgataataaattgaaattgtgaactcattgctccctaagactgtgacaactgtctaactttagaagtgcatttctgaatagaaatgggaggcctctgatggaccttctagaattataagtcacaaagagttctggaaaagaactgtttactgcttgataggaattcatcttttgaggcttctgttcctctcttttcctgttgtattgactattttcgttcattacttgattaagattttacaaaagaggagcacttccaaaattcttatttttcctaacaaaagatgaaagcagggaatttctatctaaatgatgagtattagttccctgtctcttgaaaaatgcccatttgcctttaaaaaaaaaagttacagaaatactataacatatgtacataaattgcataaagcataagtatacagttcaataaacttaactttaactgaacaatggccctgtagccagcacctgtaagaaacagagcagtaccagcgctctaaaagcacctccttgtcactttattactcccagaacaacaactatcctgacttctaatatcattcactagctttgcctggttttgtcttttatgcagatagaatcaatcagtatgtattcttttgtgcctggcttctttctctcagccttacatttgtgagattcctctgtattgtgctgattgtggatcttttcattctcattgcagaataatgttctattgtgggacttattacaatttgttcatcctattgttgatgggcacttgagaactttccattttggcgctattacaaatagtgcaactatgaatgtactgcatgttaccatcttacttgagcctttaatggacttatttcttcaaatccttccaaaaattattataagcattgaaattatagtttcaagccaactgtggatacccttaccctttcctcctttatcacaaccaccgttacaagtatacttatatttccctaaaatacatttaaaacttacctaagtgacatttgtagttggagtaataggagcttccagctctaataaaacagctgtctctaacttattttatttccatcatgtcagagcaggtgaagagccagaagtgaagagtgactagtacaaattataaaaagccactagactcttcactgttagctttttaaaacattaggctcccatccctatggaggaacaactctccagtgcctggatcccctctgtctacaaatataagattttctgggcctaaaggatagatcaaagtcaaaaatagcaatgcctccctatccctcacacatccagacatcatgaattttacatggtactcttgttgagttctgtagagccttctgatgtctctaaagcactaccgattctttggagttgtcacatcagataagacatatctctaattccatccataaatccagttctactatggctgagttctggtcaaagaaagaaagtttagaagctgagacacaaagggttgggagctgatgaaactcacaaatgatggtaggaagaagctctcgacaatacccgttggcaaggagtctgcctccatgctgcagtgttcgagtggattgtaggtgcaagatggaaaggattgtaggtgcaagctgtccagagaaaagagtccttgttccagccctattctgccactcctgacagggtgaccttgggtatttgcaatattcctttgggcctctgcttctctcacctaaaaaaagagaattagattatattggtggttctcagcaagagaaggagtatgtgtccaatgctgccttcccatgaatctgtctcccagttatgaatcagtgggcaggataaactgaaaactcccatttacgtgtctgaatcgagtgagacaaaattttagtccaaataacaagtaccaaagttttatcaagtttgggtctgtgctgctgttactgttaaccatttaagtggggcaaaaccttgctaattttctcaaaagcatttatcattcttgttgccacagctggagctctcaaactaaaagacatttgttattttggaaagaagaaagactctattctcaaagtttcctaatcagaaatttttatcagtttccagtctcaaaaatacaaaataaaaacaaacgtttttaatactattgcttttatgcctagtcaactctg

SEQ ID NO: 5441 - DNA, 1348 bp, Homo sapiens
ccagatttggctttatatagcggacccgtaaggccgaccggcctctaccggcgggatttgatggcgtgatgtctcacagaaagttctccgctcccagacatgggtccctcggcttcctgcctcggaagcgcagcagcaggcatcgtgggaaggtgaagagcttccctaaggatgacccgtccaagccggtccacctcacagccttcctgggatacaaggctggcatgactcacatcgtgcgggaagtcgacaggccgggatccaaggtgaacaagaaggaggtggtggaggctgtgaccattgtagagacaccacccatggtggttgtgggcattgtgggctacgtggaaacccctcgaggcctccggaccttcaagactgtctttgctgagcacatcagtgatgaatgcaagaggcgtttctataagaattggcataaatctaagaagaaggcctttaccaagtactgcaagaaatggcaggatgaggatggcaagaagcagctggagaaggacttcagcagcatgaagaagtactgccaagtcatccgtgtcattgcccacacccagatgcgcctgcttcctctgcgccagaagaaggcccacctgatggagatccaggtgaacggaggcactgtggccgagaagctggactgggcccgcgagaggcttgagcagcaggtacctgtgaaccaagtgtttgggcaggatgagatgatcgacgtcatcggggtgaccaagggcaaaggctacaaaggggtcaccagtcgttggcacaccaagaagctgccccgcaagacccaccgaggcctgcgcaaggtggcctgtattggggcatggcatcctgctcgtgtagccttctctgtggcacgcgctgggcagaaaggctaccatcaccgcactgagatcaacaagaagatttataagattggccagggctaccttatcaaggacggcaagctgatcaagaacaatgcctccactgactatgacctatctgacaagagcatcaaccctctgggtggctttgtccactatggtgaagtgaccaatgactttgtcatgctgaaaggctgtgtggtgggaaccaagaagcgggtgctcaccctccgcaagtccttgctggtgcagacgaagcggcgggctctggagaagattgaccttaagttcattgacaccacctccaagtttggccatggccgcttccagaccatggaggagaagaaagcattcatgggaccactgaagaaagaccgaattgcaaaggaagaaggagcttaatgccaggaacagattttgcagttggtggggtctcaataaaagttattttccactgacaaaaaaaaaaa

SEQ ID NO: 5442 - DNA, 1574 bp, Homo sapiens
tcaccacggcggcagccctttaaacccctcacccagccagcgccccatcctgtctgtccgaacccagacacaagtcttcactccttcctgcgagccctgaggaagccttgtgagtgcattggctggggcttggagggaagttgggctggagctggacaggagcagtgggtgcatttcaggcaggctctcctgaggtcccaggcgccagctccagctccctggctagggaaacccaccctctcagtcagcatgggggcccaagctccaggcagggtgggctggatcactagcgtcctggatctctctcagactgggcagccccgggctcattgaaatgccccggatgacttggctagtgcagaggaattgatggaaaccaccggggtgagagggaggctccccatctcagccagccacatccacaaggtgtgtgtaagggtgcaggcgccggccggttaggccaaggctctactgtctgttgcccctccaggagaacttccaaggagctttccccagacatggccaacaagggtccttcctatggcatgagccgcgaagtgcagtccaaaatcgagaagaagtatgacgaggagctggaggagcggctggtggagtggatcatagtgcagtgtggccctgatgtgggccgcccagaccgtgggcgcttgggcttccaggtctggctgaagaatggcgtgattctgagcaagctggtgaacagcctgtaccctgatggctccaagccggtgaaggtgcccgagaacccaccctccatggtcttcaagcagatggagcaggtggctcagttcctgaaggcggctgaggactatggggtcatcaagactgacatgttccagactgttgacctctttgaaggcaaagacatggcagcagtgcagaggaccctgatggctttgggcagcttggcagtgaccaagaatgatgggcactaccgtggagatcccaactggtttatgaagaaagcgcaggagcataagagggaattcacagagagccagctgcaggagggaaagcatgtcattggccttcagatgggcagcaacagaggggcctcccaggccggcatgacaggctacggacgacctcggcagatcatcagttagagcggagagggctagccctgagcccggccctcccccagctccttggctgcagccatcccgcttagcctgcctcacccacacccgtgtggtaccttcagccctggccaagctttgaggctctgtcactgagcaatggtaactgcacctgggcagctcctccctgtgcccccagcctcagcccaacttcttacccgaaagcatcactgccttggcccctccctcccggctgcccccatcacctctactgtctcctccctgggctaagcaggggagaagcgggctgggggtagcctggatgtgggccaagtccactgtcctccttggcggcaaaagcccattgaagaagaaccagcccagcctgccccctatcttgtcctggaatatttttggggttggaactcaaaaaaaaaaaaaaaaaatcaatcttttctcaaaaaaaaaaaaaaaaaa

SEQ ID NO: 5443 - DNA, 1533 bp, Homo sapiens
cagtgcaggcggagccgcgccgcgctcccaccccggccgggagctaggagccagcggccagccccgcgcagcgcagcgcagcccgcagaagcccggtcagcgcacgtgcccgcgagacctgcaaacttgtgccaccggctctgcccgtccccggggagcccgaacgccccgcagccctcacccctcccgccagtctccagccatgggctgctttgaatgctgcatcaagtgtctgggaggagtcccctacgcctccctggtggccaccatcctctgcttctccggggtggccttattctgcggctgtgggcatgtggctctcgcaggcaccgtggcgattcttgagcaacacttctccaccaacgccagtgaccatgccttgctgagcgaggtgatacaactgatgcagtatgtcatctatggaattgcgtcctttttcttcttgtatgggatcattctgttggcagaaggcttttacaccacaagtgcagtgaaagaactgcacggtgagtttaaaacaaccgcttgtggccgatgcatcagtggaatgttcgttttcctcacctatgtgcttggagtggcctggctgggtgtgtttggtttctcagcggtgcccgtgtttatgttctacaacatatggtcaacttgtgaagtcatcaagtcaccgcagaccaacgggaccacgggtgtggagcagatctgtgtggatatccgacaatacggtatcattccttggaatgctttccccggaaaaatatgtggctctgccctggagaacatctgcaacacaaacgagttctacatgtcctatcacctgttcattgtggcctgtgcaggagctggtgccaccgtcattgccctgctgatctacatgatggctactacatataactatgcggttttgaagtttaagagtcgggaagattgctgcactaaattctaaattgcataaggagttttagagagctatgctctgtagcatgaaatatcactgacactccagactaaagcagagtctaggtttctgcaattttgttacagtaatttgtaaatagctttagtaaactcaccttgcatggtagattaataagatgacttactgtacatgaattacacaataatgagatctggtggctatttccacattttgaaaaggattcagttatttactgacagtggtgagcatcctttttaaaataatgttctcatacttaaacattagagagcagtatctttaaatgaattattaacactttggaatacttacattttctgttatttttgattgcctgataaccagtttcaatgatgaaaatgaaaacaagtgctgaagatgaaatggaagagaaccgttttaatctggattttgttttgtcacacctggaaaatactttgcaaatatgttctaaattgaaaacaatttttttatgatcacatggttcactaccaaatgaccctcaaataagccagatgaaaatttgaagaaaaaggtcacccagttctctggaaaaaaaaaaaaaaaaaaaaaaaaaa

SEQ ID NO: 5444 - DNA, 2072 bp, Homo sapiens
gatccgcttccctgctcctttaagcgtccacaggcggcggagcggccacaatcacagctccgggcattgggggaacccgagccggctgcgccgggggaatccgtgcgggcgccttccgtcccggtcccatcctcgccgcgctccagcacctctgaagttttgcagcgcccagaaaggaggcgaggaaggagggagtgtgtgagaggagggagcaaaaagctcaccctaaaacatttatttcaaggagaaaagaaaaagggggggcgcaaaaatggctggggcaattatagaaaacatgagcaccaagaagctgtgcattgttggtgggattctgctcgtgttccaaatcatcgcctttctggtgggaggcttgattgggcccacaacggcagtgtcctacatgtcggtgaaatgtgtggatgcccgtaagaaccatcacaagacaaaatggttcgtgccttggggacccaatcattgtgacaagatccgagacattgaagaggcaattccaagggaaattgaagccaatgacatcgtgttttctgttcacattcccctcccccacatggagatgagtccttggttccaattcatgctgtttatcctgcagctggacattgccttcaagctaaacaaccaaatcagagaaaatgcagaagtctccatggacgtttccctggcttaccgtgatgacgcgtttgctgagtggactgaaatggcccatgaaagagtaccacggaaactcaaatgcaccttcacatctcccaagactccagagcatgagggccgttactatgaatgtgatgtccttcctttcatggaaattgggtctgtggcccataagttttaccttttaaacatccggctgcctgtgaatgagaagaagaaaatcaatgtgggaattggggagataaaggatatccggttggtggggatccaccaaaatggaggcttcaccaaggtgtggtttgccatgaagaccttccttacgcccagcatcttcatcattatggtgtggtattggaggaggatcaccatgatgtcccgacccccagtgcttctggaaaaagtcatctttgcccttgggatttccatgacctttatcaatatcccagtggaatggttttccatcgggtttgactggacctggatgctgctgtttggtgacatccgacagggcatcttctatgcgatgcttctgtccttctggatcatcttctgtggcgagcacatgatggatcagcacgagcggaaccacatcgcagggtattggaagcaagtcggacccattgccgttggctccttctgcctcttcatatttgacatgtgtgagagaggggtacaactcacgaatcccttctacagtatctggactacagacattggaacagagctggccatggccttcatcatcgtggctggaatctgcctctgcctctacttcctgtttctatgcttcatggtatttcaggtgtttcggaacatcagtgggaagcagtccagcctgccagctatgagcaaagtccggcggctacactatgaggggctaatttttaggttcaagttcctcatgcttatcaccttggcctgcgctgccatgactgtcatcttcttcatcgttagtcaggtaacggaaggccattggaaatggggcggcgtcacagtccaagtgaacagtgcctttttcacaggcatctatgggatgtggaatctgtatgtctttgctctgatgttcttgtatgcaccatcccataaaaactatggagaagaccagtccaatggaatgcaactcccatgtaaatcgagggaagattgtgctttgtttgtttcggaactttatcaagaattgttcagcgcttcgaaatattccttcatcaatgacaacgcagcttctggtatttgagtcaacaaggcaacacatgtttatcagctttgcatttgcagttgtcacagtcacattgattgtacttgtatacgcacacaaatacactcatttagcctttatctcaaaatgttaaatataaggaaaaaagcgtcaacaataaatattctttgagtattgtcttaaaaaa

SEQ ID NO: 5445 - DNA, 2817 bp, Homo sapiens
ttctacagatctcactcctcgccctttttttttttcctttggtgtgtgttttttgttttgttttgttttttaaaaaaattcttgctgtgttggaactagcgagtggtggagtctctgaagcctcatcagtcaccgggactgtcaggaatagtggtttaagaggaagctcggcctggggcactataccctgtcatccagttccctgcctcggagataaagattccagctacatgggcaaacgcctggatcagccacaaatgtacccccagtacacttactactatcctcattatctccaaaccaagcagtcctatgcaccagctccccaccccatggctcctcccagccccagcacaaacagcagcagcaacaacagcagcaacaacagcagcggggaacagttgagtaaaaccaacctgtacattcgaggcctcccaccaggcaccactgaccaggacctaatcaagctgtgccaaccgtatggaaaaattgtatctacaaaggcaattcttgacaaaaacacaaatcagtgcaaaggttatggttttgtagattttgacagtcctgcagccgcacagaaagcggtagcatctctcaaggcaaatggcgtgcaggcacagatggctaagcaacaagagcaagacccaacaaacctatacatctcaaatctccccatttctatggatgagcaggagcttgagaatatgctgaaaccctttggacatgtcatttccacaagaatactaagagacgctaatggagtcagcagaggtgttggctttgccagaatggagtctactgaaaaatgtgaagtggtaattcaacattttaatggaaaatatctgaaaacaccaccaggcatcccagcccccagtgagcctttgctgtgcaaattcgctgatggaggacaaaagaagcgacagaatcaaagcaaatatacccagaatgggaggccttggcccagggaaggagaggctggcatggctttgacctatgaccccacagctgccatacagaatggattttattcttcaccgtacagtattgcaaccaaccgcatgattccacagacatctatcacgccattcattgctgcttcccctgtctccacataccaggtccagagtacttcatggatgcctcatccgccatacgttatgcaaccaacaggtgctgtgattacaccaaccatggaccatcccatgtcaatgcagccagccaacatgatgggcccactgacacagcagatgaatcacctttcgttgggcacaacaggaacgattcaatcccaagacaggattatgatactccaccagctgttgtgtcagtatatgactgctgctgctcctatgcaagggacctacattcctcagtacacgcctgtgcctccgacagctgtttctattgaaggtgttgttgctgatacctctccccagacagtggcaccttcatcccaggacaccagtggtcagcagcaacagatagcagtggacacatccaacgaacatgcacctgcatattcttaccaacagtctaaaccataaacaggactgaagaatgtctgtctgaatctttgccttgaatgaagaaacttcattgaacaagaagttggcttccagtttgcacagacgtcaatggaatgcatttttttgttgttgttgttgttttttttttagtgttataccttacccaatgaaagcaaagtttttatgtgctgtgcaaatggtcttcatgtggtctgacaatttatttttgccatcatttttttaattaaagaaaaaatttccagaagaggaaaaaaaaactacaaaaaacaaaacattgaaggttgatattttatgtggaagaacatttgaattgaattcagaatttttctgaaggtgtagatactttttttttttttttaacagaaaacctgatgtcaagaggtgggcaatagaaatggaaacaaattgtcttcctcaataattaagctactttctctttttcccttcttgttttaatctagtgggttttttattttattttttcttagaaatatgtaggtaaggtttatcttgaatcttaattgccttaattttaaggacgtcaaaggctctcgaggcaagctgtcaacgtcttgttgaaaacaaaaatcaagaaagaattgaaatactgtgccggctttcactggcacagaagtttaagactatgagtttttagggtgaagaaaaaactgtacagtttaaatgaaaatgtttttcttcatttgaagaaaatttgttgataaaccatggcaactgcaagaattggaaaaatgctgggacttttcatgaactttgtcttaagtgttgacatgaatcattctaaaaggctaaaacattttacagtaaagttattaaggttggtttaaaaacaactgcattagaaataatgcgtgtttggggggcagaatgcagatttttttaatttacaaagcgtgatcgctagcaaaagcattagtgctttttatctgcagtcttttttatgagctttacaaagtttttagtcagctttgcttgtcacattgcaaaacctagcttaagagcattaaaaaaaaaaacttaagtagataggagcttatggtcaaaaagtgcaaaaaaaaaaacaaaaaaaaagcaatagatagagaaattgttgacaatttctgtagtctttcctagttgtgatcaaattcagcctatggatggcctattttataccaaagatgaagtgacaccctattacagtccagaagatagaggttgttttcgtttcttttctttttaaaaaaaaaaaaatttatttgaccgaaaaaaa

SEQ ID NO: 5446 - DNA, 1585 bp, Homo sapiens
gccggagtgggccgtcagcacttaaagggcccgcggctcgggcgtaggaggcggtgcctctgcagcaagcgtggggcgcgggaacccgagcaggactctccagtcctcagtcaccttggacaaagaagtgtggatcctcagattccatcttttccaactccaaggtgccatggcagagaaggtgctggtaacaggtggggctggctacattggcagccacacggtgctggagctgctggaggctggctacttgcctgtggtcatcgataacttccataatgccttccgtggagggggctccctgcctgagagcctgcggcgggtccaggagctgacaggccgctctgtggagtttgaggagatggacattttggaccagggagccctacagcgtctcttcaaaaagtacagctttatggcggtcatccactttgcggggctcaaggccgtgggcgagtcggtgcagaagcctctggattattacagagttaacctgaccgggaccatccagcttctggagatcatgaaggcccacggggtgaagaacctggtgttcagcagctcagccactgtgtacgggaacccccagtacctgccccttgatgaggcccaccccacgggtggttgtaccaacccttacggcaagtccaagttcttcatcgaggaaatgatccgggacctgtgccaggcagacaagacttggaacgcagtgctgctgcgctatttcaaccccacaggtgcccatgcctctggctgcattggtgaggatccccagggcatacccaacaacctcatgccttatgtctcccaggtggcgatcgggcgacgggaggccctgaatgtctttggcaatgactatgacacagaggatggcacaggtgtccgggattacatccatgtcgtggatctggccaagggccacattgcagccttaaggaagctgaaagaacagtgtggctgccggatctacaacctgggcacgggcacaggctattcagtgctgcagatggtccaggctatggagaaggcctctgggaagaagatcccgtacaaggtggtggcacggcgggaaggtgatgtggcagcctgttacgccaaccccagcctggcccaagaggagctggggtggacagcagccttagggctggacaggatgtgtgaggatctctggcgctggcagaagcagaatccttcaggctttggcacgcaagcctgaggaccctcccctaccaaggaccaggaaaagcagcagctgcctgctctccagcctctggcaggaactcagggccctggagctgctggggccaagccaaggcctcccctacctcaaaccccagctgggcccgcttagcccaccaggcatgaggccaagggctccactgaccaggaggccgaggtctctaactcttatcttccacagggtccaagagttcatcaggacccccaagagtgagtgagggggcaaggctctggcacaaaacctcctcctcccaggcactcatttatattgctctgaaagagctttccaaagtatttaaaaataaaaacaagttttcttacactgggaaaaaaaaaaaaaaaaaaa

SEQ ID NO: 5447 - DNA, 1018 bp, Homo sapiens
gccaggcgaaggcggagcgctaacgtctaacgctaacggcggtcgtgccccgccgctgctgtcacccccggccgctgctgccctccccgccgaggttctactgctctccttcttaagaagggtgggaggcactcggtctctccccacacctctcgcctgaggccaggcgccaggtgtcgcctgaagccagacagccggtttgggagcgagcctgaggtcaaccaatcaatggctcagacagataagccaacatgcatcccgccggagctgccgaaaatgctgaaggagtttgccaaagccgccattcgggcgcagccgcaggacctcatccagtggggggccgattattttgaggccctgtcccgtggagagacgcctccggtgagagagcggtctgagcgagtcgctttgtgtaactgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccacaatggtgggttgccccgaatcccattcagcaccttccagtttctctacacgtatattgccgaagtggatggggagatctgtgcatcacatgtcagcaggatgctaaactacattgaacaggaagtaattggtcctgatggtttaatcacggtgaatgactttacccaaaaccccagggtttggctggagtaacagcacaattttggcaattttaaaggaagatacagaggtgattgtacttcagaatgataaacccatataccacctaaaatcaattttcttgtacaactggtacacactaataaacaaacatgtgagatcagaaaaaaaaaaaaaaaaaaaa

SEQ ID NO: 5448 - DNA, 753 bp, Homo sapiens
ctctttctcagtgaccgggtggtttgcttaggcgcagacggggaagcggagccaacatgccagtggcccggagctgggtttgtcgcaaaacttatgtgaccccgcggagacccttcgagaaatctcgtctcgaccaagagctgaagctgatcggcgagtatgggctccggaacaaacgtgaggtctggagggtcaaatttaccctggccaagatccgcaaggccgcccgggaactgctgacgcttgatgagaaggacccacggcgtctgttcgaaggcaacgccctgctgcggcggctggtccgcattggggtgctggatgagggcaagatgaagctggattacatcctgggcctgaagatagaggatttcttagagagacgcctgcagacccaggtcttcaagctgggcttggccaagtccatccaccacgctcgcgtgctgatccgccagcgccatatcagggtccgcaagcaggtggtgaacatcccgtccttcattgtccgcctggattcccagaagcacatcgacttctctctgcgctctccctacgggggtggccgcccgggccgcgtgaagaggaagaatgccaagaagggccagggtggggctggggctggagacgacgaggaggaggattaagtccacctgtccctcctgggctgctggattgtctcgttttcctgccaaataaacaggatcagcgctttacaaaaaaaaaaaaaaaaaaaaaaaaaaaaaaaaaaaaaaaaaa

SEQ ID NO: 5449 - DNA, 1797 bp, Homo sapiens
ggaaggggggcaggagaaaaaagcttttccaaaaaagtattggctgtcttgaggaatgcggtcgcccccttgggaaagtacatatctgggagaagcaggcggctccgcgctcgcactcccgctcctccgcccgaccgcgcgctcgccccgccgctcctgctgcagccccagggcccctcgccgccgccaccatggacgccatcaagaagaagatgcagatgctgaagctcgacaaggagaacgccttggatcgagctgagcaggcggaggccgacaagaaggcggcggaagacaggagcaagcagctcgaggaggacatcgcggccaaggagaagttgctgcgggtgtcggaggacgagcgggaccgggtgctggaggagctgcacaaggcggaggacagcctcctggccgccgaagaggccgccgccaaggctgaagccgacgtagcttctctgaacagacgcatccagctggttgaggaagagttggatcgtgcccaggagcgtctggcaacagctttgcagaagctggaggaagctgagaaggcagcagatgagagtgagagaggcatgaaagtcattgagagtcgagcccaaaaagatgaagaaaaaatggaaattcaggagatccaactgaaagaggccaagcacattgctgaagatgccgaccgcaaatatgaagaggtggcccgtaagctggtcatcattgagagcgacctggaacgtgcagaggagcgggctgagctctcagaaggccaagtccgacagctggaagaacaattaagaataatggatcagaccttgaaagcattaatggctgcagaggataagtactcgcagaaggaagacagatatgaggaagagatcaaggtcctttccgacaagctgaaggaggctgagactcgggctgagtttgcggagaggtcagtaactaaattggagaaaagcattgatgacttagaagagaaagtggctcatgccaaagaagaaaaccttagtatgcatcagatgctggatcagactttactggagttaaacaacatgtgaaaacctccttagctgcgaccacattctttcgttttgttttgttttgtttttaaacacctgcttaccccttaaatgcaatttatttacttttaccactgtcacagaaacatccacaagataccagctaggtcagggggtggggaaaacacatacaaaaaggcaagcccatgtcagggcgatcctggttcaaatgtgccatttcccgggttgatgctgccacactttgtagagagtttagcaacacagtgtgcttagtcagcgtaggaatcctcactaaagcagaagaagttccattcaaagtgccaatgatagagtcaacaggaaggttaatgttggaaacacaatcaggtgtggattggtgctactttgaacaaaaggtccccctgtggtcttttgttcaacattgtacaatgtagaactctgtccaacactaatttattttgtcttgagttttactacaagatgagactatggatcccgcatgcctgaattcactaaagccaagggtctgtaagccacgctgctcttccgagacttccattcctttctgattggcacacgtgcagctcatgacaatctgtaggataacaatcagtgtggatttccactcttttcagtccttcatgttaaagatttagacaccacatacaactggtaaaggacgttttcttgagagttttaactatatgtaaacattgtataatgatatggaataaaatgcacattgtaggacattttctaaaaaaaaaaa

SEQ ID NO: 5450 - DNA, 6089 bp, Homo sapiens
ccatgtgcaccaacatagtttacgagtggctcaaagcgctgcagcttccgcagtacgcggagtccttcgtggataacggctacgatgacctggaggtgtgcaagcagatcggggacccggacctggatgccatcggggtgctggcgcccgcgcaccgccgccgtatcctggaggccgtgcgccggctgcgggagcaggacgccaacgccgccggcctctacttcacgcttgagccgcagccggcgccccccgggccgcccgccgacgccgtccccaccggccgccggggggagccgtgcggcggcccggcccagggcacccgcggggactctcgcggccacacgaccgccccccgcagcagggagctggtgagctaccccaaactgaagctgaagatcatgatcagggataagctcgtccgtgacggcatccacctgagcaagcccccgtactcccgcaaggtcccaatggctggcatcctagagtacttaatgaattggccgaagtcatcacagagccgctagatatcatttttgagacctcgtggaggactgatgaggtgcctgaagactggaaaagggcatatttagaaccttctttcaaaaagggaaatggatgatgaccctggaaatactcatcagcttaactttttgcttggacaaattctggaataatcaacttagtaaactgggtaactggcttataacagctagaaataaggcagtgaactatcacgcataaagaagtattgagttcatttttttaagaagatatcatgatgagatacagtcttatgcatttcttggcattctcccttccattcttaatgaaaacagatgaggttggctaaggcatttgagtcataacttagtttaagtacaatataacaaaaaggtagatttctgacagtaagtagtaattatattatttccaaatttgcttttaacttgagaacagtagctttaatttttatattcaagcatacattctacttcatttcatataggaccatgtttttataagataagatacataattctatgtagaatagtttggtgaaggaattcttattttaaggtgcttttatatagttattttgtatattggtacaatgttaaaggtgatgaattaaggaacatcaccaagagaggacaatttcttctaacttctctttttaaatttaatctggctgaggtttagtattaggactaatacaagtgtcttgctctgacatgcatcaagcaagagctagctattttacttcatagctagtttcttgcactctgtggagactgccagggccgcagctcacagcctgttctgagctgcagtgctttatcccaccttgctctccaggcttctgacttcaggcctgtgggggccgggaggtgggcagcggcagtggcctgaggagccctgtagaactacggctgaaaaagaaagtagattgaggtggggggaggaaattaacaggaatctagagtttttctaattcttatcgtcttatcgttcttgtgtttggatgctggtagtttttttttttttagacagagtctcgctctgtcacccaggctggagtgtagtggcacaatcttggctcacagtgactttcgcctcccaggttcaaggaattctcctgcctcggcctcttggtagctgggattacaggcacgcatcaccacacccagctaatttttttgtatttttagtagagatggggttttaccatgttggccaggctgttcttgaactcctggcctcaaatgatccactcgccgtggcctccagtagcgctgggattacaggcgtgagccatcacacccggcctggatgctggtagttttattttctgcttagaaaacgcaaccatgttgatgggaccaaaaacttagttgaaagaagccatggcaaaagatgttgacgtacaactggctcctgaggctgtcaattgtttagagctcccaagtagtactgcattacggaatctactacttagaagaatgtacaagatgtaagttcccatcggcaccgtcatggtaagaagaataagaaactctcaaaggaaaagaaacttacattcactttttcctggtccattttggttcctaagaatagataggccattaagaaggatattaggtttctaaggacaattttaacacaatactgctttaaaaatctgaagtttaaatagtttagctatttctgtaggttaattcaggcactgactaaaatcagtctcattatcatatacaaatgtaaggaagttaaattttaaaagcatgtataggttgtccttaaattatacaaaagcttttagtttcatcaggattatattccagttaacctttcatcttttttttttttccaaatgaactagggtctttaaaattcctaagtagattcttttgagtggtaggggagtctgtatagattacagatataatttattgtgataacaaatggcttcctgtttgacctcatttccaggtgtcgcatccgtggctgatttatttcacagatgtacatttgcatgtacttgttgaactttgctaggaaggactcaatttttgaaaaatctgttattttcactgtgggccttatgaggcaatctactgcaatggaaaaagggttccttggtcatttcaagttttattttctattagagtaatatctaacttcaattattttgccaggtttaaaccttctctctgtgtctgtggttagaatttgaaaataacaatgctctgcttaaagtaagagtcacagtcagcaaaaaaagccaatggattttaaaaagacatcttagttaaagctagaggaagaaaacttcaaataagcaaagaagtattgaaggatgcccacgaattcctttgcattaaaatcaagatgaggtaagaggtagaatataagagaaagggattatttttaccatgaattgtatctggggacagttagtcttagaaggagtaattttttcagcgtttttcctctgtatctaaacaccaataatatacttaatttttgaatataaaagaagtagcaattgactaagaataaatatgttataaaaactaggggattatcttgatttacatttcctagagtattaaaagagattaattacagactttcacttgataatattgaggagtctggagggtcatagcaaaattttctttagttcatcttaaaatttagggaggtaaaaaaagattttattcacataaaagatttcttggcatagggaaggcgtaatgttaagggcttcttccttacccaagtgggagctgaaccagtaattgtggggaaaactgaatttatagcaacaaaggatagtagtttctcaactgggagcatacgagcaatttctcagttcagagatatttatagcatcttggtgttatgcaataaacaatgacaacaacaagcattgagctttcactttggagttactcagatctgagtttaaattctaaaattattctagtagtattttcctgcggtgaatctgttaaggatgtaagctatagtgtagcttggggaatcatcttgaacagttatgaaactcattaaagcttcttttcccttgtctgtaaaatgggaaaaataaatacctctatagctcttaagaggcttaagagttctatggcttacacccacatacagtccttggctcagtgctaggcatgtagcaggtgctgactgcctctctcccttcccttctttactctcagttgtcttatttcttcttatgcagaagagattaccttaaagctgactagaaaactcagacataaattgacatttccttatcattgcctgaaacccactgaataagtcccctttgatttctctcaggaaggataaaaaaggctacagtacctgctcataggagttcagtaaatgtttattgattgaatgaaaagaatttgatttaaggaaacaataacactccatcctgggcaacagagcaagatcccgtctcaaaacaaaacaaaacaaaacaaaacagcaaattcataaaggccagcagttttcaagtctggggaaataggcacatggacagattatatgaaggtatttcattagctttcttctctttatggcagcttcagattgatgaatttgaggtacaaatgagtgagtgacatatgtatattttcctctgattttatgactgatttacaaattaggagtgcaaatgggctgttccccgatagcatcttctgggaagaatccaaccaagatacaaagcagatgatggtggatcggcaaactcttttctatgaaaagaaaaaccagatataccagggactggaaagcacctgcttgaaaattgatatgagcatgtctgaatttttcccttataagagcctgagtattgtaacaggtctcttgcacagggggttgaaaaataaaaaaagaagttaacataattaaaatgcttggacaaaacatttgctttatatagattcttacaagtaatatttgattaggtatcaaaataggtttaggcaggtggaagttctgaatttcaaggcaaataaggcatgaagggtggaacattgcatctagggaaaataagagaaataagtgaaagtctgaccctacattgccaattctcagaccaagtacaaagtattaggaattttttatatcagctgacatcttgtgcttacagtaaagccatatagatgcacacatagtgactttattaaatcaaatgagttgtgcagagcagagcaaatctattaggctttctcttttagagttttctaattttactcttattagctccctcagttgtcatcaattacatattcctacatcagatattttacactatcagattctttgattaaaaaatcatcttcagctttacattattaatctctgaggacataaaatcaaataactttctagtccatgatcattaatccctactattttagatatttccataaaaggcttaaagggaaaaaaaaatggtaggtagttcagaaaaaaatggctgggcacggtggctcacgcctgtaatcccagcactttgggaggccggggtgggcagatcatttgaggtcaggagtttgagaccagcctggccaacatggtgaaaccctgtgtctactaaaaatacaaaaaaaattagctgagtgtggtggtgtgcgcctgtaatcccagctactaaggcaggagaatggcttgaacccaggaggtggaggtcgcagtgagctgagatcgcgccagtgcgctccagcctgggcaacagagtgagactctgtctaaaaaaaaaaaaaaaagaaaagaaaaaagaaaaattgaagaacataacttttctacttatgaaatagataattttttaaaattgtttaaactcctggaaattaagtgttattttttattactgcagttgagagataccttttcagaggaaaacaagaggctaaattccatgttaagagctaagtagtatttttttcttaacaattttgccaaaatttcttctactggaccaaaaggaaataaatctacaataaatctactttctaaatattatttaagatgggaaatgtcttttataggtatattctgtataatacccttaattagatgaattatcccttatcattccaaaaatgaaatgctgtgttaaatatctccagggcaaagtggtatgttgactgggacaaacgttagaaattgtattgttcattgcacttgttgccctgttccccaagcttgtcaatgtttagagatactattcgggttgctaaagccattattcatagaaaatttctgcccctacagaagtgtgtgcatgggccttggaaaatctacatgtgtatatctgagtagcgaagcacagattcactctaattgaaagcagcagtttggttttgtaaatgtaattgcaattgacactttcttttccctttcagttattattttttttaaaggacgttatgagaaggcactatgaaaagcctaattggaatagcattatgaaccatgtaatgcatgcccatgcacactgtgatttgcaaacatatgtccgctcttcaataaatgttacggctttcacagcg

SEQ ID NO: 5451 - DNA, 6392 bp, Homo sapiens
atcttttttcatcttctagctgtagctcgggctgcttgtcggcttggcctccccctcccccctttgctctctgcctcgtctttccccaggacttcgctattttgcttttttaaaaaaaggcaagaaagaactaaactcccccctccctctcctccagtcgggctgcacctctgccttgcactttgcacagaggtagagagcgcgcgagggagagagaggaaagaaaaaaaataataaagagagccaagcagaagaggaggcgagaagcatgaagtgttaactcccccgtgccaaggcccgcgccgcccggacagacgcccgccgcgcctccagccccgagcggacgccgcgcgcgccctgcctgcagcccgggccggcgaggcgagcccttccttatgcaaagcgcgcagcggagcggcgagcgggggacgccgcgcaccgggccgggctcctccagcttcgccgccgcagccaccaccgccgccaccgcagctcgcggaggatcttcccgagcctgaagccgccggctcggcgcgcaaggaggcgagcgagcaaggaggggccggggcgagcgagggagcacattggcgtgagcaggggggagggagggcgggcgcggggggcgcgggcagggcgggggggtgtgtgtgtgagcgcgctcggaggtttcgggccagccaccgccgcgcaagctagaagcgccccagcccggcaagctggctcacccgctggccacccagcacagcccgctggcccctctcctgcagcccatctggcggagcggcggcggcggcggcggcggcaggagaatggcatcagaactggcaatgagcaactccgacctgcccaccagtcccctggccatggaatatgttaatgacttcgatctgatgaagtttgaagtgaaaaaggaaccggtggagaccgaccgcatcatcagccagtgcggccgtctcatcgccgggggctcgctgtcctccacccccatgagcacgccgtgcagctcggtgcccccttcccccagcttctcggcgcccagcccgggctcgggcagcgagcagaaggcgcacctggaagactactactggatgaccggctacccgcagcagctgaaccccgaggcgctgggcttcagccccgaggacgcggtcgaggcgctcatcagcaacagccaccagctccagggcggcttcgatggctacgcgcgcggggcgcagcagctggccgcggcggccggggccggtgccggcgcctccttgggcggcagcggcgaggagatgggccccgccgccgccgtggtgtccgccgtgatcgccgcggccgccgcgcagagcggcgcgggcccgcactaccaccaccaccaccaccacgccgccggccaccaccaccacccgacggccggcgcgcccggcgccgcgggcagcgcggccgcctcggccggtggcgctgggggcgcgggcggcggtggcccggccagcgctgggggcggcggcggcggcggcggcggcggaggcggcgggggcgcggcgggggcggggggcgccctgcacccgcaccacgccgccggcggcctgcacttcgacgaccgcttctccgacgagcagctggtgaccatgtctgtgcgcgagctgaaccggcagctgcgcggggtcagcaaggaggaggtgatccggctgaagcagaagaggcggaccctgaaaaaccgcggctatgcccagtcctgccgcttcaagagggtgcagcagagacacgtcctggagtcggagaagaaccagctgctgcagcaagtcgaccacctcaagcaggagatctccaggctggtgcgcgagagggacgcgtacaaggagaaatacgagaagttggtgagcagcggcttccgagaaaacggctcgagcagcgacaacccgtcctctcccgagtttttcatgtgagtctgacacgcgattccagctagccaccctgataagtgctccgcgggggtccggctcgggtgtgggcttgctagttctagagccatgctcgccaccacctcaccacccccacccccaccgagtttggcccccttggccccctacacacacacaaacccgcacgcacacaccacacacacacacacacacacacacacaccccacaccctgctcgagtttgtggtggtggtggctgttttaaactggggagggaatgggtgtctggctcatggattgccaatctgaaattctccataacttgctagcttgttttttttttttttttacacccccccgccccacccccggacttgcacaatgttcaatgatctcagcagagttcttcatgtgaaacgttgatcacctttgaagcctgcatcattcacatattttttcttcttcttccccttcagttcatgaactggtgttcattttctgtgtgtgtgtgtgttttattttgtttggatttttttttttaattttacttttagagcttgctgtgttgcccaccttttttccaacctccaccctcactccttctcaacccatctcttccgagatgaaagaaaaaaaaaagcaaagtttttttttcttctcctgagttcttcatgtgagattgagcttgcaaaggaaaaaaaaatgtgaaatgttatagacttgcagcgtgccgagttccatcgggttttttttttagcattgttatgctaaaatagagaaaaaaatcctcatgaaccttccacaatcaagcctgcatcaaccttctgggtgtgacttgtgagttttggccttgtgatgccaaatctgagagtttagtctgccattaaaaaaactcattctcatctcatgcattattatgcttgctactttgtcttagcaacaatgaactataactgtttcaaagactttatggaaaagagacattatattaataaaaaaaaaaagcctgcatgctggacatgtatggtataattattttttcctttttttttccttttggcttggaaatggacgttcgaagacttatagcatggcattcatacttttgttttattgcctcatgacttttttgagtttagaacaaaacagtgcaaccgtagagccttcttcccatgaaattttgcatctgctccaaaactgctttgagttactcagaacttcaacctcccaatgcactgaaggcattccttgtcaaagataccagaatgggttacacatttaacctggcaaacattgaagaactcttaatgttttctttttaataagaatgacgccccactttggggactaaaattgtgctattgccgagaagcagtctaaaatttattttttaaaaagagaaactgccccattatttttggtttgttttatttttattttatattttttggcttttggtcattgtcaaatgtggaatgctctgggtttctagtatataatttaattctagtttttataatctgttagcccagttaaaatgtatgctacagataaaggaatgttatagataaatttgaaagagttaggtctgtttagctgtagattttttaaacgattgatgcactaaattgtttactattgtgatgttaaggggggtagagtttgcaaggggactgtttaaaaaaagtagcttatacagcatgtgcttgcaacttaaatataagttgggtatgtgtagtctttgctataccactgactgtattgaaaaccaaagtattaagaggggaaacgcccctgtttatatctgtaggggtattttacattcaaaaatgtatgtttttttttcttttcaaaattaaagtatttgggactgaattgcactaagatataacctgcaagcatataatacaaaaaaaaattgcaaaactgtttagaacgctaataaaatttatgcagttataaaaatggcattactgcacagttttaagatgatgcagatttttttacagttgtattgtggtgcagaactggattttctgtaacttaaaaaaaaatccacagttttaaaggcaataatcagtaaatgttattttcagggactgacatcctgtctttaaaaagaaatgaaaagtaaatcttaccacaataaatataaaaaaatcttgtcagttacttttcttttacatattttgctgtgcaaaattgttttatatcttgagttactaactaaccacgcgtgttgttcctatgtgcttttctttcattttcaattctggttatatcaagaaaagaataatctacaataataaacggcatttttttttgattctgtactcagtttcttagtgtacagtttaactgggcccaacaacctcgttaaaagtgtaaaatgcatccttttctccagtggaaggattcctggaggaatagggagacagtaattcagggtgaaattataggctgttttttgaagtgaggaggctggccccatatactgattagcaatatttaatatagatgtaaattatgacctcatttttttctccccaaagttttcagttttcaaatgagttgagccataattgcccttggtaggaaaaacaaaacaaaacagtggaactaggcttcctgagcatggccctacacttctgatcaggagcaaagccatccatagacagaggagccggacaaatatggcgcatcagaggtggcttgcgcacatatgcattgaacggtaaagagaaacagcgcttgccttttcactaaagttgactatttttccttcttctcttacacaccgagattttcttgttagcaaggcctgacaagatttaacataaacatgacaaatcatagttgtttgttttgttttgcttttctctttaacactgaagatcatttgtcttaaataggaaaaagaaaatccactccttacttccatatttccaagtacatatctggtttaaactatgttatcaaatcatatttcaccgtgaatattcagtggagaacttctctacctggatgagctagtaatgatttcagatcatgctatccccagaaataaaagcaaaaaataatacctgtgtggaatataggctgtgctttgatttactggtatttaccccaaaataggctgtgtatgggggctgacttaaagatcccttggaaagactcaaaactaccttcactagtaggactcctaagcgctgacctatttttaaatgacacaaattcatgaaactaatgttacaaattcatgcagtttgcactcttagtcatcttcccctagcacaccaatagaatgttagacaaagccagcactgttttgaaaatacagccaaacacgatgacttttgttttgttttctgccgttcttaaaagaaaaaaagataatattgcaactctgactgaaagacttatttttaagaaaacaggttgtgtttggtgctgctaagttctggccagtttatcatctggccttcctgcctattttttacaaaacacgaagacagtgtgtaacctcgacattttgaccttcctttatgtgctagtttagacaggctcctgaatccacacttaattttgcttaacaaaagtcttaatagtaaacctcccctcatgagcttgaagtcaagtgttcttgacttcagatatttctttcctttttttttttttttcctcatcacaactaagagatacacaaactctgaagaagcagaaatggagagaatgcttttaacaaaaaagcatctgatgaaagattttaggcaaacattctcaaaataagagtgatattctggatgtagttattgcagttatctcatgacaaatgaggcctggattggaaggaaaatatagttgtgtagaattaagcattttgataggaatctacaaggtagttgaatataataagcaggtttgggcccccaaactttagaaaatcaaatgcaaaggtgctggcaaaaatgaggtttgagtggctggctgtaagagaaggttaactcctagtaaaaggcatttttagaaataacaattactgaaaactttgaagtatagtgggagtagcaaacaaatacatgttttttttttcttacaaagaactcctaaatcctgagtaagtgccattcattacaataagtctctaaatttaaaaaaaaaaaaatcatatgaggaaatctagctttcccctttacgctgcgtttgatctttgtctaaatagtgttaaaattcctttcattccaattacagaactgagcccactcgcaagttggagccatcagtgggatacgccacattttggaagccccagcatcgtgtacttaccagtgtgttcacaaaatgaaatttgtgtgagagctgtacattaaaaaaaatcatcattattattattatttgcagtcatggagaaccacctacccctgacttctgtttagtctcctttttaaataaaaattactgtgttagagaaaaaaaaaaaaaaaa

SEQ ID NO: 5452 - DNA, 2500 bp, Homo sapiens
cccaggcgcagccaatgggaagggtcggaggcatggcacagccaatgggaagggccggggcaccaaagccaatgggaagggccgggagcgcgcggcgcgggagatttaaaggctgctggagtgaggggtcgcccgtgcaccctgtcccagccgtcctgtcctggctgctcgctctgcttcgctgcgcctccactatgctctccctccgtgtcccgctcgcgcccatcacggacccgcagcagctgcagctctcgccgctgaaggggctcagcttggtcgacaaggagaacacgccgccggccctgagcgggacccgcgtcctggccagcaagaccgcgaggaggatcttccaggagcccacggagccgaaaactaaagcagctgcccccggcgtggaggatgagccgctgctgagagaaaacccccgccgctttgtcatcttccccatcgagtaccatgatatctggcagatgtataagaaggcagaggcttccttttggaccgccgaggaggttgacctctccaaggacattcagcactgggaatccctgaaacccgaggagagatattttatatcccatgttctggctttctttgcagcaagcgatggcatagtaaatgaaaacttggtggagcgatttagccaagaagttcagattacagaagcccgctgtttctatggcttccaaattgccatggaaaacatacattctgaaatgtatagtcttcttattgacacttacataaaagatcccaaagaaagggaatttctcttcaatgccattgaaacgatgccttgtgtcaagaagaaggcagactgggccttgcgctggattggggacaaagaggctacctatggtgaacgtgttgtagcctttgctgcagtggaaggcattttcttttccggttcttttgcgtcgatattctggctcaagaaacgaggactgatgcctggcctcacattttctaatgaacttattagcagagatgagggtttacactgtgattttgcttgcctgatgttcaaacacctggtacacaaaccatcggaggagagagtaagagaaataattatcaatgctgttcggatagaacaggagttcctcactgaggccttgcctgtgaagctcattgggatgaattgcactctaatgaagcaatacattgagtttgtggcagacagacttatgctggaactgggttttagcaaggttttcagagtagagaacccatttgactttatggagaatatttcactggaaggaaagactaacttctttgagaagagagtaggcgagtatcagaggatgggagtgatgtcaagtccaacagagaattcttttaccttggatgctgacttctaaatgaactgaagatgtgcccttacttggctgattttttttttccatctcataagaaaaatcagctgaagtgttaccaactagccacaccatgaattgtccgtaatgttcattaacagcatctttaaaactgtgtagctacctcacaaccagtcctgtctgtttatagtgctggtagtatcaccttttgccagaaggcctggctggctgtgacttaccatagcagtgacaatggcagtcttggctttaaagtgaggggtgaccctttagtgagcttagcacagcgggattaaacagtcctttaaccagcacagccagttaaaagatgcagcctcactgcttcaacgcagattttaatgtttacttaaatataaacctggcactttacaaacaaataaacattgttttgtactcacggcggcgataatagcttgatttatttggtttctacaccaaatacattctcctgaccactaatgggagccaattcacaattcactaagtgactaaagtaagttaaacttgtgtagactaagcatgtaatttttaagttttattttaatgaattaaaatatttgttaaccaactttaaagtcagtcctgtgtatacctagatattagtcagttggtgccagatagaagacaggttgtgtttttatcctgtggcttgtgtagtgtcctgggattctctgccccctctgagtagagtgttgtgggataaaggaatctctcagggcaaggagcttcttaagttaaatcactagaaatttaggggtgatctgggccttcatatgtgtgagaagccgtttcattttatttctcactgtattttcctcaacgtctggttgatgagaaaaaattcttgaagagttttcatatgtgggagctaaggtagtattgtaaaatttcaagtcatccttaaacaaaatgatccacctaagatcttgcccctgttaagtggtgaaatcaactagaggtggttcctacaagttgttcattctagttttgtttggtgtaagtaggttgtgtgagttaattcatttatatttactatgtctgttaaatcagaaattttttattatctatgttcttctagattttacctgtagttcataaaaaaaaaaaaaaaaaaaaaaaaa

SEQ ID NO: 5453 - DNA, 2957 bp, Homo sapiens
ggggcggggactgtcgcgtggagctgccgggcgagcaccgttagggcagcctggcgcgcggcgcccgccaggcgcccagtcctctgccatcgcccacgcctccctggtgccagggaacaggtatcagcgcgcctccccagcggctgggagagacgctgaatgaagaagagggaaggacggttagtcagcagtcttatagctggatcagctaccaagagaagttgtaaaccaagaagagaaaagcatttcaatttgggacatttatttgcacctggaaatggggaatgggctgtcagaccagacttctatcctgtccaacctgccttcatttcagtctttccacattgttattctgggtttggactgtgctggaaagacaactgtcttatacaggctgcagttcaatgaatttgtaaataccgtacctaccaaaggatttaacactgagaaaattaaggtaaccttgggaaattctaaaacagtcacttttcacttctgggatgtaggtggtcaggagaaattaaggccactgtggaagtcatataccagatgcacagatggcattgtatttgttgtggactctgttgatgtcgaaaggatggaagaagccaaaactgaacttcacaaaataactaggatatcagaaaatcagggagtccctgtacttatagttgctaacaaacaagatttgaggaactcattgtcactttcagaaattgagaaattgttagcaatgggtgaactgagctcatcaactccttggcatttgcagcctacctgtgcaatcataggagatggcctaaaggaaggacttgagaaactacatgatatgatcattaaaagaagaaaaatgttgcggcaacagaaaaagaaaagatgaatatcaatacctattatatctgtgtggagtaggttttctctggtctgattttgacaaatagaagagtgtctacagcgtggtttgcctgtctgccctcctggatgctattaaagctttgttttgttgaacaatcagatgcccaactctgttgccttgtggaagatgagtaaatgcagtgcttcttaaagtggtctcttctccctaccccacaaatcttttggtactaccatttggggaagccaagcaaggatagtaaattgaccagaacacagttgtgggaatttggtctgaagttagtgaaataaaactttaaagagtgtctgcctagtgttttgtgcttacatctttcggggggaagcctttgcaagaaaattgcatacaaggctttgtaacgatcaagtgctaatcgatggaaatgttaaggtagattaacatatatgcagttatattgatcacattggtccaaccagtccttttttgaagtaagggacaaggagtaagtattttcttttttaagtttctgccaaatgatttttgacgctttctggaatcaagtaatttaatagtatagcttaattctagacaatgtttaagttggtctacctttattaaaaataagatatttggggtatattcaagtgcatggattagttttcctgacaaagcatgttttggtgtgtagtcttactttttagaaatagctatgcatcgttctacacaggtttaaaacaacttttttggggatttagggctattataggaatagtttgttgtcagaagcactttcacttgaagaacctaaaatgattgactcattcatagtaaatatgggcatgtaaactaataaatatgcactggatacatatatggatttatgaagaaggcgatttagtcaagaggatgtaattaaaatatgtggtctctaaaatattccagttacaagatatttgttttattaatatttgctggctaaaaacaaatgtggtttttatatatttttgtagtgtgttgagaagagcaaaagctttataaatatacctgatgcgctgtagaatgaaaatgtaaaagataacctgtatgtgttccgagctttaattttttgtttacaaattgaacagtgttacatgggctgtccagtcctgattatagagaggaagaaatggtaacagtatggcagataagaattacaattatagaaaatgaggggaaaataacaaacctgttttatgaaaattcactggtgctgtttacattggaataaaaagctctataaggaggaaaggcctttatctaattcttatctacagacacttacttccagtgaccatattttactaaatcagcttattttttatgtctaaagcaacagctgttctgaaaaatcaccaaaagaaatgcactttgctagcaggatttgttttggctttgggttttgtttttttgttttttttttttttcagtggcataacagtttttggaaccttgattcttgtgtcacacaaaatgaatgaagtagcttgatgtggagccttcatatgttaaatattcctgcactagtgatggtcacttagaatgtttatagaaatgtggataataactaccaataaactacttgaggcactaggagaacagtatttgactttgaattttaatgtatttccacttttgctgaagcttttaatcagatgtgtaaaaacaattgaccagctaggctatttagtcccatagtagttcagatctgcttagatgtgacaggcattgaaggctgtttttttttttttctcccttcactgatactgaaatcatggtatctgctgcaaacatgagtagatccatgatggattaataaagcttgctgaaaaaaaaaatctgtgtatcaattagatttaccagtttgcctgtactttctgtctacctactatgtaaaatagtgctgtttttaagtatttcaaaagcttgtgtgttgaccctttgtagcctaagtacgtaaacaaattaatgttatctaagtttttcatatttcatggacaacaaaagagaaaatggtatgaacactgtacaaactttgatttataaa

SEQ ID NO: 5454 - DNA, 2318 bp, Homo sapiens
gcacagaagcgagtccgactgtgctcgctgctcagcgccgcacccggaagatgaggctcgccgtgggagccctgctggtctgcgccgtcctggggctgtgtctggctgtccctgataaaactgtgagatggtgtgcagtgtcggagcatgaggccactaagtgccagagtttccgcgaccatatgaaaagcgtcattccatccgatggtcccagtgttgcttgtgtgaagaaagcctcctaccttgattgcatcagggccattgcggcaaacgaagcggatgctgtgacactggatgcaggtttggtgtatgatgcttacctggctcccaataacctgaagcctgtggtggcagagttctatgggtcaaaagaggatccacagactttctattatgctgttgctgtggtgaagaaggatagtggcttccagatgaaccagcttcgaggcaagaagtcctgccacacgggtctaggcaggtccgctgggtggaacatccccataggcttactttactgtgacttacctgagccacgtaaacctcttgagaaagcagtggccaatttcttctcgggcagctgtgccccttgtgcggatgggacggacttcccccagctgtgtcaactgtgtccagggtgtggctgctccacccttaaccaatacttcggctactcgggagccttcaagtgtctgaaggatggtgctggggatgtggcctttgtcaagcactcgactatatttgagaacttggcaaacaaggctgacagggaccagtatgagctgctttgcctggacaacacccggaagccggtagatgaatacaaggactgccacttggcccaggtcccttctcataccgtcgtggcccgaagtatgggcggcaaggaggacttgatctgggagcttctcaaccaggcccaggaacattttggcaaagacaaatcaaaagaattccaactattcagctctcctcatgggaaggacctgctgtttaaggactctgcccacgggtttttaaaagtcccccccaggatggatgccaagatgtacctgggctatgagtatgtcactgccatccggaatctacgggaaggcacatgcccagaagccccaacagatgaatgcaagcctgtgaagtggtgtgcgctgagccaccacgagaggctcaagtgtgatgagtggagtgttaacagtgtagggaaaatagagtgtgtatcagcagagaccaccgaagactgcatcgccaagatcatgaatggagaagctgatgccatgagcttggatggagggtttgtctacatagcgggcaagtgtggtctggtgcctgtcttggcagaaaactacaataagagcgataattgtgaggatacaccagaggcagggtattttgctgtagcagtggtgaagaaatcagcttctgacctcacctgggacaatctgaaaggcaagaagtcctgccatacggcagttggcagaaccgctggctggaacatccccatgggcctgctctacaataagatcaaccactgcagatttgatgaatttttcagtgaaggttgtgcccctgggtctaagaaagactccagtctctgtaagctgtgtatgggctcaggcctaaacctgtgtgaacccaacaacaaagagggatactacggctacacaggcgctttcaggtgtctggttgagaagggagatgtggcctttgtgaaacaccagactgtcccacagaacactgggggaaaaaaccctgatccatgggctaagaatctgaatgaaaaagactatgagttgctgtgccttgatggtaccaggaaacctgtggaggagtatgcgaactgccacctggccagagccccgaatcacgctgtggtcacacggaaagataaggaagcttgcgtccacaagatattacgtcaacagcagcacctatttggaagcaacgtaactgactgctcgggcaacttttgtttgttccggtcggaaaccaaggaccttctgttcagagatgacacagtatgtttggccaaacttcatgacagaaacacatatgaaaaatacttaggagaagaatatgtcaaggctgttggtaacctgagaaaatgctccacctcatcactcctggaagcctgcactttccgtagaccttaaaatctcagaggtagggctgccaccaaggtgaagatgggaacgcagatgatccatgagtttgccctggtttcactggcccaagtggtttgtgctaaccacgtctgtcttcacagctctgtgttgccatgtgtgctgaacaaaaaataaaaattattattgattttatatttc

SEQ ID NO: 5455 - DNA, 5698 bp, Homo sapiens
aggttcaagtggagctctcctaaccgacgcgcgtctgtggagaagcggcttggtcgggggtggtctcgtggggtcctgcctgtttagtcgctttcagggttcttgagccccttcacgaccgtcaccatggaagtgtcaccattgcagcctgtaaatgaaaatatgcaagtcaacaaaataaagaaaaatgaagatgctaagaaaagactgtctgttgaaagaatctatcaaaagaaaacacaattggaacatattttgctccgcccagacacctacattggttctgtggaattagtgacccagcaaatgtgggtttacgatgaagatgttggcattaactatagggaagtcacttttgttcctggtttgtacaaaatctttgatgagattctagttaatgctgcggacaacaaacaaagggacccaaaaatgtcttgtattagagtcacaattgatccggaaaacaatttaattagtatatggaataatggaaaaggtattcctgttgttgaacacaaagttgaaaagatgtatgtcccagctctcatatttggacagctcctaacttctagtaactatgatgatgatgaaaagaaagtgacaggtggtcgaaatggctatggagccaaattgtgtaacatattcagtaccaaatttactgtggaaacagccagtagagaatacaagaaaatgttcaaacagacatggatggataatatgggaagagctggtgagatggaactcaagcccttcaatggagaagattatacatgtatcacctttcagcctgatttgtctaagtttaaaatgcaaagcctggacaaagatattgttgcactaatggtcagaagagcatatgatattgctggatccaccaaagatgtcaaagtctttcttaatggaaataaactgccagtaaaaggatttcgtagttatgtggacatgtatttgaaggacaagttggatgaaactggtaactccttgaaagtaatacatgaacaagtaaaccacaggtgggaagtgtgtttaactatgagtgaaaaaggctttcagcaaattagctttgtcaacagcattgctacatccaagggtggcagacatgttgattatgtagctgatcagattgtgactaaacttgttgatgttgtgaagaagaagaacaagggtggtgttgcagtaaaagcacatcaggtgaaaaatcacatgtggatttttgtaaatgccttaattgaaaacccaacctttgactctcagacaaaagaaaacatgactttacaacccaagagctttggatcaacatgccaattgagtgaaaaatttatcaaagctgccattggctgtggtattgtagaaagcatactaaactgggtgaagtttaaggcccaagtccagttaaacaagaagtgttcagctgtaaaacataatagaatcaagggaattcccaaactcgatgatgccaatgatgcagggggccgaaactccactgagtgtacgcttatcctgactgagggagattcagccaaaactttggctgtttcaggccttggtgtggttgggagagacaaatatggggttttccctcttagaggaaaaatactcaatgttcgagaagcttctcataagcagatcatggaaaatgctgagattaacaatatcatcaagattgtgggtcttcagtacaagaaaaactatgaagatgaagattcattgaagacgcttcgttatgggaagataatgattatgacagatcaggaccaagatggttcccacatcaaaggcttgctgattaattttatccatcacaactggccctctcttctgcgacatcgttttctggaggaatttatcactcccattgtaaaggtatctaaaaacaagcaagaaatggcattttacagccttcctgaatttgaagagtggaagagttctactccaaatcataaaaaatggaaagtcaaatattacaaaggtttgggcaccagcacatcaaaggaagctaaagaatactttgcagatatgaaaagacatcgtatccagttcaaatattctggtcctgaagatgatgctgctatcagcctggcctttagcaaaaaacagatagatgatcgaaaggaatggttaactaatttcatggaggatagaagacaacgaaagttacttgggcttcctgaggattacttgtatggacaaactaccacatatctgacatataatgacttcatcaacaaggaacttatcttgttctcaaattctgataacgagagatctatcccttctatggtggatggtttgaaaccaggtcagagaaaggttttgtttacttgcttcaaacggaatgacaagcgagaagtaaaggttgcccaattagctggatcagtggctgaaatgtcttcttatcatcatggtgagatgtcactaatgatgaccattatcaatttggctcagaattttgtgggtagcaataatctaaacctcttgcagcccattggtcagtttggtaccaggctacatggtggcaaggattctgctagtccacgatacatctttacaatgctcagctctttggctcgattgttatttccaccaaaagatgatcacacgttgaagtttttatatgatgacaaccagcgtgttgagcctgaatggtacattcctattattcccatggtgctgataaatggtgctgaaggaatcggtactgggtggtcctgcaaaatccccaactttgatgtgcgtgaaattgtaaataacatcaggcgtttgatggatggagaagaacctttgccaatgcttccaagttacaagaacttcaagggtactattgaagaactggctccaaatcaatatgtgattagtggtgaagtagctattcttaattctacaaccattgaaatctcagagcttcccgtcagaacatggacccagacatacaaagaacaagttctagaacccatgttgaatggcaccgagaagacacctcctctcataacagactatagggaataccatacagataccactgtgaaatttgttgtgaagatgactgaagaaaaactggcagaggcagagagagttggactacacaaagtcttcaaactccaaactagtctcacatgcaactctatggtgctttttgaccacgtaggctgtttaaagaaatatgacacggtgttggatattctaagagacttttttgaactcagacttaaatattatggattaagaaaagaatggctcctaggaatgcttggtgctgaatctgctaaactgaataatcaggctcgctttatcttagagaaaatagatggcaaaataatcattgaaaataagcctaagaaagaattaattaaagttctgattcagaggggatatgattcggatcctgtgaaggcctggaaagaagcccagcaaaaggttccagatgaagaagaaaatgaagagagtgacaacgaaaaggaaactgaaaagagtgactccgtaacagattctggaccaaccttcaactatcttcttgatatgcccctttggtatttaaccaaggaaaagaaagatgaactctgcaggctaagaaatgaaaaagaacaagagctggacacattaaaaagaaagagtccatcagatttgtggaaagaagacttggctacatttattgaagaattggaggctgttgaagccaaggaaaaacaagatgaacaagtcggacttcctgggaaaggggggaaggccaaggggaaaaaaacacaaatggctgaagttttgccttctccgcgtggtcaaagagtcattccacgaataaccatagaaatgaaagcagaggcagaaaagaaaaataaaaagaaaattaagaatgaaaatactgaaggaagccctcaagaagatggtgtggaactagaaggcctaaaacaaagattagaaaagaaacagaaaagagaaccaggtacaaagacaaagaaacaaactacattggcatttaagccaatcaaaaaaggaaagaagagaaatccctggtctgattcagaatcagataggagcagtgacgaaagtaattttgatgtccctccacgagaaacagagccacggagagcagcaacaaaaacaaaattcacaatggatttggattcagatgaagatttctcagattttgatgaaaaaactgatgatgaagattttgtcccatcagatgctagtccacctaagaccaaaacttccccaaaacttagtaacaaagaactgaaaccacagaaaagtgtcgtgtcagaccttgaagctgatgatgttaagggcagtgtaccactgtcttcaagccctcctgctacacatttcccagatgaaactgaaattacaaacccagttcctaaaaagaatgtgacagtgaagaagacagcagcaaaaagtcagtcttccacctccactaccggtgccaaaaaaagggctgccccaaaaggaactaaaagggatccagctttgaattctggtgtctctcaaaagcctgatcctgccaaaaccaagaatcgccgcaaaaggaagccatccacttctgatgattctgactctaattttgagaaaattgtttcgaaagcagtcacaagcaagaaatccaagggggagagtgatgacttccatatggactttgactcagctgtggctcctcgggcaaaatctgtacgggcaaagaaacctataaagtacctggaagagtcagatgaagatgatctgttttaaaatgtgaggcgattattttaagtaattatcttaccaagcccaagactggttttaaagttacctgaagctcttaacttcctcccctctgaatttagtttggggaaggtgtttttagtacaagacatcaaagtgaagtaaagcccaagtgttctttagctttttataatactgtctaaatagtgaccatctcatgggcattgttttcttctctgctttgtctgtgttttgagtctgctttcttttgtctttaaaacctgatttttaagttcttctgaactgtagaaatagctatctgatcacttcagcgtaaagcagtgtgtttattaaccatccactaagctaaaactagagcagtttgatttaaaagtgtcactcttcctccttttctactttcagtagatatgagatagagcataattatctgttttatcttagttttatacataatttaccatcagatagaactttatggttctagtacagatactctactacactcagcctcttatgtgccaagtttttctttaagcaatgagaaattgctcatgttcttcatcttctcaaatcatcagaggccaaagaaaaacactttggctgtgtctataacttgacacagtcaatagaatgaagaaaattagagtagttatgtgattatttcagctcttgacctgtcccctctggctgcctctgagtctgaatctcccaaagagagaaaccaatttctaagaggactggattgcagaagactcggggacaacatttgatccaagatcttaaatgttatattgataaccatgctcagcaatgagctattagattcattttgggaaatctccataatttcaatttgtaaactttgttaagacctgtctacattgttatatgtgtgtgacttgagtaatgttatcaacgtttttgtaaatatttactatgtttttctattagctaaattccaacaattttgtactttaataaa

SEQ ID NO: 5456 - DNA, 1896 bp, Homo sapiens
atttcagcagctctcagggccttgggctcatcccgagtcccgggctcagtatgtggcgccttcctcgcgcgctgtgtgtgcacgctgcaaagaccagcaagctctctggaccttggagcaggcctgccgccttcatgtccactctcctcatcaatcagccccagtatgcgtggctgaaagagctggggctccgcgaggaaaacgagggcgtgtataatggaagctggggaggccggggagaggttattacgacctattgccctgctaacaacgagccaatagcaagagtccgacaggccagtgtggcagactatgaagaaactgtaaagaaagcaagagaagcatggaaaatctgggcagatattcctgctccaaaacgaggagaaatagtaagacagattggcgatgccttgcgggagaagatccaagtactaggaagcttggtgtctttggagatggggaaaatcttagtggaaggtgtgggtgaagttcaggagtatgtggatatctgtgactatgctgttggtttatcaaggatgattggaggacctatcttgccttctgaaagatctggccatgcactgattgagcagtggaatcccgtaggcctggttggaatcatcacggcattcaatttccctgtggcagtgtatggttggaacaacgccatcgccatgatctgtggaaatgtctgcctctggaaaggagctccaaccacttccctcattagtgtggctgtcacaaagataatagccaaggttctggaggacaacaagctgcctggtgcaatttgttccttgacttgtggtggagcagatattggcacagcaatggccaaagatgaacgagtgaacctgctgtccttcactgggagcactcaggtgggaaaacaggtgggcctgatggtgcaggagaggtttgggagaagtctgttggaacttggaggaaacaatgccattattgcctttgaagatgcagacctcagcttagttgttccatcagctctcttcgctgctgtgggaacagctggccagaggtgtaccactgcgaggcgactgtttatacatgaaagcatccatgatgaggttgtaaacagacttaaaaaggcctatgcacagatccgagttgggaacccatgggaccctaatgttctctatgggccactccacaccaagcaggcagtgagcatgtttcttggagcagtggaagaagcaaagaaagaaggtggcacagtggtctatgggggcaaggttatggatcgccctggaaattatgtagaaccgacaattgtgacaggtcttggccacgatgcgtccattgcacacacagagacttttgctccgattctctatgtctttaaattcaagaatgaagaagaggtctttgcatggaataatgaagtaaaacagggactttcaagtagcatctttaccaaagatctgggcagaatctttcgctggcttggacctaaaggatcagactgtggcattgtaaatgtcaacattccaacaagtggggctgagattggaggtgcctttggaggagaaaagcacactggtggtggcagggagtctggcagtgatgcctggaaacagtacatgagaaggtctacttgtactatcaactacagtaaagaccttcctctggcccaaggaatcaagtttcagtaaaggtgttttagatgaacatcccttaatttgaggtgttccagcagctgtttttggagaagacaaagaaaattaaagttttccctgaataaatgcattattatgactgtgacagtgactaatccccctatgaccccaaagccctgattaaatcaagagattccttttttaaaaatcaaaataaaattgttacaacatagccatagttactaaaaaaaaaaaaaaaaaa

SEQ ID NO: 5457 - DNA, 1599 bp, Homo sapiens
ggcaggcccctacagccaatggaacggccctggaagagacccgggtcgcctccggagcttcaaaaacatgtgaggagggaagagtgtgcagacggaacttcagccgctgcctctgttctcagcgtcagtgccgccactgcccccgccagagcccaccggccagcatgtcctctgctcacttcaaccgaggccctgcctacgggctgtcagccgaggttaagaacaagctggcccagaagtatgaccaccagcgggagcaggagctgagagagtggatcgagggggtgacaggccgtcgcatcggcaacaacttcatggacggcctcaaagatggcatcattctttgcgaattcatcaataagctgcagccaggctccgtgaagaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgcagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctacagggttagagtttggagagagcagactggcggggggcccattggggggaaggggaccctccgctctgtagtgctacagggtccaacatagagccgggtgtccccaacagcgcccaaaggacgcactgagcaacgctattccagctgtccccccactccctcacaagtgggtacccccaggaccagaagctcccccagcaaagcccccagagcccaggctcggcctgcccccaccccattcccgcagtgggagcaaactgcatgcccagagacccagcggacacacgcggtttggtttgcagcgactggcatactatgtggatgtgacagtggcgtttgtaatgagagcactttcttttttttctatttcactggagcacaataaatggctgtaaaatctcaaaaaaaaaaaaa

SEQ ID NO: 5458 - DNA, 429 bp, Homo sapiens
gcccgtgccgccccagccgctgccgcctgcaccggacccggagccgccatgcccaagtgtcccaagtgcaacaaggaggtgtacttcgccgagagggtgacctctctgggcaaggactggcatcggccctgcctgaagtgcgagaaatgtgggaagacgctgacctctgggggccacgctgagcacgaaggcaaaccctactgcaaccacccctgctacgcagccatgtttgggcctaaaggctttgggcggggcggagccgagagccacactttcaagtaaaccaggtggtggagaccccatccttggctgcttgcagggccactgtccaggcaaatgccaggccttgtccccagatgcccagggctcccttgttgcccctaatgctctcagtaaacctgaacacttggaaaaaaaaaaaaaaaaaaa

SEQ ID NO: 5459 - DNA, 2665 bp, Homo sapiens
aatcgctgacatcatccgggggcgggcgcccctgccctgcgggtgactccgacccctggctagagggtaggcggcgtggagcagcgcgcgcaagcgaggccaggggaaggtgggcgcaggtgaggggccgaggtgtgcgcaggactttagccggttgagaaggatcaagcaggcatttggagcacaggtgtctagaaacttttaaggggccggttcaagaaggaaaagttcccttctgctgtgaaactatttggcaagaggctggagggcccaatggctgcaaaatcgcaacccaacattcccaaagccaagagtctagatggcgtcaccaatgacagaaccgcatctcaagggcagtggggccgtgcctgggaggtggactggttttcactggcgagcgtcatcttcctactgctgttcgcccccttcatcgtctactacttcatcatggcttgtgaccagtacagctgcgccctgactggccctgtggtggacatcgtcaccggacatgctcggctctcggacatctgggccaagactccacctataacgaggaaagccgcccagctctataccttgtgggtcaccttccaggtgcttctgtacacgtctctccctgacttctgccataagtttctacccggctacgtaggaggcatccaggagggggccgtgactcctgcaggggttgtgaacaagtatcagatcaatggcctgcaagcctggctcctcacgcacctgctctggtttgcaaacgctcatctcctgtcctggttctcgcccaccatcatcttcgacaactggatcccactgctgtggtgcgccaacatccttggctatgccgtctccaccttcgccatggtcaagggctacttcttccccaccagcgccagagactgcaaattcacaggcaatttcttttacaactacatgatgggcatcgagtttaaccctcggatcgggaagtggtttgacttcaagctgttcttcaatgggcgccccgggatcgtcgcctggaccctcatcaacctgtccttcgcagcgaagcagcgggagctccacagccatgtgaccaatgccatggtcctggtcaacgtcctgcaggccatctacgtgattgacttcttctggaacgaaacctggtacctgaagaccattgacatctgccatgaccacttcgggtggtacctgggctggggcgactgtgtctggctgccttatctttacacgctgcagggtctgtacttggtgtaccaccccgtgcagctgtccaccccgcacgccgtgggcgtcctgctgctgggcctggtgggctactacatcttccgggtggccaaccaccagaaggacctgttccgccgcacggatgggcgctgcctcatctggggcaggaagcccaaggtcatcgagtgctcctacacatccgccgatgggcagaggcaccacagcaagctgctggtgtcgggcttctggggcgtggcccgccacttcaactacgtcggcgacctgatgggcagcctggcctactgcctggcctgtggcggcggccacctgctgccctacttctacatcatctacatggccatcctgctgacccaccgctgcctccgggacgagcaccgctgcgccagcaagtacggccgggactgggagcgctacaccgccgcagtgccttaccgcctgctgcctggaatcttctaagggcacgccctagggagaagccctgtggggctgtcaagagcgtgttctgccaggtccatgggggctggcatcccagctccaactcgaggagcctcagtttcctcatctgtaaactggagagagcccagcacttggcaggtgtccagtacctaatcacgctctgttccttgcttttgccttcaagggaattccgagtgtccagcactgccgtattgccagcacagacggattttctctaatcagtgtccctggggcaggaggatgacccagtcacctttactagtcctttggagacaatttacctgtattaggagcccaggccacgctacactctgcccacactggtgagcaggaggtcttcccacgccctgtcattaggctgcatttactcttgctaaataaaagtgggagtggggcgtgcgcgttatccatgtattgcctttcagctctagatccccctcccctgcctgctctgcagtcgtgggtggggcccgtgcgccgtttctccttggtagcgtgcacggtgttgaactgggacactggggagaaaggggctttcatgtcgtttccttcctgctcctgctgcacagctgccaggagtgctctgcctggagtctgcagacctcagagaggtcccagcaccggctgtggcctttcaggtgtaggcaggtgggctctgcttcccgattccctgtgagcgcccaccctctcgaaagaattttctgcttgccctatgactgtgcagactctggctcgagcaacccggggaacttcaccctcaggggcctcccacaccttctccagcgaggaggtctcagtcccagcctcgggagggcacctccttttctgtgctttcttccctgaggcattcttcctcatccctagggtgttgtgtagaactctttttaaactctatgctccgagtagagttcatctttatattaaacttcccctgttcaaataa

SEQ ID NO: 5460 - DNA, 5181 bp, Homo sapiens
tttctcacagccacctccaactcttaaaaacgcttccaactgcctcccagcacacaaccaagggagaaaactattctgtcaaagagacggtgccaaaaggcaaaaacaaaggagctgatggcaaagaaggtagctgtgattggagctggggtcagtggcctaatttctctgaagtgctgtgtggatgagggacttgagcccacttgctttgagagaactgaagatattggaggagtgtggaggttcaaagagaatgtggaagatggccgagcaagtatctatcaatctgtcgttaccaacaccagcaaagaaatgtcctgtttcagtgactttccaatgcctgaagattttccaaacttcctgcataattctaaacttctggaatatttcaggatttttgctaaaaaatttgatctgctaaaatatattcagttccagacaactgtccttagtgtgagaaaatgtccagatttctcatcctctggccaatggaaggttgtcactcagagcaacggcaaggagcagagtgctgtctttgacgcagttatggtttgcagtggccaccacattctacctcatatcccactgaagtcatttccaggtatggagaggttcaaaggccaatatttccatagccgccaatacaagcatccagatggatttgagggaaaacgcatcctggtgattggaatgggaaactcaggctcagatattgctgttgagctgagtaagaatgctgctcaggtttttatcagcaccaggcatggcacctgggtcatgagccgtatctctgaagatggctatccttgggactcagtgttccacacccggtttcgttctatgctccgcaatgtactgccacgaacagctgtaaaatggatgatagaacaacagatgaatcggtggttcaaccatgaaaattatggccttgagcctcaaaacaaatacattatgaaggaacctgtactaaatgatgatgtcccaagtcgtctactctgtggagccatcaaggtgaaatctacagtgaaagagctcacagaaacttctgccatctttgaggatggaacagtggaggagaacattgatgtcatcatttttgcaacaggatatagtttctcttttcccttccttgaagattcactcgttaaagtagagaataatatggtctcactgtataaatacatattccccgctcacctggacaagtcaaccctcgcgtgcattggtctcatccagcccctaggttccattttcccaactgctgaacttcaagctcgttgggtgacaagagttttcaaaggcttgtgtagcctgccctcagagagaactatgatgatggacattatcaaaaggaatgaaaaaagaattgacctgtttggagaaagccagagccagacgttgcagaccaattatgttgactacttggacgagctcgccttagagataggtgcgaagccagatttctgctctctcttgttcaaagatcctaaactggctgtgagactctatttcggaccctgcaactcctattagtatcgcctggttgggcctgggcaatgggaaggagccagaaatgccatcttcacccagaaacaaagaatactgaagccactcaagactcgggccctgaaggattcatctaatttctcagtttcttttctgttgaaaatcctgggccttcttgctgttgttgtggcctttttttgccaacttcaatggtcctagtcagcataatgctttgggctttattatcttgtcagtcactacctcctaaagaaaaaaaaaaaggctagaagaaaaaacattacattcatgttctaattatagattttagagttaggtagtacaggtaagggggaaattgtaaagaattagcagaattaggcatatgtacaaaaccaaaattttgtcatgaaattttgcctttccacgcttccctcagttcaccaaagttaccaaaatgtaaaataaaataagactggctcaggtaagtagtgctgccaaccctgatataggggagttgtatggaaaaatagtagaattacacagcatgaaaagcagcccatggtttaaattattggacaatttaaattgtgggtaaatatttaaaactcctgaacaatgtttctgatggtcttctatccaccctacttggtaacaaagttctcagatgttaggtcatgtttcatttgctcagtcggggatcactcaaaactactagacaaaaaagtgagaggatagatttagaaaacatcagtgatgctcagataaacttttaggacctcatattaagagctaagcaaatggccacatttcctatattttgacagagatactgctggaaaaattaaaattaaaatgccataatagctacctaacaaatatatatgtttaatgtttatcataggccagacattgtgctatgtgcatatcatatgtattatttcatttaattctcacaacaattctgtgaaatggttacagctattatagtcatttcacagatgatgaaactaagattcagagcagctgatcttgtgaggcagctggaattggaactcagatttgttgaactctagaactaaagatcataatgttgtcttgtaatatatttatttacaaaacacttcattatttataaagaatttactaacagtttatcttatttatacccatacatctgctactttgggaggccctttacatagaaaacagcattctttttgccaaatatgaccaaattacttttatttataatttttgatttatatttcagctagatctaaaaagcatctgaaggaatttacaatgaaagatacctatgcaataacatttaggataatctttgacattttggaaaaataagaattgaggaaaaaaagtgtatctttcaagtagatgcaaagcattataatgactgacacttgtatctaactccagtcttacagataactaaggcaaaaagctaaataaacaatatgtaacctctaacatttggtaaaaggaagtatactggtctgttagcagagacaaactttttttagaattgaagtctgaaacaaacaaaagcaattcaatgtcaatagacattaagcaacataatagacaaacatctcctaagggaacatttgttacagctgctccttccctgaactgtgctttggaagataagctctgtcctgagtccaaaccaagcccttccaagagagaacaaaggtcagagatgttgaagattccagcaaatttctcctcttatttctaccaagcctttgtgaacattgctcttcattttggcctgtacttctccctcagggacgtagaacaatggaatgtcagtcagtctctgtagttaaaactttttctttaaaattcaattaaggtacttctccctcagggacgtagaacaatggaatgtcagtcagtctctgtagttaaaactttttctttaaaattcaattaagttacaccagaatttacaggcaagattttttttttcattgctcccataagcaaatttgttttaaaataattgtaaatgaggtatatacttagttcttggttaaaaaatatattgctttgttaagtattaaagattatttgtaagtcattgtattaataatactaataaaatttatcaagcctttatagcaagggtcagtgaattaccactgcctgtgggccaaatctagctcactatctgtttttgtaaataaaattttataatagtacacagccacactcattcatttattttctgtggttgctttcaagctacaattgtagagttgggtagtcgcaacagaatctctgtggcccacaaggctaaaatatttacattctcacccattacagaaaaagtttgataattcctgctttataatatgtaaggcattgtcccattttgcataacttgccttatttcatcattatcactacccatttagtagctatggttgttatcttacttctacagtggaagagattgaaaagcatttgtcaggttaatgctaaatcagtgcggaaatatagctccactaggaaaatattattaaatttatatccctaaaatttttagaaatctctcaaaatctttccaaatgttctggtatctttgaaaaatgtaaatagtttatttatagagaaccctacctctgaggttgactcaaaggttaaagaaggctcatcagtctatccttctgcctccatatatcctgaacatcaaactatcccaggaaaaccatctagagtagtttgtttcaaaatattagccacagaccacctacatcacaataactcagggagcttatagaagtgaagattcctgaatataaacatagtaataattcaacctactgaatggaaatctctgctgaaatccacagttttcataagctccccagatgattcctgtgtacattaaatctagaaaccattagtttgagatctctcaaaaataaaaataaaaattgctttcagagagtagcccatgaaatttcccattcttcaaggacaaattccttctgttcagccttggtcctccaactgcagtttacaatttttgttcttctcctgtaaagaatgtcaatggttatcaccttcaatagtttcaatatgtcccccaaagttatgtgtttgaaacttgcaatagtattgggagatggggcctaatgaggtgattaggtgaagtctctgccctcatgaaaagattaatcccattatctcaggagtgtgttggttataaaagcaagtttggctccctcttttcctcacacactctttttcccttctgccttcacctttgccgtgggtggacacagcaagaaggccctcatcagatgctggccccttggtcttgaatttcctagcctctacaactaagccaaataaatttctgtttattataaataacccagtctcagatattctgttacagaaacacaaaatggactaagacaccacccttttccaaaatctctccttgtgatggctccctttactaacctttcttttagctattccctttatgatagtttcttaattttttctatcaaaagctaaatatggcacacttgttctttacagaaaaataaagatattttaaacaaaatactagggccatggtatgtaataaaatttgaaacaataatttcaaataataaagattgaaaatgcttaacccag

SEQ ID NO: 5461 - DNA, 2058 bp, Homo sapiens
gttgggaaagagcagcctgggcggcaggggcggtggctggagctcggtaaagctcgtgggaccccattgggggaatttgatccaaggaagcggtgattgccgggggaggagaagctcccagatccttgtgtccacttgcagcgggggaggcggagacggcggagcgggccttttggcgtccactgcgcggctgcaccctgccccatcctgccgggatcatggtctgcggcagcccgggagggatgctgctgctgcgggccgggctgcttgccctggctgctctctgcctgctccgggtgcccggggctcgggctgcagcctgtgagcccgtccgcatccccctgtgcaagtccctgccctggaacatgactaagatgcccaaccacctgcaccacagcactcaggccaacgccatcctggccatcgagcagttcgaaggtctgctgggcacccactgcagccccgatctgctcttcttcctctgtgccatgtacgcgcccatctgcaccattgacttccagcacgagcccatcaagccctgtaagtctgtgtgcgagcgggcccggcagggctgtgagcccatactcatcaagtaccgccactcgtggccggagaacctggcctgcgaggagctgccagtgtacgacaggggcgtgtgcatctctcccgaggccatcgttactgcggacggagctgattttcctatggattctagtaacggaaactgtagaggggcaagcagtgaacgctgtaaatgtaagcctattagagctacacagaagacctatttccggaacaattacaactatgtcattcgggctaaagttaaagagataaagactaagtgccatgatgtgactgcagtagtggaggtgaaggagattctaaagtcctctctggtaaacattccacgggacactgtcaacctctataccagctctggctgcctctgccctccacttaatgttaatgaggaatatatcatcatgggctatgaagatgaggaacgttccagattactcttggtggaaggctctatagctgagaagtggaaggatcgactcggtaaaaaagttaagcgctgggatatgaagcttcgtcatcttggactcagtaaaagtgattctagcaatagtgattccactcagagtcagaagtctggcaggaactcgaacccccggcaagcacgcaactaaatcccgaaatacaaaaagtaacacagtggacttcctattaagacttacttgcattgctggactagcaaaggaaaattgcactattgcacatcatattctattgtttactataaaaatcatgtgataactgattattacttctgtttctcttttggtttctgcttctctcttctctcaacccctttgtaatggtttgggggcagactcttaagtatattgtgagttttctatttcactaatcatgagaaaaactgttcttttgcaataataataaattaaacatgctgttaccagagcctctttgctggagtctccagatgttaatttactttctgcaccccaattgggaatgcaatattggatgaaaagagaggtttctggtattcacagaaagctagatatgccttaaaacatactctgccgatctaattacagccttatttttgtatgccttttgggcattctcctcatgcttagaaagttccaaatgtttataaaggtaaaatggcagtttgaagtcaaatgtcacataggcaaagcaatcaagcaccaggaagtgtttatgaggaaacaacacccaagatgaattatttttgagactgtcaggaagtaaaataaataggagcttaagaaagaacattttgcctgattgagaagcacaactgaaaccagtagccgctggggtgttaatggtagcattcttcttttggcaatacatttgatttgttcatgaatatattaatcagcattagagaaatgaattataactagacatctgctgttatcaccatagttttgtttaatttgcttccttttaaataaacccattggtgaaagtcccaaaaaaaaaaaaaaaaaaaaa

SEQ ID NO: 5462 - DNA, 1330 bp, Homo sapiens
gcagcccagccaagcactgtcaggaatcctgtgaagcagctccagctatgtgtgaagaagaggacagcactgccttggtgtgtgacaatggctctgggctctgtaaggccggctttgctggggacgatgctcccagggctgttttcccatccattgtgggacgtcccagacatcagggggtgatggtgggaatgggacaaaaagacagctacgtgggtgacgaagcacagagcaaaagaggaatcctgaccctgaagtacccgatagaacatggcatcatcaccaactgggacgacatggaaaagatctggcaccactctttctacaatgagcttcgtgttgcccctgaagagcatcccaccctgctcacggaggcacccctgaaccccaaggccaaccgggagaaaatgactcaaattatgtttgagactttcaatgtcccagccatgtatgtggctatccaggcggtgctgtctctctatgcctctggacgcacaactggcatcgtgctggactctggagatggtgtcacccacaatgtccccatctatgagggctatgccttgccccatgccatcatgcgtctggatctggctggccgagatctcactgactacctcatgaagatcctgactgagcgtggctattccttcgttactactgctgagcgtgagattgtccgggacatcaaggagaaactgtgttatgtagctctggactttgaaaatgagatggccactgccgcatcctcatcctcccttgagaagagttacgagttgcctgatgggcaagtgatcaccatcggaaatgaacgtttccgctgcccagagaccctgttccagccatccttcatcgggatggagtctgctggcatccatgaaaccacctacaacagcatcatgaagtgtgatattgacatcaggaaggacctctatgctaacaatgtcctatcagggggcaccactatgtaccctggcattgccgaccgaatgcagaaggagatcacggccctagcacccagcaccatgaagatcaagatcattgcccctccggagcgcaaatactctgtctggatcggtggctccatcctggcctctctgtccaccttccagcagatgtggatcagcaaacaggaatacgatgaagccgggccttccattgtccaccgcaaatgcttctaaaacactttcctgctcctctctgtctctagcacacaactgtgaatgtcctgtggaattatgccttcagttcttttccaaatcattcctagccaaagctctgactcgttacctatgtgttttttaataaatctgaaataggctactggtaa

SEQ ID NO: 5463 - DNA, 1345 bp, Homo sapiens
gcctctggggttttatattgctctggtattcatgccaaagacacaccagccctcagtcactgggagaagaacctctcataccctcggtgctccagtccccagctcactcagccacacacaccatgtgtgaagaggagaccaccgcgctcgtgtgtgacaatggctctggcctgtgcaaggcaggcttcgcaggagatgatgccccccgggctgtcttcccctccattgtgggccgccctcgccaccagggtgtgatggtgggaatgggccagaaagacagctatgtgggggatgaggctcagagcaagcgagggatcctaactctcaaataccccattgaacacggcatcatcaccaactgggatgacatggagaagatctggcaccactccttctacaatgagctgcgtgtagcacctgaagagcaccccaccctgctcacagaggctcccctaaatcccaaggccaacagggaaaagatgacccagatcatgtttgaaaccttcaatgtccctgccatgtacgtcgccattcaagctgtgctctccctctatgcctctggccgcacgacaggcatcgtcctggattcaggtgatggcgtcacccacaatgtccccatctatgaaggctatgccctgccccatgccatcatgcgcctggacttggctggccgtgacctcacggactacctcatgaagatcctcacagagagaggctattcctttgtgaccacagctgagagagaaattgtgcgagacatcaaggagaagctgtgctatgtggccctggattttgagaatgagatggccacagcagcttcctcttcctccctggagaagagctatgagctgccagatgggcaggttatcaccattggcaatgagcgcttccgctgccctgagaccctcttccagccttcctttattggcatggagtccgctggaattcatgagacaacctacaattccatcatgaagtgtgacattgacatccgtaaggacttatatgccaacaatgtcctctctgggggcaccaccatgtaccctggcattgctgacaggatgcagaaggagatcacagccctggcccccagcaccatgaagatcaagattattgctcccccagagcggaagtactcagtctggatcgggggctctatcctggcctctctctccaccttccagcagatgtggatcagcaagcctgagtatgatgaggcagggccctccattgtccacaggaagtgcttctaaagtcagaacaggttctccaaggatcccctcgagactactctgttaccagtcatgaaacattaaaacctacaagccttaaaaaaaaaaaaaaa

SEQ ID NO: 5464 - DNA, 4001 bp, Homo sapiens
aggcatcagcaatctatcagggaacggcggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaaacaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctctaaaaaaaaaaaaaaaaa

SEQ ID NO: 5465 - DNA, 2053 bp, Homo sapiens
aaagccaggcagagcccgggggcgagggggcggcaggcaggtgtagcgctgccctgggcgggcttgcacccccacacccaagtgagcggcctgctcactcctcagctgcaggagccagacgtgtggagtcccagcagaggccaacctgtgtctcttcatctccgtgagaaaggtgcccccgaagtgaaagagatggcctggtggaaagcctggattgaacaggagggtgtcacagtgaagagcagctcccacttcaacccagaccctgatgcagagaccctctacaaagccatgaaggggatcgggaccaacgagcaggctatcatcgatgtgctcaccaagagaagcaacacgcagcggcagcagatcgccaagtccttcaaggctcagttcggcaaggacctcactgagaccttgaagtctgagctcagtggcaagtttgagaggctcattgtggcccttatgtacccgccatacagatacgaagccaaggagctgcatgacgccatgaagggcttaggaaccaaggagggtgtcatcattgagatcctggcctctcggaccaagaaccagctgcgggagataatgaaggcgtatgaggaagactatgggtccagcctggaggaggacatccaagcagacacaagtggctacctggagaggatcctggtgtgcctcctgcagggcagcagggatgatgtgagcagctttgtggacccggcactggccctccaagacgcacaggatctgtatgcggcaggcgagaatattcgtgggactgatgagatgaaattcatcaccatcctgtgcacgcgcagtgccactcacctgctgagagtgtttgaagagtatgagaaaattgccaacaagagcattgaggacagcatcaagagtgagacccatggctcactggaggaggccatgctcactgtggtgaaatgcacccaaaacctccacagctactttgcagagagactctactatgccatgaagggagcagggacgcgtgatgggaccctgataagaaacatcgtttcaaggagcgagattgacttaaatcttatcaaatgtcacttcaagaagatgtacggcaagaccctcagcagcatgatcatggaagacaccagcggtgactacaagaacgccctgctgagcctggtgggcagcgacccctgaggcacagaagaacaagagcaaagaccatgaagccagagtctccaggactcctcactcaacctcggccatggacgcaggttgggtgtgaggggggtcccagcctttcggtcttctatttccctatttccagtgctttccagccgggtttctgacccagagggtggaaccggcctggactcctcttcccaacttcctccaggtcatttcccagtgtgagcacaatgccaaccttagtgtttctccagccagacagatgcctcagcatgaagggcttggggacttgtggatcattccttcctccctgcaggagcttcccaagctggtcacagagtctcctgggcacaggttatacagaccccagccccattcccatctactgaaacagggtctccacaagaggggccagggaatatgggtttttaacaagcgtcttacaaaacacttctctatcatgcagccggagagctggctgggagcccttttgttttagaacacacatccttcagcagctgagaaacgaacacgaatccatcccaaccgagatgccattaacattcatctaaaaatgttaggctctaaatggacgaaaaattctctcgccatcttaataacaaaataaactacaaattcctgacccaaggacactgtgttataagaggcgtgggctcccctggtggctgaccaggtcagctgccctggccttgcacccctctgcatgcagcacagaagggtgtgaccatgccctcagcaccactcttgtccccactgaacggcaactgagactgggtacctggagattctgaagtgcctttgctgtggttttcaaaataataaagatttgtattcaactcaaaaaaaaaaaaaaaaaaaaaaaaaa

SEQ ID NO: 5466 - DNA, 12887 bp, Homo sapiens
aacaactttcttattatctagcttcataattgcagtaaggaatagctttttttgcttgcagctgagatgactttttcaagggagaaaaagggatttctataacgaagagagggagagagagatgaagagggagggagtaagggagagagggaagaagggagaaagagagagagatttgaatatacattgcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagacggaccacagcaagcagaggctgggggggggaaagacgaggaaagaggaggaaaacaaaagctgctacttatggaagatacaaaggagtctaacgtgaagacattttgctccaagaatatcctagccatccttggcttctcctctatcatagctgtgatagctttgcttgctgtggggttgacccagaacaaagcattgccagaaaacgttaagtatgggattgtgctggatgcgggttcttctcacacaagtttatacatctataagtggccagcagaaaaggagaatgacacaggcgtggtgcatcaagtagaagaatgcagggttaaaggtcctggaatctcaaaatttgttcagaaagtaaatgaaataggcatttacctgactgattgcatggaaagagctagggaagtgattccaaggtcccagcaccaagagacacccgtttacctgggagccacggcaggcatgcggttgctcaggatggaaagtgaagagttggcagacagggttctggatgtggtggagaggagcctcagcaactacccctttgacttccagggtgccaggatcattactggccaagaggaaggtgcctatggctggattactatcaactatctgctgggcaaattcagtcagaaaacaaggtggttcagcatagtcccatatgaaaccaataatcaggaaacctttggagctttggaccttgggggagcctctacacaagtcacttttgtaccccaaaaccagactatcgagtccccagataatgctctgcaatttcgcctctatggcaaggactacaatgtctacacacatagcttcttgtgctatgggaaggatcaggcactctggcagaaactggccaaggacattcaggttgcaagtaatgaaattctcagggacccatgctttcatcctggatataagaaggtagtgaacgtaagtgacctttacaagaccccctgcaccaagagatttgagatgactcttccattccagcagtttgaaatccagggtattggaaactatcaacaatgccatcaaagcatcctggagctcttcaacaccagttactgcccttactcccagtgtgccttcaatgggattttcttgccaccactccagggggattttggggcattttcagctttttactttgtgatgaagtttttaaacttgacatcagagaaagtctctcaggaaaaggtgactgagatgatgaaaaagttctgtgctcagccttgggaggagataaaaacatcttacgctggagtaaaggagaagtacctgagtgaatactgcttttctggtacctacattctctccctccttctgcaaggctatcatttcacagctgattcctgggagcacatccatttcattggcaagatccagggcagcgacgccggctggactttgggctacatgctgaacctgaccaacatgatcccagctgagcaaccattgtccacacctctctcccactccacctatgtcttcctcatggttctattctccctggtccttttcacagtggccatcataggcttgcttatctttcacaagccttcatatttctggaaagatatggtatagcaaaagcagctgaaatatgctggctggagtgaggaaaaaaatcgtccagggagcattttcctccatcgcagtgttcaaggccatccttccctgtctgccagggccagtcttgacgagtgtgaagcttccttggcttttactgaagcctttcttttggaggtattcaatatcctttgcctcaaggacttcggcagatactgtctctttcatgagtttttcccagctacacctttctcctttgtactttgtgcttgtataggttttaaagacctgacacctttcataatctttgctttataaaagaacaatattgactttgtctagaagaactgagagtcttgagtcctgtgataggaggctgagctggctgaaagaagaatctcaggaactggttcagttgtactctttaagaacccctttctctctcctgtttgccatccattaagaaagccatatgatgcctttggagaaggcagacacacattccattcccagcctgctctgtgggtaggagaattttctacagtaggcaaatatgtgctaaagccaaagagttttataaggaaatatatgtgctcatgcagtcaatacagttctcaatcccacccaaagcaggtatgtcaataaatcacatattcctaggtgatacccaaatgctacagagtggaacactcagacctgagatttgcaaaaagcagatgtaaatatatgcattcaaacatcagggcttactatgaggtaggtggtatatacatgtcacaaataaaaatacagttacaactcagggtcacaaaaaatgcatcttccaatgcatatttttattatggtaaaatatacataaatataattcaccattttaacatttaattcatattaaatacgtacaaatcagtgacatttagtacattcacagtgttgtgccaccatcaccactatttagttccagaacatttgcatcatcaatacattgtctagagacaagactatcctgggtaggcagaaaccatagatcttttgtgtttacagctatggaaaccaactgtaccataaagatagttcactgagttttaaagccaagccacatcttatttttccaaggtttaatttagtgagagggcagcattagtgtggagtggcatgcttttgccctatcgtggaatttacacatcagaatgtgcaggatccaagtctgaaagtgttgccacccgtcacacaacatgggctttgtttgcttattccatgaagcagcagctatagaccttaccatggaaacatgaagagaccctgcacccctttccttaaggattgctgcaagagttacctgttgagcaggattgactggtgatgtttcattctgaccttgtcccaagctctccatctctagatctggggactgactgttgagctgatggggaaagaaaagctctcacacaaaccggaagccaaatgtcccctatctcttgaatgatcaagtcacttttgacaacatccaggtgaatataaaaacttaataaagctgtggaaaggaactcttaatcttcttttctgctacttaggttaaattcactagatcttgattaggaatcaaaattcgaattgggacatgttcaaattctttcttgtggtagttgcctatactgtcatcgctgctgttggttgagcatttgtggtgtaccacgctgtgtgctcaagggtattacattcatcttctcatttaatcctcacaacaatctgaagaaggtaggtattacaattcccacttcatagaaacagaaactgaggttcagagaggttaagtcatttgcccaaatggctgagccaaagcctaccatgtacctaacctttattttctttcccgaacataccaggctgtctcctcataacttccaagcatgcacttaaaactccacatgaatacaaggttcatgggacttggtattcatagaaagggaggcagaaagctggtctgttcctgataggcttgtaatttaatatcattctgttcatgtgctttggatggaagcacatctggcatatgatgctaatcagtggttcccatacccctggcttcctaattttaatgtttgctcacagcatagtagattgacatcaaatagtggccgatgatgatgaaaataaaggtcaaataagttgagccaataacagccgcttttttccttctgtctgcgtatacaaagcactgtcatgcacacaatctattctgaccctcacaacaacccataagggtgtaaatagtatttccattttacaaatgaggatcacacaaactactacatggcagagcagatactccaactcatgtcttctggttgaagcctattgctttttcttttctaaacactttccctcagcaagttggaattagacttcacaagtctccttcagagaacacaaatcttttcttattccattcctgtttggttgcctacgtccaatctccccctccccagagatgccaaaaaaaaaatcctttaaggtatttgggagccaaactcaacttgttaaaatctcaaattatggagacaatcagcagacacaacctaaccccaattattttggcaggaaggttggtttagaggcagatccagcaatctgctttgggccactctgggtggggtaggtgaaataagattggtcactgttaactaattttaatattggattggccattggttatcactgattaccattctcccctggattttcacccaggactcaaaacttggttctgctaaccctgttcctttatgaggaaccttttaaagattcctttataaggtgggagttttttttctatgaacctataggggagaaaaaagatcagcagaagtcattacttttttttttttttttttttttttttgagagagagtctcactccattgcccaggctggagtgcagtggtgctatctcggctcactgcaacctccgcctcctgggttcaagcaattctcctgcctcagcctcccgagtagctgggattgcaggtgcccaccaccacacccggctaatttttgtatttttagtaaagacagggtttcaccatgttggccaggctggtctccaactcccaatctcaggtgatcctattgcctcgggctcccaaagtgctgggattacaggagtgagccaccatgcctggccagaagtggttacttctgtagacaaaagaataatgctacttaatcaggctttctgtgtgacaagaaagagaaagaaaataaagaagtttcaattcatccaattcttaataagaaatatgtaaataaaattttttaaaattacacttcattttaatgttgtatcagtcaaggtccctgcaagagatggatggtatggtacactcaaactgggtaacacaggagagttttcagaaagcaactaaatccaaaatactatcaaggaatcaatataaaaattgttaatatttttctcatactaaattttcaaaatattttgtgtctattacatttacagcacatcttaattaggactagctgtgtgttcacctcacatgtggcttgtagctaccatactggacagcacatgtccaaaaaaatacacgtaaagttaaagtttaaaagacacaggaactaagccctcattgtctttcccttgggaggtagtttaaagagctatagatgctgtaacattcttgctattatttattatatatgacattattcctaaaaaagcttttgagatcctaggttgtattcctcaggttttgttgccttcccatgaagatgtgaaggcagggatgcctgttattcagtccaagatgcatgacaagagaccttgggaaagtttcatctggatttaaagattaattcttgatgcttacattccatactcaaaatgtaaatttgaatattaaaataaagatgattttttttttggagctagtcttgctctgttgcccaggctggaatgcagtggcatgatcatggctcactgcagcctcgacctcccaagctcaagcaaggctacaggtgtgcacctaagtagctaggactacaggtgtgcaccaccatgtctagctatttttttttctgtagagacagggttttcctatgttgtccaggctggtctcgaactcctgccctcaagcaatcctcctgccttggcctcccaaagtgttgagattacaggcgtaagccactgcacctggccaagatgaatattttaatagctcacagaacaaagtttgccacataatgataaaattactatgaaaatatattccctttattgtcagtttaaaagatgaactgagtttcacccaaactggtctggcccctctctgattcaaataccaatagttgctctgattcaaattccaactgttagaacatgacagctgctcataactagctttgcttactaaccatgtttctttccatttgtattaggtcctttactttttataacagcctcaaagtttcatgaattgctgcagtaaacattgattttcatgtttgtgagtctgcaagccagctgggcagctctacttcaggtggtaagggtggatcagacctattccatatacctcttgttctccttgtccagtggtttctagggatatgttctcatgatgaaccccgcagaggctcgtgaaagtgagaggaaactaggatgcctcttaaggtcttggtcaggatggggtctcctgtcacttctgtcacaggctattgtaagtcatatgagcaagctcaataaaatataaacaagtcagataaacagtgggaggaatggcaaagtcatatggccaaggccatgagtgattaattttaacacaggaaaaaagtaaagcattaaatgcgattatttaatatacaatgtcttattaactgaaatataaaatgtgtttactgtaaaatataatctgtttatctcaccaaagaaatattatctttaaaaaatgtcattacttctaagacatcatcagtctgcaacttctttccatagccttaatcaggatgctgtggcagctcccacattagcctcgcattctaaactggtagatgtcctaggaaaccatacatctatgtatttttcttattttatacgtttaggacaatgtatagctaattacccaactttttatttgcatacaaatctaatacaactgaacacaatcagttttatcacaggtataatggatttttcaatagtgaggaggtgcctccatgagccttctctttagaaaagtggcattcaagactcttcatttgaagtgaagattgctatgtcttttgcattgctctattttacataaattaagttataaattgacactataatcaactgacaccatgatcagtgatgatgatcaccctcatcagcactagagttgacttgtttttataacccctttgcatgtatgttgaatagcaaagttcatcagagaacatgtattagtcaatggtaagtaagatactctcatctaagaaataacatcacctcttctaatgaagttctaagaagagagggaagaaaaagtcttgggagctagtcagggaatagtgtgtatttgcaattacctaaactgaactctaccattactcctaacccagttcctcctcctgtgttttacatgattaatgccacccctgcctcaatgaaccaagatcagctccatcactgggacctccccattctgcctgtgcaatatttttcttttttatttctccttctaatattactgttattgctccagtaaagagctgtaatatattttacctggactgataccaggaatggtggtgttgcttccaatctgttgctgctagattaatctttgcaaagcacaggcttaatttcattgctgctcaactaaaaccactggtggctttccattgcctacaaaataaagtcaacctccccatcagacattcaaggctttcaatgatccatggccgccagctctctccaggctcatatcccactccactcctctgatgtttcctacactacactacactatactacactacagccaggtagaatgactgttcacccaacaccactcaggttgtcttctcaacttggaatactcttgcaccttcaaagctcatttcaaatgccccttcatttgtgaagccttctccaaatttccaagtcagaatgtctcttccttgtgctaccacaaccctttaactgagcctccattagtgcactgagaccattctgttcagtgtctgggtgaagcttcctggtgaaaaatatgttacctatttctttctgaaaagttggattcagggatattatcacggacctaaggtaatagttctagccaacctccctgtccactgccaggccgactacaaacccttctgttgctggcgagctggtccgcaccactagttctgcttcactctatttatctcttgatgtaaccatcttctttctccaggttttaagaaccagcccaactcctggttccctgatgaagcttttattcccctagccacatggaacttttcctttttggaacatgcctttagtttctgtgtagtttgccatgcagcacttcattgtacacattattaaaacagaattttaaggattagaatgaaccttaaaagatcatgcatctcaaaatttaatgtacatacaaattacccagggattttgttgaaataaaaattatttaattttaattaatataaataattcagtaggtctggggtgaggcctgaggttttacatttccaacaagctgccaggtaaagccaatacatctgtccaggaatcacactttgcgtatcaaaggtctagatgacattatcattccaaagagtttcttttacaggctctcagatcagtgttcatccactacctgactactgtcattcacaggcattctgttccacagcaggccagctaacgtggtatttacaaagctcactcctcttatacaacaatccaagtgtttcttttgtcagttgtctgtgccccaggagatccctctctgccttgccttgccctctgcctttggagaccagcacctcatactcagtgaaggcctggagtgcttaagagggatttcttccagctctcttgccctggtcttcagtgtattagatgtattacctccatgctctcagtagaggcccataggaaagagtaggtaggttatgccagctcacacgcatcctttaaaaatggtttagaagtttagctggtttcttattactcctgtctatggatgtttccttctgtcactctactagggatgaaacagctaatcatgttcaatagttacatttagattggtttttaaaaactatgattgtattagttcgtttccatgctgctgataaagacatatctgagactggaaacaaaaagggtttaattggacttacagttccacatggctggggaggcctcaaaatcaggtgggaggcaaaaggtacttcttacgtggtggcatcaagagcaaaatgaggaagaagcaaaagcagaaactcttcataaacccaccagatcttgtgggacttattatcacgagaatagcacagaaaagactggcctccatgattcaattacctcccactgcgtccctcccacaacatgtgggaattctgggagatacaattcaagttgagatttgggtggggacacagccaaaccatatcattcctccctgggctcctccaaatttcataatcctcacatttcaaaaccaatcattccttcccaacagttccccaaagtcttaactcatttcagcattaacccaaaagtccacagtccaaagtctcatctgagacaaggcaagtcccttccacttacaagcctgtaaaagcaagctagttacctcctagatacaatggggggtacaggtattgggtaaatacagctgttccaaatgagagaaattggccaaaacaaaggggttacagggtccatgcaagtctgaaatccagtggggcagtcaaattttaaagctccataatgatctcctttgactccatgtctcacattcaggtcatgctgatgcaagagataggttcccatggtcttgtgcagctccgcccctgtggctttgcagagtacagcctccctcctggctgctttctcaggctgatgttgagtgtctgtagcttttccaggcacaagatgcaagttggtggttgatctaccattctggggtctaccattctggggtctaccgttctgggactgtggccttcttctcacagctccactaggcagtgccccaacagggactctgtgtgggggctctgccccacatttcccttccacactgccctaggagaggttccccatgagggctctgcccctgcagcaaacttttgcctggacatccaggtgtttccatatatattctgaaatctaggcagaggttcccaaatctcaattcttgacatctctgcacccacaggctcaacatcacatggaagctgccaatgcttggggcctctaccctctgaagccacagcccaagctctatgttggctcctttcagccatggctggagcagctgggacacagggcaccaagtccctaggctgcacacagcacagagaccctgggcccagcccacaaaaccactttttcctcctgggcctctgggcctgtgatgggaggggctgccatgaaggtctctgacatgacctggagacattttccccatggtcttggggattaacattaggctccttgctgcttatgcaaatttctgcagccagcttgaatttctccttaaaaaaaatgggtttttcttttctactgcatcatcaggctgcagattttccacatttatgctcttgtttcccttttaaaacagaatgtttttaacagcacccaagtcaccttttgaatgctttgctgcttagaaatttattccaccagataccctaagtcatctctctcaagctctaagttccacaaatctctagggcaagggtgaaatgctgccagtctccttgctaaaacataacaagggtcacctttacttcagttcccaacaaggtcttcatctccatctgagaccacctcagcctggaccttattgttcatatcactatcagtatttttgtcaatgccattcacagtctctaggaggttccaaactttcctacattttcctatcttcttctgagccctccagattatttcaacacccagttccaaagttgcttccacattttcgggtatcttttcagcaatgccccactctactggtactattagtccattttcatgctgctgataaagacatacctgagactgggaacaaaaagaggtttaattggacttatagttccacctggctggggaggcctcagaatcatggcaggaggtgaaaggcatttcttacacggcagcagcaagagaaaaatgaagaagcagcaaaagcagaaacccctgataaaaccatcagatctcgtgagacttattcactatcacaagaatagcatgggaaagaccagcccccttgattcaattacctccccctgggtcctgtgggaattctggaaggtacaattcaagttgagatttgggtggggacacagccaaaccatatcaatgattttgtactttaaccagctgaatggaagtacaatctcttgctatatgacacaataattatttgcaaaatgagtaaacatatcataaggaaattatttttacaaggtttgaaacctgaaatgcagtctattatcatacataactaaaaatagagcctcaataaacagattcccagttttgaaaatgcaacatttgtactccacattgtcagttttcttaggtatatttataaatactcctataaaaatgtaaagaaacacataatgtagattgctaattttataataacacaagttgattttgacatccaacttattaattatgaaatgacttttggcctagtaacaatgaaaatgggggcaaatacagataaatggtaattcttagaatgaactactcagcaccaattctaagtttttcttgatggtaaatcataatgttccctttctcctcggttctgcaatctataggcataccataattgtaatcaatagcttaaaaatatgtctctctgtcctattctgtatctgtatctcttggatttttacctttgcaatagtcaactgaaccatcttcttggagtactcatgaagatggaagtctacatggagaatacaggatgaatccactctgtctcctgcagtgaagtctgtttgaaggatgtatttggctgtcttctggacaggccattctaataacagaaacaaacaagttattttaaaacttattggaatattcaaatattaaccaaagtagaaaaatataatacacatccatgtgcccatcacagaacttcactgattatcatcatttagccagtcttgaagaagcaagtgctaattacaatcacaaatgaaacaagattcagacttcatgaagagcactgcgctataataaaagaagaaatgagcacatacattcttttactgacagtcaaatggtgaaggtgggcagaatcattatgtgatgcaacatggcaaaagtatacagacagtgcatccagaggaaggcaccttgctgaatgactagaatggaagtaggagacattttgcaggcccccttcatcctgcagggagaaccagaaccacagcagctctatttgcctattcctctttaaattacaaagttaaaatttgggagtagtagaaaatcaattggttatcttatagagtctcctagaatatttcattggcattgagaaggtggaaaatgcaaattatatactttaaaatgtaatttttgcttttcacatatgcttaaagcctaaaacctcttaataaacttcttctgaaatata

SEQ ID NO: 5467 - DNA, 1431 bp, Homo sapiens
ccgtgaagtgggcggagcgagcgatttgaacgcgagcggcgcggacttctgccaagcaccggctcatgtgaggctcgcggcacagcgttctctgggctccccagaagccagcctttcgctcccggacccggcagcccgagcaggagccgtgggaccgggcgccagcaccctctgcggcgtgtcatgggcccgcgccgccggagccgaaagcccgaggccccgaggaggcgcagcccgagcccgaccccgacccccggcccctcccggcggggcccctccttaggcgcttcctcccatcaacacagtcggcggagacaaggttggctaaaggagatccgaaagcttcagaagagcacacacctcttgataaggaagctgcccttcagccgcctggcaagagaaatatgtgttaaattcactcgtggtgtggacttcaattggcaagcccaggccctattggccctacaagaggcagcagaagcatttctagttcatctctttgaggacgcctatctcctcaccttacatgcaggccgagttactctcttcccaaaggatgtgcaactggcccggaggatccggggccttgaggagggactcggctgagctcctgcacccagtgtttctgtcagtctttcctgctcagccaggggggatgataccggggactctccagagccatgactagatccaatggattctgcgatgctgtctggactttgctgtctctgaacagtatgtgtgtgttgctttaaatatttttcttttttttgagaaggagaagactgcatgactttcctctgtaacagaggtaatatatgagacaatcaacaccgttccaaaggcctgaaaataattttcagataaagagactccaaggttgactttagtttgtgagttactcatgtgactatttgaggattttgaaaacatcagatttgctgtggtatgggagaaaaggctatgtacttattattttagctctttctgtaatatttacattttttaccatatgtacatttgtacttttattttacacataagggaaaaaataagaccactttgagcagttgcctggaaggctgggcatttccatcatatagacctctgcccttcagagtagcctcaccattagtggcagcatcatgtaactgagtggactgtgcttgtcaacggatgtgtagcttttcagaaacttaattggggatgaatagaaaacctgtaagctttgatgttctggttacttctagtaaattcctgtcaaaatcaattcagaaattctaacttggagaatttaacattttactcttgtaaatcatagaagatgtatcataacagttcagaattttaaagtacattttcgatgcttttatgggtatttttgtagtttctttgtagagagataataaaaatcaaaatatttaatgaaaa

SEQ ID NO: 5468 - DNA, 8630 bp, Homo sapiens
taaatttaaaggcggggcggcctgtgagccctgaagtgccggccgcggagggtcctggccattttcctgggaccagttcagcctgataggatggcggaggaaggagccgtggccgtctgcgtgcgagtgcggccgctgaacagcagagaagaatcacttggagaaactgcccaagtttactggaaaactgacaataatgtcatttatcaagttgatggaagtaaatccttcaattttgatcgtgtctttcatggtaatgaaactaccaaaaatgtgtatgaagaaatagcagcaccaatcatcgattctgccatacaaggctacaatggtactatatttgcctatggacagactgcttcaggaaaaacatataccatgatgggttcagaagatcatttgggagttatacccagggcaattcatgacattttccaaaaaattaagaagtttcctgatagggaatttctcttacgtgtatcttacatggaaatatacaatgaaaccattacagatttactctgtggcactcaaaaaatgaaacctttaattattcgagaagatgtcaataggaatgtgtatgttgctgatctcacagaagaagttgtatatacatcagaaatggctttgaaatggattacaaagggagaaaagagcaggcattatggagaaacaaaaatgaatcaaagaagcagtcgttctcataccatctttaggatgattttggaaagcagagagaagggtgaaccttctaattgtgaaggatctgttaaggtatcccatttgaatttggttgatcttgcaggcagtgaaagagctgctcaaacaggcgctgcaggtgtgcggctcaaggaaggctgtaatataaatcgaagcttatttattttgggacaagtgatcaagaaacttagtgatggacaagttggtggtttcataaattatcgagatagcaagttaacacgaattctccagaattccttgggaggaaatgcaaagacacgtattatctgcacaattactccagtatcttttgatgaaacacttactgctctccagtttgccagtactgctaaatatatgaagaatactccttatgttaatgaggtatcaactgatgaagctctcctgaaaaggtatagaaaagaaataatggatcttaaaaaacaattagaggaggtttctttagagacgcgggctcaggcaatggaaaaagaccaattggcccaacttttggaagaaaaagatttgcttcagaaagtacagaatgagaaaattgaaaacttaacacggatgctggtgacctcttcttccctcacgttgcaacaggaattaaaggctaaaagaaaacgaagagttacttggtgccttggcaaaattaacaaaatgaagaactcaaactatgcagatcaatttaatataccaacaaatataacaacaaaaacacataagctttctataaatttattacgagaaattgatgaatctgtctgttcagagtctgatgttttcagtaacactcttgatacattaagtgagatagaatggaatccagcaacaaagctactaaatcaggagaatatagaaagtgagttgaactcacttcgtgctgactatgataatctggtattagactatgaacaactacgaacagaaaaagaagaaatggaattgaaattaaaagaaaagaatgatttggatgaatttgaggctctagaaagaaaaactaaaaaagatcaagagatgcaactaattcatgaaatttcgaacttaaagaatttagttaagcatgcagaagtatataatcaagatcttgagaatgaactcagttcaaaagtagagctgcttagagaaaaggaagaccagattaagaagctacaggaatacatagactctcaaaagctagaaaatataaaaatggacttgtcatactcattggaaagcattgaagacccaaaacaaatgaagcagactctgtttgatgctgaaactgtagcccttgatgccaagagagaatcagcctttcttagaagtgaaaatctggagctgaaggagaaaatgaaagaacttgcaactacatacaagcaaatggaaaatgatattcagttatatcaaagccagttggaggcaaaaaagaaaatgcaagttgatctggagaaagaattacaatctgcttttaatgagataacaaaactcacctcccttatagatggcaaagttccaaaagatttgctctgtaatttggaattggaaggaaagattactgatcttcagaaagaactaaataaagaagttgaagaaaatgaagctttgcgggaagaagtcattttgctttcagaattgaaatctttaccttctgaagtagaaaggctgaggaaagagatacaagacaaatctgaagagctccatataataacatcagaaaaagataaattgttttctgaagtagttcataaggagagtagagttcaaggtttacttgaagaaattgggaaaacaaaagatgacctagcaactacacagtcgaattataaaagcactgatcaagaattccaaaatttcaaaacccttcatatggactttgagcaaaagtataagatggtccttgaggagaatgagagaatgaatcaggaaatagttaatctctctaaagaagcccaaaaatttgattcgagtttgggtgctttgaagaccgagctttcttacaagacccaagaacttcaggagaaaacacgtgaggttcaagaaagactaaatgagatggaacagctgaaggaacaattagaaaatagagattctacgctgcaaactgtagaaagggagaaaacactgattactgagaaactgcagcaaactttagaagaagtaaaaactttaactcaagaaaaagatgatctaaaacaactccaagaaagcttgcaaattgagagggaccaactcaaaagtgatattcacgatactgttaacatgaatatagatactcaagaacaattacgaaatgctcttgagtctctgaaacaacatcaagaaacaattaatacactaaaatcgaaaatttctgaggaagtttccaggaatttgcatatggaggaaaatacaggagaaactaaagatgaatttcagcaaaagatggttggcatagataaaaaacaggatttggaagctaaaaatacccaaacactaactgcagatgttaaggataatgagataattgagcaacaaaggaagatattttctttaatacaggagaaaaatgaactccaacaaatgttagagagtgttatagcagaaaaggaacaattgaagactgacctaaaggaaaatattgaaatgaccattgaaaaccaggaagaattaagacttcttggggatgaacttaaaaagcaacaagagatagttgcacaagaaaagaaccatgccataaagaaagaaggagagctttctaggacctgtgacagactggcagaagttgaagaaaaactaaaggaaaagagccagcaactccaagaaaaacagcaacaacttcttaatgtacaagaagagatgagtgagatgcagaaaaagattaatgaaatagagaatttaaagaatgaattaaagaacaaagaattgacattggaacatatggaaacagagaggcttgagttggctcagaaacttaatgaaaattatgaggaagtgaaatctataaccaaagaaagaaaagttctaaaggaattacagaagtcatttgaaacagagagagaccaccttagaggatatataagagaaattgaagctacaggcctacaaaccaaagaagaactaaaaattgctcatattcacctaaaagaacaccaagaaactattgatgaactaagaagaagcgtatctgagaagacagctcaaataataaatactcaggacttagaaaaatcccataccaaattacaagaagagatcccagtgcttcatgaggaacaagagttactgcctaatgtgaaagaagtcagtgagactcaggaaacaatgaatgaactggagttattaacagaacagtccacaaccaaggactcaacaacactggcaagaatagaaatggaaaggctcaggttgaatgaaaaatttcaagaaagtcaggaagagataaaatctctaaccaaggaaagagacaaccttaaaacgataaaagaagcccttgaagttaaacatgaccagctgaaagaacatattagagaaactttggctaaaatccaggagtctcaaagcaaacaagaacagtccttaaatatgaaagaaaaagacaatgaaactaccaaaatcgtgagtgagatggagcaattcaaacccaaagattcagcactactaaggatagaaatagaaatgctcggattgtccaaaagacttcaagaaagtcatgatgaaatgaaatctgtagctaaggagaaagatgacctacagaggctgcaagaagttcttcaatctgaaagtgaccagctcaaagaaaacataaaagaaattgtagctaaacacctggaaactgaagaggaacttaaagttgctcattgttgcctgaaagaacaagaggaaactattaatgagttaagagtgaatctttcagagaaggaaactgaaatatcaaccattcaaaagcagttagaagcaatcaatgataaattacagaacaagatccaagagatttatgagaaagaggaacaatttaatataaaacaaattagtgaggttcaggaaaaagtgaatgaactgaaacaattcaaggagcatcgcaaagccaaggattcagcactacaaagtatagaaagtaagatgctcgagttgaccaacagacttcaagaaagtcaagaagaaatacaaattatgattaaggaaaaagaggaaatgaaaagagtacaggaggcccttcagatagagagagaccaactgaaagaaaacactaaagaaattgtagctaaaatgaaagaatctcaagaaaaagaatatcagtttcttaagatgacagctgtcaatgagactcaggagaaaatgtgtgaaatagaacacttgaaggagcaatttgagacccagaagttaaacctggaaaacatagaaacggagaatataaggttgactcagatactacatgaaaaccttgaagaaatgagatctgtaacaaaagaaagagatgaccttaggagtgtggaggagactctcaaagtagagagagaccagctcaaggaaaaccttagagaaactataactagagacctagaaaaacaagaggagctaaaaattgttcacatgcatctgaaggagcaccaagaaactattgataaactaagagggattgtttcagagaaaacaaatgaaatatcaaatatgcaaaaggacttagaacactcaaatgatgccttaaaagcacaggatctgaaaatacaagaggaactaagaattgctcacatgcatctgaaagagcagcaggaaactattgacaaactcagaggaattgtttctgagaagacagataaactatcaaatatgcaaaaagatttagaaaattcaaatgctaaattacaagaaaagattcaagaacttaaggcaaatgaacatcaacttattacgttaaaaaaagatgtcaatgagacacagaaaaaagtgtctgaaatggagcaactaaagaaacaaataaaagaccaaagcttaactctgagtaaattagaaatagagaatttaaatttggctcagaaacttcatgaaaaccttgaagaaatgaaatctgtaatgaaagaaagagataatctaagaagagtagaggagacactcaaactggagagagaccaactcaaggaaagcctgcaagaaaccaaagctagagatctggaaatacaacaggaactaaaaactgctcgtatgctatcaaaagaacacaaagaaactgttgataaacttagagaaaaaatttcagaaaagacaattcaaatttcagacattcaaaaggatttagataaatcaaaagatgaattacagaaaaagatccaagaacttcagaaaaaagaacttcaactgcttagagtgaaagaagatgtcaatatgagtcataaaaaaattaatgaaatggaacagttgaagaagcaatttgaggcccaaaacttatctatgcaaagtgtgagaatggataacttccagttgactaagaaacttcatgaaagccttgaagaaataagaattgtagctaaagaaagagatgagctaaggaggataaaagaatctctcaaaatggaaagggaccaattcatagcaaccttaagggaaatgatagctagagaccgacagaaccaccaagtaaaacctgaaaaaaggttactaagtgatggacaacagcaccttacggaaagcctgagagaaaagtgctctagaataaaagagcttttgaagagatactcagagatggatgatcattatgagtgcttgaatagattgtctcttgacttggagaaggaaattgaattccaaaaagagctttcaatgagagttaaagcaaacctctcacttccctatttacaaaccaaacacattgaaaaactttttactgcaaaccagagatgctccatggaattccacagaatcatgaagaaactgaagtatgtgttaagctatgttacaaaaataaaagaagaacaacatgaatccatcaataaatttgaaatggattttattgatgaagtggaaaagcaaaaggaattgctaattaaaatacagcaccttcaacaagattgtgatgtaccatccagagaattaagggatctcaaattgaaccagaatatggatctacatattgaggaaattctcaaagatttctcagaaagtgagttccctagcataaagactgaatttcaacaagtactaagtaataggaaagaaatgacacagtttttggaagagtggttaaatactcgttttgatatagaaaagcttaaaaatggcatccagaaagaaaatgataggatttgtcaagtgaataacttctttaataacagaataattgccataatgaatgaatcaacagagtttgaggaaagaagtgctaccatatccaaagagtgggaacaggacctgaaatcactgaaagagaaaaatgaaaaactatttaaaaactaccaaacattgaagacttccttggcatctggtgcccaggttaatcctaccacacaagacaataagaatcctcatgttacatcaagagctacacagttaaccacagagaaaattcgagagctggaaaattcactgcatgaagctaaagaaagtgctatgcataaggaaagcaagattataaagatgcagaaagaacttgaggtgactaatgacataatagcaaaacttcaagccaaagttcatgaatcaaataaatgccttgaaaaaacaaaagagacaattcaagtacttcaggacaaagttgctttaggagctaagccatataaagaagaaattgaagatctcaaaatgaagcttgtgaaaatagacctagagaaaatgaaaaatgccaaagaatttgaaaaggaaatcagtgctacaaaagccactgtagaatatcaaaaggaagttataaggctattgagagaaaatctcagaagaagtcaacaggcccaagatacctcagtgatatcagaacatactgatcctcagccttcaaataaacccttaacttgtggaggtggcagcggcattgtacaaaacacaaaagctcttattttgaaaagtgaacatataaggctagaaaaagaaatttctaagttaaagcagcaaaatgaacagctaataaaacaaaagaatgaattgttaagcaataatcagcatctttccaatgaggtcaaaacttggaaggaaagaacccttaaaagagaggctcacaaacaagtaacttgtgagaattctccaaagtctcctaaagtgactggaacagcttctaaaaagaaacaaattacaccctctcaatgcaaggaacggaatttacaagatcctgtgccaaaggaatcaccaaaatcttgtttttttgatagccgatcaaagtctttaccatcacctcatccagttcgctattttgataactcaagtttaggcctttgtccagaggtgcaaaatgcaggagcagagagtgtggattctcagccaggtccttggcacgcctcctcaggcaaggatgtgcctgagtgcaaaactcagtagactcctctttgtcacttctctggagatccagcattccttatttggaaatgactttgtttatgtgtctatccctggtaatgatgttgtagtgcagcttaatttcaattcagtctttactttgccactagagttgaaagataagggaacaggaaatgaatgcattgtggtaatttagaatggtgatagcaataccttcttcttgcatatggtaatacttttaaaagttgaattgttttatttatttgtatattttgtaaagaataaagttattgaaagaaatgtaaagttatctacatgacttagcatattccaaagcataatacatacattaatataaaacatcattttattaacaaaattgtaaatgtttttaataccttacacattcaataaatgtttagtagttctgaatcaccaaaaaaaaaaaaaaaaaa

SEQ ID NO: 5469 - DNA, 627 bp, Homo sapiens
agtctccggcgagttgttgcctgggctggacgtggttttgtctgctgcgcccgctcttcgcgctctcgtttcattttctgcagcgcgccacgaggatggcccacaagcagatctactactcggacaagtacttcgacgaacactacgagtaccggcatgttatgttacccagagaactttccaaacaagtacctaaaactcatctgatgtctgaagaggagtggaggagacttggtgtccaacagagtctaggctgggttcattacatgattcatgagccagaaccacatattcttctctttagacgacctcttccaaaagatcaacaaaaatgaagtttatctggggatcgtcaaatctttttcaaatttaatgtatatgtgtatataaggtagtattcagtgaatacttgagaaatgtacaaatctttcatccatacctgtgcatgagctgtattcttcacagcaacagagctcagttaaatgcaactgcaagtaggttactgtaagatgtttaagataaaagttcttccagtcagtttttctcttaagtgcctgtttgagtttactgaaacagtttacttttgttcaataaagtttgtatgttgcatttaaaaaaaaaaaaaaa

SEQ ID NO: 5470 - DNA, 691 bp, Homo sapiens
gacccctcacactcacctagccaccatggacatcgccatccaccacccctggatccgccgccccttctttcctttccactcccccagccgcctctttgaccagttcttcggagagcacctgttggagtctgatcttttcccgacgtctacttccctgagtcccttctaccttcggccaccctccttcctgcgggcacccagctggtttgacactggactctcagagatgcgcctggagaaggacaggttctctgtcaacctggatgtgaagcacttctccccagaggaactcaaagttaaggtgttgggagatgtgattgaggtgcatggaaaacatgaagagcgccaggatgaacatggtttcatctccagggagttccacaggaaataccggatcccagctgatgtagaccctctcaccattacttcatccctgtcatctgatggggtcctcactgtgaatggaccaaggaaacaggtctctggccctgagcgcaccattcccatcacccgtgaagagaagcctgctgtcaccgcagcccccaagaaatagatgccctttcttgaattgcattttttaaaacaagaaagtttccccaccagtgaatgaaagtcttgtgactagtgctgaagcttattaatgctaagggcaggcccaaattatcaagctaataaaatatcattcagcaac

SEQ ID NO: 5471 - DNA, 3163 bp, Homo sapiens
ctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactgatacccggaaggacgagcaggagcgttgcatcaccatcaagtcaactgccatctccctcttctacgagctctcggagaatgacttgaacttcatcaagcagagcaaggacggtgccggcttcctcatcaacctcattgactcccccgggcatgtcgacttctcctcggaggtgactgctgccctccgagtcaccgatggcgcattggtggtggtggactgcgtgtcaggcgtgtgcgtgcagacggagacagtgctgcggcaggccattgccgagcgcatcaagcctgtgctgatgatgaacaagatggaccgcgccctgctggagctgcagctggagcccgaggagctctaccagactttccagcgcatcgtggagaacgtgaacgtcatcatctccacctacggcgagggcgagagcggccccatgggcaacatcatgatcgatcctgtcctcggtaccgtgggctttgggtctggcctccacgggtgggccttcaccctgaagcagtttgccgagatgtatgtggccaagttcgccgccaagggggagggccagttggggcctgccgagcgggccaagaaagtagaggacatgatgaagaagctgtggggtgacaggtactttgacccagccaacggcaagttcagcaagtcagccaccagccccgaagggaagaagctgccacgcaccttctgccagctgatcctggaccccatcttcaaggtgtttgatgcgatcatgaatttcaagaaagaggagacagcaaaactgatagagaaactggacatcaaactggacagcgaggacaaggacaaagaaggcaaacccctgctgaaggctgtgatgcgccgctggctgcctgccggagacgccttgttgcagatgatcaccatccacctgccctcccctgtgacggcccagaagtaccgctgcgagctcctgtacgaggggcccccggacgacgaggctgccatgggcattaaaagctgtgaccccaaaggccctcttatgatgtatatttccaaaatggtgccaacctccgacaaaggtcggttctacgcctttggacgagtcttctcggggctggtctccactggcctgaaggtcaggatcatggggcccaactatacccctgggaagaaggaggacctctacctgaagccaatccagagaacaatcttgatgatgggccgctacgtggagcccatcgaggatgtgccttgtgggaacattgtgggcctcgtgggcgtggaccagttcctggtgaagacgggcaccatcaccaccttcgagcacgcgcacaacatgcgggtgatgaagttcagcgtcagccctgttgtcagagtggccgtggaggccaagaacccggctgacctgcccaagctggtggaggggctgaagcggctggccaagtccgaccccatggtgcagtgcatcatcgaggagtcgggagagcatatcatcgcgggcgccggcgagctgcacctggagatctgcctgaaggacctggaggaggaccacgcctgcatccccatcaagaaatctgacccggtcgtctcgtaccgcgagacggtcagtgaagagtcgaacgtgctctgcctctccaagtcccccaacaagcacaaccggctgtacatgaaggcgcggcccttccccgacggcctggccgaggacatcgataaaggcgaggtgtccgcccgtcaggagctcaagcagcgggcgcgctacctggccgagaagtacgagtgggacgtggctgaggcccgcaagatctggtgctttgggcccgacggcaccggccccaacatcctcaccgacatcaccaagggtgtgcagtacctcaacgagatcaaggacagtgtggtggccggcttccagtgggccaccaaggagggcgcactgtgtgaggagaacatgcggggtgtgcgcttcgacgtccacgacgtcaccctgcacgccgacgccatccaccgcggagggggccagatcatccccacagcacggcgctgcctctatgccagtgtgctgaccgcccagccacgcctcatggagcccatctaccttgtggagatccagtgtccagagcaggtggtcggtggcatctacggggttttgaacaggaagcggggccacgtgttcgaggagtcccaggtggccggcacccccatgtttgtggtcaaggcctatctgcccgtcaacgagtcctttggcttcaccgctgacctgaggtccaacacgggcggccaggcgttcccccagtgtgtgtttgaccactggcagatcctgcccggagaccccttcgacaacagcagccgccccagccaggtggtggcggagacccgcaagcgcaagggcctgaaagaaggcatccctgccctggacaacttcctggacaaattgtaggcggcccttcctgcagcgcctgccgccccggggactcgcagcacccacagcaccacgtcctcgaattctcagacgacacctggagactgtcccgacacagcgacgctcccctgagaggtttctggggcccgctgcgtgccatcactcaaccataacacttgatgccgtttctttcaatatttatttccagagtccggaggcagcagacacgccctcttagtagggacttaatgggccggtcggggagggggaggcgggatgggacacccaacactttttccatttcttcagagggaaactcagatgtccaaactaattttaacaaacgcattaagaggtttatttgggtacatggcccgcagtggcttttgccccagaaaggggaaaggaacacgcgggtagatgatttctagcaggcaggaagtcctgtgcggtgtcaccatgagcacctccagctgtactagtgccattggaataataaatttgataaggtggtgaaaaaa

SEQ ID NO: 5472 - DNA, 3318 bp, Homo sapiens
ggaggccgagctcggctgggcttggcgaggctgcggcgcggccaccggcgggagtgcagcggccactgtacccagagattcaaaaccccaaacccgggacttgggggcgctgagccgggccgggaagcagagcctggtcgtgaggaacagccgcccgttgctgtctgcccctttgcggacagcgtctccctcgactccgcttaggaagtggtgggggcggcgtggcccccgtcgggaggcgttcgaacgcccgctaggagagagaaaggattcccctgtgcttggagcccgcactcgggcgcggagggagcggcggcaggctctcgctttcggcaccatgggctgcacgctgagcgccgaggacaaggcggcggtggagcggagtaagatgatcgaccgcaacctccgtgaggacggcgagaaggcggcgcgcgaggtcaagctgctgctgctcggtgctggtgaatctggtaaaagtacaattgtgaagcagatgaaaattatccatgaagctggttattcagaagaggagtgtaaacaatacaaagcagtggtctacagtaacaccatccagtcaattattgctatcattagggctatggggaggttgaagatagactttggtgactcagcccgggcggatgatgcacgccaactctttgtgctagctggagctgctgaagaaggctttatgactgcagaacttgctggagttataaagagattgtggaaagatagtggtgtacaagcctgtttcaacagatcccgagagtaccagcttaatgattctgcagcatactatttgaatgacttggacagaatagctcaaccaaattacatcccgactcaacaagatgttctcagaactagagtgaaaactacaggaattgttgaaacccattttactttcaaagatcttcattttaaaatgtttgatgtgggaggtcagagatctgagcggaagaagtggattcattgcttcgaaggagtgacggcgatcatcttctgtgtagcactgagtgactacgacctggttctagctgaagatgaagaaatgaaccgaatgcatgaaagcatgaaattgtttgacagcatatgtaacaacaagtggtttacagatacatccattatactttttctaaacaagaaggatctctttgaagaaaaaatcaaaaagagccctctcactatatgctatccagaatatgcaggatcaaacacatatgaagaggcagctgcatatattcaatgtcagtttgaagacctcaataaaagaaaggacacaaaggaaatatacacccacttcacatgtgccacagatactaagaatgtgcagtttgtttttgatgctgtaacagatgtcatcataaaaaataatctaaaagattgtggtctcttttaagttttgcagttcatggtaaaatgcattttcaaaccaaatgagtacttatatatggatctctgtagactagagtcttgcagcaacacagaatgtaatataaggcaaatgcatctgggacttgaccaaagttgttctgttttgtttttttaactgaaagtaacagaaggacctttcttaaatgtgacagatggtcctgcagtgtgaaactgaaggacagtgttaaagctgggctctagtatattgatgatttctgcataagtgtaaatatgcaaatgtatgtatacatgtatttatgactttagttttcgacattatttttaggttttaagagtggcaacttaggattttagggtgatggctttggaaataacataaatataccttgtactgaatgacagactattactacgtttgccagttttaaacagctttatttatgttcatgtcctgtaaatttttaagtacagtaattaatattaggaaacattacagcccttatctagattatatgtatacttgtattaataaaaatgttatttgtacaaacattgcacagactattttaataacatgatttgttctttaaattttatgtgttttattgaaatgttcttaagatgaatacacctgcctttggatcaactatttaaacattgtatgcattttgatttttcctactttaagaaaataaaataatttaattttacattagattccacgttagatttggtttgaaaaactaaaatttcagatttctgaggatatactgtcttagacttattgtacacacttagtttttattcacttgttttcactctgaattttaatatttggctgatatgaatgcattgcctcaaaggtgatgtcatcttaatttttattcactttaaataactacatttttgtttataactaagtttggagggatcctaagagcatttttgtgggtaaaaaaaaaacctgtggacataatgaattttgagacattgattggtgaggcttttatttcccttgaggagtctcttgtacctagcatacatgatagctccttgttgggaagataacaagaaggatctttgaatactctattgctgatataatgcaagatttaaatttatacatataactaatttcaaatgtaattatcacactatgttaaaattacttttttcccttagataattcaaatttctccacttgcttgagattatatcatttctttttcaattatactattatttctgagaatgaaatggacgattacacttagaaaatgagtaatagtgtttaataagtcagtgattatatgtgtgctcaaataagtgttatgtatcagctagatactgagctttgatagaataattttcttttgattattcatgatgtgtcatctctgaccttgtttcagcaaagtaaacagcactccccaccccaccctcctttttttactcatcttggaaaaggttagtctttcagtacacgttgctggtaagtagtttccaagttacgtgttgtcactgggttgaagtatatttgtgtgtgtgtgtgtgtgtgtgtgtgtgtgtgtaaccataaactatattcatatctgtttcatttggaggattttcttctttgtaatgtaaagaaattcaaagttatcaaagttccttaaatgtgttagtttagattctttatgtgcctttcatgaaagatatgttttcattaattttactggtggacctgtaatatccacattgtgaagctgtgtatgaaattcaactataatatgaataaatttgaatcatgagaattatgggttaaaaagccacaaagaagcacatattggtgaccatcattaatgaaatcctgaactttattctgtgtaattgtgttaataaatcctaataaatttaaatttttaaaattttacaaac

SEQ ID NO: 5473 - DNA, 1075 bp, Homo sapiens
gagcccctcccctcggcccgcgcgggaggagtgtgacccaggtgccgcttcctctcgccgccgagggtcaggagcccgggagcgcgaccctcccccggcccggcctggcccggcctggccagtccccgcggtctctgcccgggctgacgcccaggaatgtggtcgacgagaagccccaacagcacggcgtggcctctcagcctcgagcctgatccggggatggcctctgcctccaccacaatgcatactaccaccattgcagagcctgatccagggatgtctggatggccggatggcagaatggagacctccacccccaccataatggacattgtcgtcattgcaggtgtgattgctgctgtggccatcgtcctagtctccctcctcttcgtcatgctgcgctacatgtaccggcacaagggcacgtaccacaccaatgaggccaagggcacggagtttgctgagagtgcagatgcagccctgcagggagaccctgccctccaagatgctggtgatagcagcagaaaggagtactttatttgagggacaacagacttcacttccctgaatgcctcccccatctccatcaggaaaaatacaccccatcgcccagcacccctgctgataccaccagacagagagagagagcacttgattcttcccgagatagccacctggaaacactaggtgcctgcccagggaggaacggaggaggactcgcgctacaagaggccactcccagggacccagggaggcgatggccaccccagaggccaccttttgctccacggaggtgggagaaaatctgggcacatggggccccctgggcagtgcaggacaacatcagctcactggcaggaaagtccttgttgagggtgagggggtgctggggtacccgggggctggggaagcaaggaaataagtcatctgtatgctgactggggataatggcatcaaatgtcagtccttgacatttggggggaacagcaggtgccagagctaaaaggtacctttgtctgccattgatccagctcagaacgattggaaataaatttgaaatgtaaccgagcaaaaa

SEQ ID NO: 5474 - DNA, 12568 bp, Homo sapiens
cttccagctcccgccgggcggctgtgacggccgcagcgggtcgcagagcagggagtggacacggagtggggagcggagagggaaggaggaggaggaggagcaaaggtgttggagagaaaacttcagaaaggaacaggaaacctgccggggaggcggcggcggctgcggcttctctgggcgcctgggctgcgctcttcgcggggtgtccgcagctgcggcttggccccggtctggcttccccggcgcgcacgcacggctgagccgcgacgctcagtggctcgggccgtgccctccgccgcggctcttggccgctgtagtcccgcgatccgatccgcttctgccgcggcggctccctggagagagggcggcgagggcgcagggaagaagagggacgtccactgtggaacatgaagcagcatgactgagaaaatgtccagcttcctctacataggggacatcgtgtccctgtacgcggagggctcggtcaacggcttcatcagcaccttggggttagtggatgacagatgtgtggtgcacccagaggccggggaccttgccaaccctcccaagaagttcagagactgccttttcaaggtgtgccctatgaacagatattctgcccagaagcaatattggaaagcaaagcaagccaaacaagggaaccacaccgaggcagccttgctgaagaaactacagcacgctgcagaactggaacaaaaacaaaatgaatcggagaataagaaactgttgggagaaattgtaaaatacagtaatgttatacaactactgcatataaaaagcaacaaatatcttactgtcaacaagagattacctgctttactggagaagaatgccatgcgtgtgtccttggatgctgcaggaaatgaagggtcttggttttatattcatccgttctggaaactgagaagcgagggtgacaatattgttgtaggagataaagttgttttgatgcctgtgaatgcagggcagccactacatgccagcaacatagagcttcttgataacccagggtgtaaagaggtgaatgctgtcaattgcaacaccagctggaaaatcactttattcatgaaatatagttcctatcgagaggatgtattaaaaggaggggacgttgttagattatttcatgcggaacaagagaagtttttgacttgtgatgaatatgagaaaaaacagcacattttccttcgtacgaccttgcgccaatcagctacttctgctactagttctaaagcactctgggaaatagaggtggttcatcatgacccatgccgtgggggtgcaggacagtggaacagcttgttcagatttaagcatcttgcaactggaaactatttagctgcagagcttaatcctgattatcgagatgcccaaaatgaaggaaaaaatgtgagagatggagtccctccaacttcaaagaaaaaacgccaggcaggggagaagatcatgtatactttggtttcagtcccgcatggcaatgacattgcatccctttttgaactagatgccacaactcttcagagagctgactgcctggttccaaggaactcatatgttcggttaaggcatttatgcaccaacacatgggtaaccagtactagtatccccatagacacagatgaagagaggcctgttatgttaaagattggaacctgccaaaccaaagaagataaagaagcgttcgcaatcgtgtctgttccactgtctgaagttcgagacttagactttgccaatgatgccaataaagtactagcgaccacagttaaaaagctagaaaacggcacaataactcagaatgaaaggaggtttgtaaccaaattattggaagatctcatattctttgttgctgatgtgcctaataatggacaagaagttctggatgtggttatcactaagccaaaccgagagcgtcaaaaattgatgagggaacaaaacatactggcacaggtatttggaattcttaaagcaccctttaaagagaaagcaggagaaggctcgatgctgagacttgaagatctgggggatcaaagatatgcaccctacaagtacatgctgcggctctgttaccgcgtcctgagacactcgcagcaggattaccggaaaaatcaggaatatattgctaagaatttctgtgtcatgcagtcccagattggctatgatattttggcagaagatactatcacagctttgttgcacaacaacagaaaactactagagaaacatatcacagcaaaagaaatagaaacatttgtcagtttactcaggagaaatcgggagccaaggtttttggattatttgtcagatctgtgtgtgtctaataccactgctatccctgtaactcaagaactcatctgtaaatttatgttgagtccaggcaatgcagacattctcattcaaactaaggtggtctcaatgcaagcagacaaccccatggagagctccatcctttcagatgacattgatgatgaagaagtttggctctattggattgacagcaacaaggaacctcatggcaaagctatcaggcaccttgctcaagaggcaaaagaaggcaccaaagctgacttagaagttcttacctattacaggtaccagctaaacctctttgcaaggatgtgcttggatcgccagtatctggccataaaccagatttctacacagctgtctgtagacctgatcctgcggtgtgtgtcggatgagagcctgccgttcgacctccgagcgtccttctgtcgcctcatgctccacatgcacgttgaccgggatccccaggagtccgtggtgcctgttcgctatgccaggctctggacagaaatccccacaaagatcacaattcatgaatatgattctataacagactcttccagaaatgatatgaagaggaaatttgccctgacaatggaatttgttgaagaatatttgaaagaagttgtaaaccagccctttccttttggggataaagaaaaaaataaactgacatttgaggtggtccacttggctcggaatcttatatactttggattttatagtttcagtgagttattaaggctaacaagaacacttctggctattttagacattgtacaggcccccatgtcatcatactttgaaagattaagcaaatttcaagatggaggaaacaatgtgatgagaaccattcatggggtgggagagatgatgacccagatggtactcagtagaggctccatcttccccatgagcgtgccggatgtgccacccagcatccacccgagcaagcaagggagccccaccgagcacgaggatgtgactgtgatggacaccaagctgaagatcattgagattttgcagtttatcctgagtgtcagactggattataggatctcatatatgctgtcaatatataagaaggagtttggagaggacaatgacaatgcggagacatctgccagtggatctccagacactttactaccatcagctattgttcctgatatagatgaaattgcagctcaggcagaaactatgtttgcgggaagaaaagaaaaaaatccagttcaacttgacgatgaaggaggcaggacgtttttacgggtcctcattcatctgatcatgcacgactacccgcctttgctgtctggagccctgcagctgttgtttaagcacttcagccagagggcagaggttttacaggcatttaagcaggtgcaattactggtgtctaatcaagacgtagataactacaagcaaatcaaggcagatctagaccagcttcgactgacagtagaaaagtctgagctatgggtggagaagagcagcaactatgagaatggagaaataggggaaagtcaagtgaaaggtggtgaagagccaattgaggaatcaaacattttaagtccagtgcaggatggaacaaagaaacctcagattgacagcaacaagagcaataactaccggattgtaaaggagattttgatcaggctaagtaaactctgtgtgcagaataaaaagtgtcggaatcaacatcaacgattactgaaaaatatgggggcgcattcggtggtgttggatcttctgcagataccctatgaaaagaatgatgaaaagatgaatgaagtaatgaatctagcccatacatttctgcagaatttctgtcgaggaaatccacagaatcaagttcttcttcataaacatctgaatttgtttttaactccaggtctccttgaagcagaaaccatgcggcacatcttcatgaacaattaccatctgtgcaacgaaattagcgagagagttgtacaacactttgtgcactgcattgagacacatggccgccacgtggagtacctgaggtttttgcaaacaattgtaaaagcagatggtaaatatgtgaagaaatgccaggatatggtaatgacagagttgataaatgggggtgaagacgtgctgatattttacaatgatagagcatcatttccaatccttctccatatgatgtgttcagagagagaccgaggggatgagagtggccccttagcctaccacatcaccctggtggagttgctggcagcatgcacagaggggaaaaatgtctacactgaaatcaagtgtaattcccttctcccgctggacgacatagtgagggtggtgacccatgacgactgcatccctgaggttaaaattgcttatgtgaactttgttaatcactgttatgttgacactgaagtggaaatgaaagaaatctatacaagtaaccacatttggaaattatttgagaacttcttggtggatatggcaagggtttgcaacacaactacagacaggaaacatgcagacatctttttggaaaagtgtgttactgagtcaataatgaatattgtgagcggcttctttaattctcccttttcagacaatagtaccagcctccagacacatcagccagtttttattcagctactgcaatctgccttcagaatttacaattgcacctggccaaacccagcgcagaaagcctcagtggaatcctgtatcagaactttggctgaagtggcaaaaaatcgtggaattgccattccagtggatttggacagccaagttaatactcttttcatgaagagccattcaaatatggtgcagagagcagcaatgggttggagactatcagctcgctctgggccacgctttaaggaagctcttggagggcctgcttgggattacagaaatattattgaaaagttacaggatgtagtggcctccttggagcaccagttcagcccaatgatgcaggctgaattctcagtgttggttgatgtattgtacagtccagaactgctgttccctgagggaagcgatgcaagaataagatgtggcgctttcatgtcgaagttgattaatcatacaaagaaactaatggagaaagaagaaaaactgtgcattaaaattcttcagacattacgagaaatgttagagaagaaagacagctttgtggaagagggtaacacattaagaaagatacttctgaatcgatactttaaaggtgattatagtattggtgtgaatggacacctatcaggagcctactccaaaactgcacaggtgggaggaagcttttctggacaagattcagataagatggggatatcaatgtcagacattcagtgtctgctggataaagaaggtgcatcagaacttgtcatcgatgttatagtgaacaccaaaaatgacagaattttttcagaaggcattttcctcggcattgccttgcttgaaggaggaaatacacaaacacagtattctttctaccagcagttgcatgaacaaaaaaagtcagaaaaattctttaaagttctctatgatcgaatgaaggctgctcagaaagaaataagatcaacagtgacagttaataccatagatttaggtaacaaaaaaagggacgatgacaatgaattgatgacatctggtccacgaatgagagtaagagattcaacactacatttaaaagagggaatgaaagggcaattaacagaagcttcttcagcaacatccaaagcatattgtgtatacagaagagaaatggatccagaaatagacattatgtgcacaggaccagaagcgggaaacactgaggaaaaatccgcagaggaagtaacaatgagtcccgcaattgccatcatgcagccaatactgagatttcttcagttactgtgtgagaatcacaaccgggaattgcagaacttcttgaggaatcaaaacaacaaaacaaattacaacctagtctgtgagacccttcagtttctggactgcatttgtggaagtacaaccggtggcctgggcctgttgggtctctacatcaatgagaagaatgtagcgctggtcaaccagaacctggagagcttgactgagtattgccagggcccttgccatgaaaatcagacctgtatcgctacacatgagtctaatgggattgatatcatcattgctttgattctgaatgacataaaccctcttggtaaataccgaatggacctggtgctccagctaaagaacaatgcatctaaacttttgctggccattatggaaagcagacatgacagtgagaatgcagaaagaattctttttaacatgagacccagagaactggtggatgtgatgaagaatgcctataaccaaggattggaatgtgaccatggggatgatgagggtggagatgatggtgtttctccaaaagatgttggacacaatatctatattctggcccatcagttggcccgccacaataaactgttgcagcagatgctcaaaccaggatcggatccagatgaaggagatgaagccttaaagtattatgccaaccacactgcacagattgagattgtccggcatgataggaccatggaacaaatagtttttcctgtccccaatatatgtgaatacctcactcgagaatccaagtgccgtgtgttcaatacaactgaaagggatgaacaaggaagtaaagtgaatgactttttccagcaaacagaagatctctacaatgaaatgaagtggcagaagaaaatcaggaataaccctgcactgttctggttctcgaggcacatctctctctgggggagcatttccttcaacctggctgtgttcatcaatttagctgttgctctcttctacccatttggggatgatggagatgaaggtacactttctccattgttctcggttcttctttggatagcagttgcgatctgcacatctatgctgtttttcttctccaagcctgtgggtattcggccgtttcttgtatcaataatgctcagatcaatatatacaataggtcttgggcctacattaatacttcttggtgcagctaatctttgtaataaaattgtttttctggtgagttttgttggaaatcgtggcacgttcacccgtgggtaccgagcagtcatcctggatatggcctttctctatcacgtggcgtatgtcctggtttgcatgctgggcctttttgtccatgaattcttctatagcttcctgctttttgatttggtgtacagggaagagactttgctgaatgtcataaaaagtgtcacacgaaatggccgctctattattctaactgcagtcctggctctcatcctcgtctacctgttttccattattgggttcctttttttgaaggatgacttcactatggaagttgataggctgaaaaaccgaactcctgttacaggcagtcatcaagtgcctactatgactttaactaccatgatggaagcatgtgccaaggagaactgttcacccacaattccagcttcaaatacagctgatgaagagtatgaagatggaattgaaaggacgtgtgacactctccttatgtgcattgtcaccgtgctgaaccagggcctcaggaatggcggtggtgtgggggatgtgctaagaaggccatcgaaagatgagcccttgtttgctgcccgagtggtttatgaccttcttttttatttcattgttatcattattgttctgaacttgatttttggtgttatcatcgatacttttgctgatctcagaagcgaaaaacagaaaaaagaagaaattctaaagacaacttgtttcatctgtggacttgagagagacaagtttgataataaaacggtttcatttgaggagcacattaagtcagaacacaatatgtggcattatttgtacttcatagtcctggtgaaagttaaagacccaacagaatacactggacctgaaagttatgtggctcaaatgattgtggagaagaatttggattggtttcctcggatgcgagccatgtccctcgttagcaatgaaggcgacagtgagcaaaatgaaattcggagccttcaggagaagttggaatcgaccatgagtctggtcaaacagctgtcgggtcagctggcggagctcaaggagcagatgacagaacaaaggaagaataagcagagactgggcttcctcggatcaaacacaccccatgtgaatcatcacatgccaccacactgataccatggggggaagccgtgactagcctttcatcagtgtcctgcctgatcactgaataaagaactgagatggaggggagtgaacagtgcctattgttgaaaagttaaaaacaaccaagtgccaagatgttgagtgggttagctccgagaacaatttataactgtgttttcatggttgcgaagacctaacctcaaatgcatctgctagaaagcgtacatcacacattcgcaatgcatcaggaagaaaaggcttgcccaaaaggctggagagggcagggagcggcaggatggaaggagacacggggcagggagaactctcttctgctaaatcgataggagtcagttttgtcttaaatgctgactacagccactgacatggttggctggaatttctttcttttaattgtggcatataggtttgtgacacaagaagtcatactttggtggctaagttttactaaggaaaataactgaaaagattaaaagtgagagctgaaaagagaaatgataatgcttccaaactgtagctgtcacagggcaatttctttatttataacatgaagcacaatggatttacagctctaggaacttagtactttggagcttttgcctctcacactgacaacataacaggatgtgattgccttctctgggattcagacaggctctgtcaatgtggagcacaaaaggagattttcatataacttgttaaaaacatgttctaagtcatgtataggctaagattttaagaagatctgggggaataaaaagccaacagtaagccccaggaaagggttttttgagaccatatgtatgctattaaaatatattgagattaatacatgaaaatgcttaaaagtgataggaattattgagaaacttatgatggtggcattgccttttataaacatggagtgaaagccatttgactcaacgtttgctgtgcttaaagaattgcttcaggacccgagcgtttttatgtatgctgttcctgcagttaggaaaaaaaaatccaagaaatgtattgaatactcaagaaaatgccacatttcaattacatatttaaaactgtatctgtaagggcttttcaaaatgtagcaagataaaaatctcttattcaaattgtttttgtattaaatcatgcactcagaatttgtcgagggagagaataacctggtgtgttcaggttattcttagagactacacatttggaatagcagagcaaaatatggataatgaaagtgttgggaaaaaagtgatgtgacagggagtgaagacacttgataccagactctgggagatactctgcaagttgacctggcctctcccccacaggaacaaaacactgcctccagagtctttaaattctcagttatcaacgccaaggtttaaggtctagatagggtttgctatagggtttgctctgacaatttttaaagcttttggattgttctaacatagcttaagctattggttcctaaaaatcccaaatcaagatctatgtagaatataaaggaagcctgaaccaatccttccacatactgttaagatgtagacttggaacaaagctgttgggacccagagcaatgaatttttgaactgaagctactggtactccccagcaccacctcatactaagaattcctcactctgacatgacagtattttttctgaccaggagctgaaagaccctgacattcatgatccaaagatataagaaattttgatatgtctgcatgcagcacagaactttgaacctaggaggcagtcaataaatacatgagaaattcagctgtcattcagttactcttaattctttataaaactttaaatgataccacatatttgtttgtttaaaatggctttcccaaaatcaaagtagactaaagcagccatctttaaaatccaggatcatcaatgctattaacagtatcaggtaaaaagtacactttaaaatattttaatcaggcagagttttatggatagagaatagaagagaaaggtagtaaatattgaacatattccaatataggaacctatctctgttttagtacaaaatatttctgacatctgaactagaggtcaagagaataaattcatttgtatacatctgagcaacctgtctttcagatgataaagtatctagccttttctgacaccataatagttcattttgtagggaataagccattaggtgtatataattgctttctagaaatgacctaatgtccccaaccactttgtagtggcagatcactgtttcacagcatattttctcccaaggaaagtattcaaaagagactgcaactaacaagactcttatttcatcaaaatttaaatatttctgagttgtatttttaatgcctctttcttttctgcctaaatgcttagaaattataaagcaaaaaaaaaaaaaacagcaacaaaaaatcgaagcagacaaaaaaggcacttttcagaacatcaaattcctaatgaagaagaggagaagataatggggaaatttgacatttgatataaatttatatttgttatgtgtatgtttgttaatgcaactggaatatttgacttaggtgagtatcagttaacatccttgtatttatatagtgacatcaaaataaatgcaatcatcttgaactttgatgttaagggagattttgaaaaaatatttagttatttcaaattcatattggttcaaaagtatcagtttctgctgaataatatttttaatttcaaaagggttttgttccctctgtgctccattctgaggctcaagagcttaatgccagtatgttttctgagttaaaataacacttttagatgagaaaatgcttgtatcatacagggctataatataaataaataaattgtatgtatgcaaaatttatcatattttctaccccttaaaaaattaagttagaaataagcttattttcttgcacatcaatatttttctgttggtaaagaggacacaatttctagtagattgttaataacatcaggaagatatttctttcgtcagaactaattgtgtgcttattcccatattctcagctcataactccctgttttggctgctctctttattttacaattgtttcattgcaaacagcaaggcagtatagcccacactcagccactagcccccagtccccaggactgagaatgagtggggaggctggggagttggtgagagaaggtggagatagggatttctgcttcccagtactctatcattagagaaaaggaggggtaaatattagctaagaagaagaaaaaagcttattcttcagggacccagtagattggacgtaagcaagtaaatattgcacaggcatcatgatgtaatagttgatggaccccagagatacccctcacccatgcagagaacaaagctgtgtggaagagcaactaccataagatggtgtgttccttccagcggctgttaaagccatcctgaataacaaatcagctattcctacctacagacccattccaatatgctgtgatacacgacacggtgcaccgcagaggagacagacatcttcagcacaaacacagatgcctgcaggagcttggcaagtcactaaattgcatgaaattgtgaggtgcacaccaaatgcagggatgggggaggccgtgggaagctctgtattctcaaaatttgacagctaattccggtttttagaaaatgcctgaggccagtagaggccctctagtcactcactgctgctgtttctgatataattattgagaaagctatctcacttaatagaagaaaacacgcactatcaaaaccagatagcctaacgtgcatgtgaaaatcgagaaagctgaaaacaaatccaggtacccttctctgaactggagtgtttccacagacttgaataatttatgaaattatcacaccagtatttctcatatcaccaagaagactttctctcctgcagtagaggattgttatatttgcctaaaaaacacgattccaatatatgacaagggcagataatttataagtgaatgttaataaaattggatgtgtataa

SEQ ID NO: 5475 - DNA, 1709 bp, Homo sapiens
ggtacctcctgccagcatctcttgggtttgctgagaactcacgggctccagctacctggccatgaccaccacatttctgcaaacttcttcctccacctttgggggtggctcaacccgagggggttccctcctggctgggggaggtggctttggtggggggagtctctctgggggaggtggaagccgaagtatctcagcttcttctgctaggtttgtctcttcagggtcaggaggaggatatgggggtggcatgagggtctgtggctttggtggaggggctggtagtgttttcggtggaggctttggagggggcgttggtgggggttttggtggtggctttggtggtggcgatggtggtctcctctctggcaatgagaaaattaccatgcagaacctcaatgaccgcctggcctcctacctggacaaggtacgtgccctggaggaggccaatgctgacctggaggtgaagatccatgactggtaccagaagcagaccccaaccagcccagaatgcgactacagccaatacttcaagaccattgaagagctccgggacaagatcatggccaccaccatcgacaactcccgggtcatcctggagatcgacaatgccaggctggctgcggacgacttcaggctcaagtatgagaatgagctggccctgcgccagggcgttgaggctgacatcaacggcttgcgccgagtcctggatgagctgaccctggccaggactgacctggagatgcagatcgagggcctgaatgaggagctagcctacctgaagaagaaccacgaagaggagatgaaggagttcagcagccagctggccggccaggtcaatgtggagatggacgcagcaccgggtgtggacctgacccgtgtgctggcagagatgagggagcagtacgaggccatggcggagaagaaccgccgggatgtcgaggcctggttcttcagcaagactgaggagctgaacaaagaggtggcctccaacacagaaatgatccagaccagcaagacggagatcacagacctgagacgcacgatgcaggagctggagatcgagctgcagtcccagctcagcatgaaagctgggctggagaactcactggccgagacagagtgccgctatgccacgcagctgcagcagatccaggggctcattggtggcctggaggcccagctgagtgagctccgatgcgagatggaggctcagaaccaggagtacaagatgctgcttgacataaagacacggctggagcaggagatcgctacttaccgcagcctgctcgagggccaggatgccaagatggctggcattggcatcagggaagcctcttcaggaggtggtggtagcagcagcaatttccacatcaatgtagaagagtcagtggatggacaggtggtttcttcccacaagagagaaatctaagtgtctattgcaggagaaacgtcccttgccactccccactctcatcaggccaagtggaggactggccagagggcctgcacatgcaaactccagtccctgccttcagagagctgaaaagggtccctcggtcttttatttcagggctttgcatgcgctctattccccctctgcctctccccaccttctttggagcaaggagatgcagctgtattgtgtaacaagctcatttgtacagtgtctgttcatgtaataaagaattacttttccttttgcaaat

SEQ ID NO: 5476 - DNA, 1490 bp, Homo sapiens
agatatccgcccctgacaccattcctcccttcccccctccaccggccgcgggcataaaaggcgccaggtgagggcctcgccgctcctcccgcgaatcgcagcttctgagaccagggttgctccgtccgtgctccgcctcgccatgacttcctacagctatcgccagtcgtcggccacgtcgtccttcggaggcctgggcggcggctccgtgcgttttgggccgggggtcgcctttcgcgcgcccagcattcacgggggctccggcggccgcggcgtatccgtgtcctccgcccgctttgtgtcctcgtcctcctcgggggcctacggcggcggctacggcggcgtcctgaccgcgtccgacgggctgctggcgggcaacgagaagctaaccatgcagaacctcaacgaccgcctggcctcctacctggacaaggtgcgcgccctggaggcggccaacggcgagctagaggtgaagatccgcgactggtaccagaagcaggggcctgggccctcccgcgactacagccactactacacgaccatccaggacctgcgggacaagattcttggtgccaccattgagaactccaggattgtcctgcagatcgacaatgcccgtctggctgcagatgacttccgaaccaagtttgagacggaacaggctctgcgcatgagcgtggaggccgacatcaacggcctgcgcagggtgctggatgagctgaccctggccaggaccgacctggagatgcagatcgaaggcctgaaggaagagctggcctacctgaagaagaaccatgaggaggaaatcagtacgctgaggggccaagtgggaggccaggtcagtgtggaggtggattccgctccgggcaccgatctcgccaagatcctgagtgacatgcgaagccaatatgaggtcatggccgagcagaaccggaaggatgctgaagcctggttcaccagccggactgaagaattgaaccgggaggtcgctggccacacggagcagctccagatgagcaggtccgaggttactgacctgcggcgcacccttcagggtcttgagattgagctgcagtcacagctgagcatgaaagctgccttggaagacacactggcagaaacggaggcgcgctttggagcccagctggcgcatatccaggcgctgatcagcggtattgaagcccagctgggcgatgtgcgagctgatagtgagcggcagaatcaggagtaccagcggctcatggacatcaagtcgcggctggagcaggagattgccacctaccgcagcctgctcgagggacaggaagatcactacaacaatttgtctgcctccaaggtcctctgaggcagcaggctctggggcttctgctgtcctttggagggtgtcttctgggtagagggatgggaaggaagggacccttacccccggctcttctcctgacctgccaataaaaatttatggtccaagggaaaaaaaaaaaaaaaaaaaa

SEQ ID NO: 5477 - DNA, 1332 bp, Homo sapiens
cttgcagagccggcgccggaggagacgcacgcagctgactttgtcttctccgcacgactgttacagaggtctccagagccttctctctcctgtgcaaaatggcaactcttaaggaaaaactcattgcaccagttgcggaagaagaggcaacagttccaaacaataagatcactgtagtgggtgttggacaagttggtatggcgtgtgctatcagcattctgggaaagtctctggctgatgaacttgctcttgtggatgttttggaagataagcttaaaggagaaatgatggatctgcagcatgggagcttatttcttcagacacctaaaattgtggcagataaagattattctgtgaccgccaattctaagattgtagtggtaactgcaggagtccgtcagcaagaaggggagagtcggctcaatctggtgcagagaaatgttaatgtcttcaaattcattattcctcagatcgtcaagtacagtcctgattgcatcataattgtggtttccaacccagtggacattcttacgtatgttacctggaaactaagtggattacccaaacaccgcgtgattggaagtggatgtaatctggattctgctagatttcgctaccttatggctgaaaaacttggcattcatcccagcagctgccatggatggattttgggggaacatggcgactcaagtgtggctgtgtggagtggtgtgaatgtggcaggtgtttctctccaggaattgaatccagaaatgggaactgacaatgatagtgaaaattggaaggaagtgcataagatggtggttgaaagtgcctatgaagtcatcaagctaaaaggatataccaactgggctattggattaagtgtggctgatcttattgaatccatgttgaaaaatctatccaggattcatcccgtgtcaacaatggtaaaggggatgtatggcattgagaatgaagtcttcctgagccttccatgtatcctcaatgcccggggattaaccagcgttatcaaccagaagctaaaggatgatgaggttgctcagctcaagaaaagtgcagataccctgtgggacatccagaaggacctaaaagacctgtgactagtgagctctaggctgtagaaatttaaaaactacaatgtgattaactcgagcctttagttttcatccatgtacatggatcacagtttgctttgatcttcttcaatatgtgaatttgggctcacagaatcaaagcctatgcttggtttaatgcttgcaatctgagctcttgaacaaataaaattaactattgtagtgcgaaaaaaaaaaaaaaaaaaaaaaaaaaaaa

SEQ ID NO: 5478 - DNA, 10099 bp, Homo sapiens
ctctctcccagaacgtgtctctgctgcaaggcaccgggccctttcgctctgcagaactgcacttgcaagaccattatcaactcctaatcccagctcagaaagggagcctctgcgactcattcatcgccctccaggactgactgcattgcacagatgatggatatttacgtatgtttgaaacgaccatcctggatggtggacaataaaagaatgaggactgcttcaaatttccagtggctgttatcaacatttattcttctatatctaatgaatcaagtaaatagccagaaaaagggggctcctcatgatttgaagtgtgtaactaacaatttgcaagtgtggaactgttcttggaaagcaccctctggaacaggccgtggtactgattatgaagtttgcattgaaaacaggtcccgttcttgttatcagttggagaaaaccagtattaaaattccagctctttcacatggtgattatgaaataacaataaattctctacatgattttggaagttctacaagtaaattcacactaaatgaacaaaacgtttccttaattccagatactccagagatcttgaatttgtctgctgatttctcaacctctacattatacctaaagtggaacgacaggggttcagtttttccacaccgctcaaatgttatctgggaaattaaagttctacgtaaagagagtatggagctcgtaaaattagtgacccacaacacaactctgaatggcaaagatacacttcatcactggagttgggcctcagatatgcccttggaatgtgccattcattttgtggaaattagatgctacattgacaatcttcatttttctggtctcgaagagtggagtgactggagccctgtgaagaacatttcttggatacctgattctcagactaaggtttttcctcaagataaagtgatacttgtaggctcagacataacattttgttgtgtgagtcaagaaaaagtgttatcagcactgattggccatacaaactgccccttgatccatcttgatggggaaaatgttgcaatcaagattcgtaatatttctgtttctgcaagtagtggaacaaatgtagtttttacaaccgaagataacatatttggaaccgttatttttgctggatatccaccagatactcctcaacaactgaattgtgagacacatgatttaaaagaaattatatgtagttggaatccaggaagggtgacagcgttggtgggcccacgtgctacaagctacactttagttgaaagtttttcaggaaaatatgttagacttaaaagagctgaagcacctacaaacgaaagctatcaattattatttcaaatgcttccaaatcaagaaatatataattttactttgaatgctcacaatccgctgggtcgatcacaatcaacaattttagttaatataactgaaaaagtttatccccatactcctacttcattcaaagtgaaggatattaattcaacagctgttaaactttcttggcatttaccaggcaactttgcaaagattaattttttatgtgaaattgaaattaagaaatctaattcagtacaagagcagcggaatgtcacaatcaaaggagtagaaaattcaagttatcttgttgctctggacaagttaaatccatacactctatatacttttcggattcgttgttctactgaaactttctggaaatggagcaaatggagcaataaaaaacaacatttaacaacagaagccagtccttcaaaggggcctgatacttggagagagtggagttctgatggaaaaaatttaataatctattggaagcctttacccattaatgaagctaatggaaaaatactttcctacaatgtatcgtgttcatcagatgaggaaacacagtccctttctgaaatccctgatcctcagcacaaagcagagatacgacttgataagaatgactacatcatcagcgtagtggctaaaaattctgtgggctcatcaccaccttccaaaatagcgagtatggaaattccaaatgatgatctcaaaatagaacaagttgttgggatgggaaaggggattctcctcacctggcattacgaccccaacatgacttgcgactacgtcattaagtggtgtaactcgtctcggtcggaaccatgccttatggactggagaaaagttccctcaaacagcactgaaactgtaatagaatctgatgagtttcgaccaggtataagatataattttttcctgtatggatgcagaaatcaaggatatcaattattacgctccatgattggatatatagaagaattggctcccattgttgcaccaaattttactgttgaggatacttctgcagattcgatattagtaaaatgggaagacattcctgtggaagaacttagaggctttttaagaggatatttgttttactttggaaaaggagaaagagacacatctaagatgagggttttagaatcaggtcgttctgacataaaagttaagaatattactgacatatcccagaagacactgagaattgctgatcttcaaggtaaaacaagttaccacctggtcttgcgagcctatacagatggtggagtgggcccggagaagagtatgtatgtggtgacaaaggaaaattctgtgggattaattattgccattctcatcccagtggcagtggctgtcattgttggagtggtgacaagtatcctttgctatcggaaacgagaatggattaaagaaaccttctaccctgatattccaaatccagaaaactgtaaagcattacagtttcaaaagagtgtctgtgagggaagcagtgctcttaaaacattggaaatgaatccttgtaccccaaataatgttgaggttctggaaactcgatcagcatttcctaaaatagaagatacagaaataatttccccagtagctgagcgtcctgaagatcgctctgatgcagagcctgaaaaccatgtggttgtgtcctattgtccacccatcattgaggaagaaataccaaacccagccgcagatgaagctggagggactgcacaggttatttacattgatgttcagtcgatgtatcagcctcaagcaaaaccagaagaagaacaagaaaatgaccctgtaggaggggcaggctataagccacagatgcacctccccattaattctactgtggaagatatagctgcagaagaggacttagataaaactgcgggttacagacctcaggccaatgtaaatacatggaatttagtgtctccagactctcctagatccatagacagcaacagtgagattgtctcatttggaagtccatgctccattaattcccgacaatttttgattcctcctaaagatgaagactctcctaaatctaatggaggagggtggtcctttacaaacttttttcagaacaaaccaaacgattaacagtgtcaccgtgtcacttcagtcagccatctcaataagctcttactgctagtgttgctacatcagcactgggcattcttggagggatcctgtgaagtattgttaggaggtgaacttcactacatgttaagttacactgaaagtgttcatgtgcttttaatgtagtctaaaagccaaagtatagtgactcagaatcctcaatccacaaaactcaagattgggagctctttgtgatcaagccaaagaattctcatgtactctaccttcaagaagcatttcaaggctaatacctacttgtacgtacatgtaaaacaaatcccgccgcaactgttttctgttctgttgtttgtggttttctcatgtgtatacttggtggaattgtaagtggatttgcaggccagggagaaaatgtccaagtaacaggtgaagtttatttgcctgacgtttactcctttctagatgaaaaccaagcacagattttaaaacttctaagattattctcctctatccacagcattcacaaaaattaatataatttttaatgtagtgacagcgatttagtgttttgtttgataaagtatgcttatttctgtgcctactgtataatggttatcaaacagttgtctcaggggtacaaactttgaaaacaagtgtgacactgaccagcccaaatcataatcatgttttcttgctgtgataggttttgcaagccttttcattattttttagcttttatgcttgcttccattatttcagttggttgccctaatatttaaaatttacacttctaagactagagacccacattttttaaaaatcattttattttgtgatacagtgacagctttatatgagcaaattcaatattattcataagcatgtaattccagtgacttactatgtgagatgactactaagcaatatctagcagcgttagctgtccatatagttctgattggatttcgttcctcctgaggagaccatgccgttgagcttggctacccaggcagtggtgatctttgacaccttctggtggatgttcctcccactcatgagtcttttcatcatgccacattatctgatccagtcctcacatttttaaatataaaactaaagagagaatgcttcttacaggaacagttacccaagggctgtttcttagtaactgtcataaactgatctgaatccatgggcatacctgtgttgcaggtgcagcaattgcttggtgagctgtgcagaattgattgccttcagcacagcatcctctgcccacccttgtttctcataagcgatgtctggagtgattgtggttcttggaaaagcagaaggaaaaactaaaaagtgtatcttgtattttccctgccctcaggttgcctatgtattttaccttttcatatttaaggcaaaagtacttgaaaattttaagtgtccgaataagatatgtcttttttgtttgttttttttggttgtttgtttgttttttatcatctgagattctgtaatgtatttgcaaataatggatcaattaattttttttgaagctcatattgtatctttttaaaaaccatgttgtggaaaaaagccagagtgacaagtgacaaaatctatttaggttctctgtgtatgaatcctgattttaactgctaggattcagctaaatttctgagctttatgatctgtggaaatttggaatgaaatgcaattcattttgtacatacatagtatattaaaactatataatagttcatagaaatgttcagtaatgaaaaatatatccaatcagagccatccctaaagagtgttctcttgtcttcctttgtatcctctttggctccttcccttagcttccaccccagacatcagacctggggctgccttctctccctgccaaagcttgctgttagcattgtctgcttgccctcaactcctgccttgttccctgttgaaatgtatcaatcccgtactttatctctccaggacaaggataagtgtggctacagtaaaagtttattgctctaaacggcgctaacctgagataatgagaaaaggccagaagagattgtttgatctctgtctgtcaatatatatgcatttcaactgtgaccatctggatccagggccctttctaacctatataacgactcatttgtttggttaatgatgaatatcactggggctcttaagtcctttcgttctatccaagacttcattgtttttttctgtatgaaaaaagtgcagaatatcactcacctttcccctacttttggatcccctacacgaggatcactagcttaatgagaagcagagtaacgctattaagtctgggcaagctccttataagttgctgtgtgcttaaaagaatgtgatttatgtctggggccaaagcagttttccttcttttccctcattgaattcaagacagctagacccttgtgtagatcccaggatattacctctactccccccaacctgtgtgtgtagggagagtaacaacacgggaagaggggagggaagttggaaggagattggtcacatgttcagttgtctgagatactggtaaatgtgcgctgtttgtcaatgaaggttgcatgcctgcatttacaaggtggtctcatactgattgtgctctgtccagttagattcgtggcttctcccttggaagctacaattaaggactagttagaagcagaggctagatgtgttctctccagcccttactaactgggaaaataattgagaaatccctcttttcctcagtgaaagcccagtcattggttagaaaaatctaattgtcaaactagcattatgttccatcatatctgtgggatagtaattcatgtaagacacatttttacctctcttacaagtcaattcacttacaagccagtttcaaatcaagcttcccttgcgaggaatggagatcattatggggcttattatgactacatttcttttatgagtgaccattttaaataattaatattttatttaatattaaattattaaagacttagctagacttttaacattagatgaaccttgtgaatcatatattgcatagattagcacatgtatgcaatctaggtcatcaatttgttgaatttatacagccctagatttgagattgtggccctgagtatctggatagttgagttgtgtgtttatgtgcttatatgatagaggtgctttgttcctgcagcttagaaacagaagcagccattcactgagaagcttaagagaggaagtatcaacctcattttccaaaccagcattactttcaccgctcgtggatctgaaagattacatttagaacatttagtactattacactctcagaaactgtggtaaaaagtcacattttcaaaacttcatgcatattgtattcttgttggaaataagtcctatagtttcttaattgtcttcatgccgtccatatttaacaaacattgcaagtcctttttatatttgggtaattatttgtaatttagtgaaggagactaggggatgttttcttccaaagggaatttaaaatcaattttatggtattttgaaagtaaaatactccttaacgtgtcaatatttttaaaatgttatctcgaagttttctattgctcaggtatataatctaataaaattttttgtttgctctaaggttatttttgctattctctattttgaattatgttaaaatttgtgtgcattttatgaaatgccttttttcttattttgaaagtgtaaaattgggcatctcagagtaaaatgtgggattattagctacaaagactaggcacatcgtgaaagctcagtaactaattttcttgactgagtcctatcccagagtgtcacagattcaacagaattttcctgaagggtgatacacaccaaaatctagcttgtgtggatctgagactattgactcaaagattcaaatctacttcggaagtgactccacggtttgagtgaaaactgaggaaggactcatgcctgtatatcactagatatcttatttctccataattttaagtgttcataatttcttcttctttgatgggtgtgcaactggggcatgtttgtaccagccagcatgtgttctgcccaacagtgtgtccgtgtgtgaggttaactgattcagaactcattctcttgataaactatttcttgaaagcatttattttaagtctttatttcctgctgaaatgaagtttcatgctgtcatgcccatcttatttattctagaagaaaattttcatagaagaaaatgatttatggccaaagttacagaacattcatcttttagacttagccttagaatatcattggaaattacttggcttgaatttggttcgtttttatctttatggattatgtaccagggctattaataatacttaaaccccttattttgctatggtggttagatttttttattccttttcaattagtgctattaattattacatggtcgtattcatgcttattacagatgaactatttttagtgccagtgtaaaggattaagaataacattcaattagttggctatttcaggctttattgtacatggtaatgtttcagggagtgtgatttggtctagaatatatccagatccttgtaattatgatattgggttatgacaggattctattatttttagctatgaatggtgcttatttttccctatattaggaatgttaatatttggattatcagagtccatgttataaacagaatttacctatgcaagacaaattctaactgtgcaacattttcatgagaattaaaagttgtgtgttaaggggaaaaccctctgaatgtttttatgtgtaagtgcctaaagaaccgtagaaacagtacatcaaaagctcttataaaagaaaaactgattgaacattagccagaaacaaaatatgatttacatttttttttttggttgctgggactgaataccctaaaaactaagagatgtgagtggggaaaatgtctaattgataagaaagttgatttatattatatttacatgcatcttctaagattgcctttacagtagccaatcagaactttaaaaaaaaaaaagctaacaacatagatcctatgtgttgcccttaagactaaaatactttgcacacgtgattgaatggctcacttaagttgttgaatttccttatacatttaaagtgtacttccgttaagaattattccattttaaatgggtaactttcagcttccgaactattttcctaaacattccagttgtgtattataaaagatcaaaatatctctaggtggtagtacaattttcatttataacgtggaaaagttaactgttaggtttaacattagtattagtgtttttgcaattgctcatagaaaagaacactgaataatggttttcatacaatttttgtaaaacattcttctcccagtttgattccaaatgcttttccccaaattgtctaatatatcataagctagtgtttccttgtatttaatttttccttccaacacaatatttaggaaaaatatgaataacattgtgagtagcgggagacaacacgaaaaagaaacctttcattgttgtggaggggtaggtgttatgtgattgatgcccttcctggcgtttgttttatcctgttattttctcaaaaaagagcacggctttttcttaaatacatttaaattcagaattgcttgcaaaagattggcctggatagatagacatcctagatttaagatagtaccatcttaaaagtatgttgaaaggtaaaataaatcatttcaaaatacttaactttcctaataaggatgttaggttttcttctctttcattagctggccataagtcaaggtccttataacactaggaaattacctttttttactttcaaaattgcattatagtgaattactgtttacaaaatacacatactgtgaacagatataagtttctgtcttttataaggtttgtagaatgaatgtttttttaaagtgagtattatatgttaaatattttaagttttttataaatactagtaactgtttactaatttttgtttggtcaaatgcttgtaaatgtagctgaaagaagatagggagaaactgcggatcccaaactgttccctttttcatttcttgaaatgttaccactacagacatttttttaaggtgaataaacagttgtgatgtgctgtacctaaaatcatgtttaatcgtataaggaaacatttcaatacacttatacaggaagaaaactatagatgaagtacatgtgtgtgattcagtctgattcacagaattctgagagtaatatggaataaaacaactccacttagatgataactgaagcatttcctgccttgtgaaaatttggattttaaattgctgttagaatgggaaatttggacactttatatcattgtataatttcagaatttagtttctgtatcttttggaaaacatgattatagcaaaaacatagaaaataatctattactaaaacaccataaatgtaaaactagtatgcttggctgttaactctaaagatgttacttatgtctgtttttaaaacatgcatgtatttaacaattttatcatagtattgtcatggaaaaaataaatatattttcttacatcttaaaaaaaaaaaaaaaaaaaaa

SEQ ID NO: 5479 - DNA, 4122 bp, Homo sapiens
gcgagcgaagggagcgctctgggatgggacttggagcaagcggcggcggcggagacagaggcagaggcagaagctggggctccgtcctcgcctcccacgagcgatccccgaggagagccgcggccctcggcgaggcgaagaggccgacgaggaagacccgggtggctgcgcccctgcctcgcttcccaggcgccggcggctgcagccttgcccctcttgctcgccttgaaaatggaaaagatgctcgcaggctgctttctgctgatcctcggacagatcgtcctcctccctgccgaggccagggagcggtcacgtgggaggtccatctctaggggcagacacgctcggacccacccgcagacggcccttctggagagttcctgtgagaacaagcgggcagacctggttttcatcattgacagctctcgcagtgtcaacacccatgactatgcaaaggtcaaggagttcatcgtggacatcttgcaattcttggacattggtcctgatgtcacccgagtgggcctgctccaatatggcagcactgtcaagaatgagttctccctcaagaccttcaagaggaagtccgaggtggagcgtgctgtcaagaggatgcggcatctgtccacgggcaccatgactgggctggccatccagtatgccctgaacatcgcattctcagaagcagagggggcccggcccctgagggagaatgtgccacgggtcataatgatcgtgacagatgggagacctcaggactccgtggccgaggtggctgctaaggcacgggacacgggcatcctaatctttgccattggtgtgggccaggtagacttcaacaccttgaagtccattgggagtgagccccatgaggaccatgtcttccttgtggccaatttcagccagattgagacgctgacctccgtgttccagaagaagttgtgcacggcccacatgtgcagcaccctggagcataactgtgcccacttctgcatcaacatccctggctcatacgtctgcaggtgcaaacaaggctacattctcaactcggatcagacgacttgcagaatccaggatctgtgtgccatggaggaccacaactgtgagcagctctgtgtgaatgtgccgggctccttcgtctgccagtgctacagtggctacgccctggctgaggatgggaagaggtgtgtggctgtggactactgtgcctcagaaaaccacggatgtgaacatgagtgtgtaaatgctgatggctcctacctttgccagtgccatgaaggatttgctcttaacccagataaaaaaacgtgcacaaagatagactactgtgcctcatctaatcacggatgtcagcacgagtgtgttaacacagatgattcctattcctgccactgcctgaaaggctttaccctgaatccagataagaaaacctgcagaaggatcaactactgtgcactgaacaaaccgggctgtgagcatgagtgcgtcaacatggaggagagctactactgccgctgccaccgtggctacactctggaccccaatggcaaaacctgcagccgagtggaccactgtgcacagcaggaccatggctgtgagcagctgtgtctgaacacggaggattccttcgtctgccagtgctcagaaggcttcctcatcaacgaggacctcaagacctgctcccgggtggattactgcctgctgagtgaccatggttgtgaatactcctgtgtcaacatggacagatcctttgcctgtcagtgtcctgagggacacgtgctccgcagcgatgggaagacgtgtgcaaaattggactcttgtgctctgggggaccacggttgtgaacattcgtgtgtaagcagtgaagattcgtttgtgtgccagtgctttgaaggttatatactccgtgaagatggaaaaacctgcagaaggaaagatgtctgccaagctatagaccatggctgtgaacacatttgtgtgaacagtgatgactcatacacgtgcgagtgcttggagggattccggctcgctgaggatgggaaacgctgccgaaggaaggatgtctgcaaatcaacccaccatggctgcgaacacatttgtgttaataatgggaattcctacatctgcaaatgctcagagggatttgttctagctgaggacggaagacggtgcaagaaatgcactgaaggcccaattgacctggtctttgtgatcgatggatccaagagtcttggagaagagaattttgaggtcgtgaagcagtttgtcactggaattatagattccttgacaatttcccccaaagccgctcgagtggggctgctccagtattccacacaggtccacacagagttcactctgagaaacttcaactcagccaaagacatgaaaaaagccgtggcccacatgaaatacatgggaaagggctctatgactgggctggccctgaaacacatgtttgagagaagttttacccaaggagaaggggccaggcccctttccacaagggtgcccagagcagccattgtgttcaccgacggacgggctcaggatgacgtctccgagtgggccagtaaagccaaggccaatggtatcactatgtatgctgttggggtaggaaaagccattgaggaggaactacaagagattgcctctgagcccacaaacaagcatctcttctatgccgaagacttcagcacaatggatgagataagtgaaaaactcaagaaaggcatctgtgaagctctagaagactccgatggaagacaggactctccagcaggggaactgccaaaaacggtccaacagccaacagaatctgagccagtcaccataaatatccaagacctactttcctgttctaattttgcagtgcaacacagatatctgtttgaagaagacaatcttttacggtctacacaaaagctttcccattcaacaaaaccttcaggaagccctttggaagaaaaacacgatcaatgcaaatgtgaaaaccttataatgttccagaaccttgcaaacgaagaagtaagaaaattaacacagcgcttagaagaaatgacacagagaatggaagccctggaaaatcgcctgagatacagatgaagattagaaatcgcgacacatttgtagtcattgtatcacggattacaatgaacgcagtgcagagccccaaagctcaggctattgttaaatcaataatgttgtgaagtaaaacaatcagtactgagaaacctggtttgccacagaacaaagacaagaagtatacactaacttgtataaatttatctaggaaaaaaatccttcagaattctaagatgaatttaccaggtgagaatgaataagctatgcaaggtattttgtaatatactgtggacacaacttgcttctgcctcatcctgccttagtgtgcaatctcatttgactatacgataaagtttgcacagtcttacttctgtagaacactggccataggaaatgctgtttttttgtactggactttaccttgatatatgtatatggatgtatgcataaaatcataggacatatgtacttgtggaacaagttggattttttatacaatattaaaattcaccacttcagagaatggtattcagtgcaaaaattcttagtttaactttaaatggaagatatgtatgtatgagaaatggccaacatgcctatgaaaaaaatgctgaatctcatcagtaatcaggaaaatgcaggttaaaacaataccatttttcacccatcagcttagcaaaaatgagtatattttttaacaagtgttggtaaggatgtggaaatgtgaggttcttgtagtaagaatgcaaatggcactctttgtagagtaagtctgttgacatctcataaaactgaaaatgcacacaaccctgtaaatctagcaactgcactcagttgatttcagcccatacatacaaagagacctgcataagaatgttactaggctttgtaaaagcaaaaaataaggaacaacttaaacatcatcagaaggggaactgataaactctggtgtaatccataccacagaaatacaacaccgcatgtacaggaatgtgctacatctatacaaataaatggtcaaactcaaaaaaaaaaaaaaaa

SEQ ID NO: 5480 - DNA, 12684 bp, Homo sapiens
gcgggcgggcgggaggactcgactcggtgggagccgctagagccgggcgcccggggacgtagcctgtagggccaccgggtccccgtcagaggcggcggcgggagcagcggggactgcaggccggggtgcagcgaacgcgaccccgcgggctgcggcccggtgtgtgcggagcgtggcgggcgcagcttaccgggcggaggtgagcgcggcgccggctcctcctgcggcggactttgggtgcgacttgacgagcggtggttcgacaagtggccttgcgggccggatcgtcccagtggaagagttgtaaatttgcttctggccttcccctacggattatacctggccttcccctacggattatactcaacttactgtttagaaaatgtggcccacgagacgcctggttactatcaaaaggagcggggtcgacggtccccactttcccctgagcctcagcacctgcttgtttggaaggggtattgaatgtgacatccgtatccagcttcctgttgtgtcaaaacaacattgcaaaattgaaatccatgagcaggaggcaatattacataatttcagttccacaaatccaacacaagtaaatgggtctgttattgatgagcctgtacggctaaaacatggagatgtaataactattattgatcgttccttcaggtatgaaaatgaaagtcttcagaatggaaggaagtcaactgaatttccaagaaaaatacgtgaacaggagccagcacgtcgtgtctcaagatctagcttctcttctgaccctgatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattaatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattgttgcaaaatcatgggcagatgtagtaaaacttggtgcaaaacaaacacaaactaaagtcataaaacatggtcctcaaaggtcaatgaacaaaaggcaaagaagacctgctactccaaagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggaatagctgaaatgttcaagaccccagtgaaggagcaaccgcagttgacaagcacatgtcacatcgctatttcaaattcagagaatttgcttggaaaacagtttcaaggaactgattcaggagaagaacctctgctccccacctcagagagttttggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggctgaggacaatgtgtgtgtcaagaaaataagaaccagaagtcatagggacagtgaagatatttgacagaaaaatcgaactgggaaaaatataataaagttagttttgtgataagttctagtgcagtttttgtcataaattacaagtgaattctgtaagtaaggctgtcagtctgcttaagggaagaaaactttggatttgctgggtctgaatcggcttcataaactccactgggagcactgctgggctcctggactgagaatagttgaacaccgggggctttgtgaaggagtctgggccaaggtttgccctcagctttgcagaatgaagccttgaggtctgtcaccacccacagccaccctacagcagccttaactgtgacacttgccacactgtgtcgtcgtttgtttgcctatgtcctccagggcacggtggcaggaacaactatcctcgtctgtcccaacactgagcaggcactcggtaaacacgaatgaatggatgagcgcacggatgaatggagcttacaagatctgtctttccaatggccgggggcatttggtccccaaattaaggctattggacatctgcacaggacagtcctatttttgatgtcctttcctttctgaaaataaagttttgtgctttggagaatgactcgtgagcacatctttagggaccaagagtgactttctgtaaggagtgactcgtggcttgccttggtctcttgggaatacttttctaactagggttgctctcacctgagacattctccacccgcggaatctcagggtcccaggctgtgggccatcacgacctcaaactggctcctaatctccagctttcctgtcattgaaagcttcggaagtttactggctctgctcccgcctgttttctttctgactctatctggcagcccgatgccacccagtacaggaagtgacaccagtactctgtaaagcatcatcatccttggagagactgagcactcagcaccttcagccacgatttcaggatcgcttccttgtgagccgctgcctccgaaatctcctttgaagcccagacatctttctccagcttcagacttgtagatataactcgttcatcttcatttactttccactttgccccctgtcctctctgtgttccccaaatcagagaatagcccgccatcccccaggtcacctgtctggattcctccccattcacccaccttgccaggtgcaggtgaggatggtgcaccagacagggtagctgtcccccaaaatgtgccctgtgcgggcagtgccctgtctccacgtttgtttccccagtgtctggcggggagccaggtgacatcataaatacttgctgaatgaatgcagaaatcagcggtactgacttgtactatattggctgccatgatagggttctcacagcgtcatccatgatcgtaagggagaatgacattctgcttgagggagggaatagaaaggggcagggaggggacatctgagggcttcacagggctgcaaagggtacagggattgcaccagggcagaacaggggagggtgttcaaggaagagtggctcttagcagaggcactttggaaggtgtgaggcataaatgcttccttctacgtaggccaacctcaaaactttcagtaggaatgttgctatgatcaagttgttctaacactttagacttagtagtaattatgaacctcacatagaaaaatttcatccagccatatgcctgtggagtggaatattctgtttagtagaaaaatcctttagagttcagctctaaccagaaatcttgctgaagtatgtcagcaccttttctcaccctggtaagtacagtatttcaagagcacgctaagggtggttttcattttacagggctgttgatgatgggttaaaaatgttcatttaagggctacccccgtgtttaatagatgaacaccacttctacacaaccctccttggtactgggggagggagagatctgacaaatactgcccattcccctaggctgactggatttgagaacaaatacccacccatttccaccatggtatggtaacttctctgagcttcagtttccaagtgaatttccatgtaataggacattcccattaaatacaagctgtttttactttttcgcctcccagggcctgtgggatctggtcccccagcctctcttgggctttcttacactaactctgtacctaccatctcctgcctcccttaggcaggcacctccaaccaccacacactccctgctgttttccctgcctggaactttccctcctgccccaccaagatcatttcatccagtcctgagctcagcttaagggaggcttcttgcctgtgggttccctcacccccatgcctgtcctccaggctggggcaggttcttagtttgcctggaattgttctgtacctctttgtagcacgtagtgttgtggaaactaagccactaattgagtttctggctcccctcctggggttgtaagttttgttcattcatgagggccgactgcatttcctggttactctatcccagtgaccagccacaggagatgtccaataaagtatgtgatgaaatggtcttaaaa

SEQ ID NO: 5481 - DNA, 1147 bp, Homo sapiens
accaaatcaaccataggtccaagaacaattgtctctggacggcagctatgcgactcaccgtgctgtgtgctgtgtgcctgctgcctggcagcctggccctgccgctgcctcaggaggcgggaggcatgagtgagctacagtgggaacaggctcaggactatctcaagagattttatctctatgactcagaaacaaaaaatgccaacagtttagaagccaaactcaaggagatgcaaaaattctttggcctacctataactggaatgttaaactcccgcgtcatagaaataatgcagaagcccagatgtggagtgccagatgttgcagaatactcactatttccaaatagcccaaaatggacttccaaagtggtcacctacaggatcgtatcatatactcgagacttaccgcatattacagtggatcgattagtgtcaaaggctttaaacatgtggggcaaagagatccccctgcatttcaggaaagttgtatggggaactgctgacatcatgattggctttgcgcgaggagctcatggggactcctacccatttgatgggccaggaaacacgctggctcatgcctttgcgcctgggacaggtctcggaggagatgctcacttcgatgaggatgaacgctggacggatggtagcagtctagggattaacttcctgtatgctgcaactcatgaacttggccattctttgggtatgggacattcctctgatcctaatgcagtgatgtatccaacctatggaaatggagatccccaaaattttaaactttcccaggatgatattaaaggcattcagaaactatatggaaagagaagtaattcaagaaagaaatagaaacttcaggcagaacatccattcattcattcattggattgtatatcattgttgcacaatcagaattgataagcactgttcctccactccatttagcaattatgtcacccttttttattgcagttggtttttgaatgtctttcactccttttaaggataaactcctttatggtgtgactgtgtcttattcatctatacttgcagtgggtagatgtcaataaatgttacatacacaaataaataaaatgtttattccatggtaaatttaaaaaaaaaaaaaaaaaaaaaaaaaaaaa

SEQ ID NO: 5482 - DNA, 2130 bp, Homo sapiens
ggttaaacggggcccaaggcaggggtggcgggtcagtgctgctcgggggcttctccatccaggtccctggagttcctggtccctggagctccgcacttggcggcgcaacctgcgtgaggcagcgcgactctggcgactggccggccatgccttcccgggctgaggactatgaagtgttgtacaccattggcacaggctcctacggccgctgccagaagatccggaggaagagtgatggcaagatattagtttggaaagaacttgactatggctccatgacagaagctgagaaacagatgcttgtttctgaagtgaatttgcttcgtgaactgaaacatccaaacatcgttcgttactatgatcggattattgaccggaccaatacaacactgtacattgtaatggaatattgtgaaggaggggatctggctagtgtaattacaaagggaaccaaggaaaggcaatacttagatgaagagtttgttcttcgagtgatgactcagttgactctggccctgaaggaatgccacagacgaagtgatggtggtcataccgtattgcatcgggatctgaaaccagccaatgttttcctggatggcaagcaaaacgtcaagcttggagactttgggctagctagaatattaaaccatgacacgagttttgcaaaaacatttgttggcacaccttattacatgtctcctgaacaaatgaatcgcatgtcctacaatgagaaatcagatatctggtcattgggctgcttgctgtatgagttatgtgcattaatgcctccatttacagcttttagccagaaagaactcgctgggaaaatcagagaaggcaaattcaggcgaattccataccgttactctgatgaattgaatgaaattattacgaggatgttaaacttaaaggattaccatcgaccttctgttgaagaaattcttgagaaccctttaatagcagatttggttgcagacgagcaaagaagaaatcttgagagaagagggcgacaattaggagagccagaaaaatcgcaggattccagccctgtattgagtgagctgaaactgaaggaaattcagttacaggagcgagagcgagctctcaaagcaagagaagaaagattggagcagaaagaacaggagctttgtgttcgtgagagactagcagaggacaaactggctagagcagaaaatctgttgaagaactacagcttgctaaaggaacggaagttcctgtctctggcaagtaatccagaacttcttaatcttccatcctcagtaattaagaagaaagttcatttcagtggggaaagtaaagagaacatcatgaggagtgagaattctgagagtcagctcacatctaagtccaagtgcaaggacctgaagaaaaggcttcacgctgcccagctgcgggctcaagccctgtcagatattgagaaaaattaccaactgaaaagcagacagatcctgggcatgcgctagccaggtagagagacacagagctgtgtacaggatgtaatattaccaacctttaaagactgatattcaaatgctgtagtgttgaatacttggttccatgagccatgcctttctgtatagtacacatgatatttcggaattggttttactgttcttcagcaactattgtacaaaatgttcacatttaatttttctttcttcttttaagaacatattataaaaagaatactttcttggttgggcttttaatcctgtgtgtgattactagtaggaacatgagatgtgacattctaaatcttgggagaaaaaataatgttaggaaaaaaatatttatgcaggaagagtagcactcactgaatagttttaaatgactgagtggtatgcttacaattgtcatgtctagatttaaattttaagtctgagattttaaatgtttttgagcttagaaaacccagttagatgcaatttggtcattaataccatgacatcttgcttataaatattccattgctctgtagttcaaatctgttagctttgtgaaaattcatcactgtgatgtttgtattctttttttttttctgtttaacagaatatgagctgtctgtcatttacctacttctttcccactaaataaaagaattcttcagtt

SEQ ID NO: 5483 - DNA, 2921 bp, Homo sapiens
ctaggagctggcggtccgagctgtggcttgaaagaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagcataattagtagtgagaaggaacttaagaatttaacagaattagaagatgaacatttggcaaaaagggcaagacaaggtgaagaggataatgagtatactgaaagctattctgatgatgattcaagtatggaagactacccagatccacagtcagcaaatcacatgaacagttccctgctgtctttatatcggaaaggaaatcctgattctgtttcaaatactcctgagatggagcaaagagaaaccacctcttcaacaccacggataagttccaaaacaggctccattcccttgaagacccctgccaaagattctgaaggaggatggtttattgacaaaaccccaagtgtaaagaaagacagttttttcttggacctgtcatgtgagaaaagtaatcctaagaagccaataactgagatacaggattcaaaagattcttctcttttggagagtgatatgaaacggaaaggcaagctaaagaataaaggaagcaaaaggaagaaagaagatcttcaggaagtagatggagaaattgaagctgtcctgcaaaagaaagctaaagccagggggttagaattccagatctccaacgtgaagtttgaagatgtgggaggcaatgatatgacattaaaagaggtctgcaagatgctcatacacatgcgtcacccggaggtgtaccaccacctgggcgtcgtgccccctcgtggagttctccttcatggaccaccaggctgtgggaagacattacttgcacatgcaattgctggggaacttgacctgccaattttgaaagtggctgctccagagattgtgtctggagtatccggagagtctgagcagaagctgagagaactatttgagcaagctgtgtcaaatgcaccatgtatcattttcattgatgaaattgatgctattacccccaaaagagaagtggcttcaaaagatatggaacgaagaattgtagcccaactcctaacctgcatggatgatctgaataatgtggctgctacagcccgggtcctagttattggagctactaatcgaccagactcgttagaccctgctttgagacgtgcgggaaggttcgaccgagaaatatgcctaggtatcccagatgaagcatccagggaaagaatacttcaaacattgtgcagaaaactgaggcttcctcaagcttttgatttctgtcacttagcacacctaactccaggctttgttggtgctgatctcatggcactgtgccgagaggcagcaatgtgtgcagtcaatagagtcttaatgaagctacaggaacagcagaagaaaaatcctgaaatggaagatttgccatctaaaggagtccaggaggaaaggctgggaactgagcccacttctgaaacacaggatgaattacaaaggctgctggggttgctaagagaccaagatcccctctcagaggagcagatgcaaggactgtgcattgaactgaatgatttcattgttgctctatcctcagtccaaccctctgccaaaagggaaggctttgtcactgtccctaatgtgacatgggcagatattggtgccctggaagacattagagaggagctcaccatggcaatattggcaccagtacgcaacccagaccagttcaaagctcttggattggtgactccagctggggtcctccttgctggtcctcctggctgtgggaagactctgctggcgaaggctgttgcaaatgagtccggactaaattttatatctgtcaagggccccgaattactaaacatgtatgttggtgagagtgaacgtgctgtgcgacaagtttttcaacgagccaagaactcagcaccctgtgtgatattctttgatgaagtggatgctttatgtcctcgaagatcagaccgagagacaggggcaagtgtccgagtggtgaatcagctacttacagagatggatggtctggaagcacgccagcaggtttttattatggcagccactaacaggccagatataattgaccctgcaatcctgcgcccgggccgcctggacaaaacactgtttgtgggtttaccgccccctgcagatcgccttgccatcttaaaaactatcacaaaaaatggtaccaaaccaccactggatgcagatgtaaatttggaagcaattgctggtgaccttcgctgtgattgctatacgggcgcagatctctctgctttggtacgagaagcttctatctgtgccctgagacaggaaatggcaagacagaagagtggaaatgaaaaaggtgaactcaaggttagtcataagcattttgaagaagctttcaagaaagtaagatcatctatatcaaaaaaggatcaaatcatgtatgaacgtttgcaggagtccctcagccggtgatgtctccagcagccggcttagaggagctagcccatcaagccggcagagaatcccccacacgctctgaaggacccactttcagctggacacaggcgcggcctcatgtaaacattttattttcaaatgaatgaggccaagctgaagctgaagctgaagattcttcccatctggccagccttgtgtgaaaatgccttcttcctctttaagaaaaaggacaatttttaaactgctgaaataaaatgactgttacatttttcaaataaaacttttactttgaactattttgactataaaaaaaaaaaaaaaa

SEQ ID NO: 5484 - DNA, 4266 bp, Homo sapiens
agagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtaaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaggctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttttgtagagacagggtttcgccatgttgacgagactggtctcgaactcctggcctcaagtgatctgccgcctcagcttctcaaagtactgggattatataggcatgagccactgagcctggccctgaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgcc

SEQ ID NO: 5485 - DNA, 1879 bp, Homo sapiens
agttccaagtttggagcttttagctgccagccctggcccatcatgtagctgcagcacagccttccctaacgttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtcttttgtgctcccctcccccatcaaaggaaaggggaaaatgtctcagtcgaaaggcaagaagcgaaaccctggccttaaaattccaaaagaagcatttgaacaacctcagaccagttccacaccacctcgagatttagactccaaggcttgcatttctattggaaatcagaactttgaggtgaaggcagatgacctggagcctataatggaactgggacgaggtgcgtacggggtggtggagaagatgcggcacgtgcccagcgggcagatcatggcagtgaagcggatccgagccacagtaaatagccaggaacagaaacggctactgatggatttggatatttccatgaggacggtggactgtccattcactgtcaccttttatggcgcactgtttcgggagggtgatgtgtggatctgcatggagctcatggatacatcactagataaattctacaaacaagttattgataaaggccagacaattccagaggacatcttagggaaaatagcagtttctattgtaaaagcattagaacatttacatagtaagctgtctgtcattcacagagacgtcaagccttctaatgtactcatcaatgctctcggtcaagtgaagatgtgcgattttggaatcagtggctacttggtggactctgttgctaaaacaattgatgcaggttgcaaaccatacatggcccctgaaagaataaacccagagctcaaccagaagggatacagtgtgaagtctgacatttggagtctgggcatcacgatgattgagttggccatccttcgatttccctatgattcatggggaactccatttcagcagctcaaacaggtggtagaggagccatcgccacaactcccagcagacaagttctctgcagagtttgttgactttacctcacagtgcttaaagaagaattccaaagaacggcctacatacccagagctaatgcaacatccatttttcaccctacatgaatccaaaggaacagatgtggcatcttttgtaaaactgattcttggagactaaaaagcagtggacttaatcggttgaccctactgtggattggtgggtttcggggtgaagcaagttcactacagcatcaatagaaagtcatctttgagataatttaaccctgcctctcagagggttttctctcccaattttctttttactccccctcttaagggggccttggaatctatagtatagaatgaactgtctagatggatgaattatgataaaggcttaggacttcaaaaggtgattaaatatttaatgatgtgtcatatgagtcctcaagcttctcagacttctcttattctttacaaaatgaatgcattggccctgacaaaaaggtgctacggtagtgatgaaattataagtagatttgtagtttgtcccatttattattttaatatttatgtttaagtgcttggttgaaaagattccattttatacaagaagggagattcaaaaaaaaaatataaggttgggttagcaatatttatagggcttttattttttaagttcaattgtgtctgtggtccagaagaaattatttaatatgcatctttgagaatattataaaaatatcaaaaaggaaaaaaaaaaa

SEQ ID NO: 5486 - DNA, 1558 bp, Homo sapiens
gagtgcaaagcgctctccctccctcgcccagccttcgtcctcctggcccgctcctctcatccctcccattctccatttcccttccgttccctccctgtcagggcgtaattgagtcaaaggcaggatcaggttccccgccttccagtccaaaaatcccgccaagagagccccagagcagaggaaaatccaaagtggagagaggggaagaaagagaccagtgagtcatccgtccagaaggcggggagagcagcagcggcccaagcaggagctgcagcgagccgggtacctggactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaaaaaaaaaaa

SEQ ID NO: 5487 - DNA, 8169 bp, Homo sapiens
acagccgggctggagcgcgcacccggcactgaggcttcgctgctctcggagcgctcagaccgcggccgccgcagccggcgaaagaggcaaagtcccgcacgccggaggacatgcgcctcggctagcggccccgggccccaccaccgtgcggctttctccagattattcctctctcgctgtctctgactgtctctctctgtctctgtctctgtctctctctctctcacacacacacacacacacacaaacacacatacgcacgcacgatctcacttcgatctatacactggaggattaaaacaaacaaacaaaaaaaacatttccttcgctccccctccctctccactctgagaagcagaggagccgcacggcgaggggccgcagaccgtctggaaatgcgaatcctaaagcgtttcctcgcttgcattcagctcctctgtgtttgccgcctggattgggctaatggatactacagacaacagagaaaacttgttgaagagattggctggtcctatacaggagcactgaatcaaaaaaattggggaaagaaatatccaacatgtaatagcccaaaacaatctcctatcaatattgatgaagatcttacacaagtaaatgtgaatcttaagaaacttaaatttcagggttgggataaaacatcattggaaaacacattcattcataacactgggaaaacagtggaaattaatctcactaatgactaccgtgtcagcggaggagtttcagaaatggtgtttaaagcaagcaagataacttttcactggggaaaatgcaatatgtcatctgatggatcagagcatagtttagaaggacaaaaatttccacttgagatgcaaatctactgctttgatgcggaccgattttcaagttttgaggaagcagtcaaaggaaaagggaagttaagagctttatccattttgtttgaggttgggacagaagaaaatttggatttcaaagcgattattgatggagtcgaaagtgttagtcgttttgggaagcaggctgctttagatccattcatactgttgaaccttctgccaaactcaactgacaagtattacatttacaatggctcattgacatctcctccctgcacagacacagttgactggattgtttttaaagatacagttagcatctctgaaagccagttggctgttttttgtgaagttcttacaatgcaacaatctggttatgtcatgctgatggactacttacaaaacaattttcgagagcaacagtacaagttctctagacaggtgttttcctcatacactggaaaggaagagattcatgaagcagtttgtagttcagaaccagaaaatgttcaggctgacccagagaattataccagccttcttgttacatgggaaagacctcgagtcgtttatgataccatgattgagaagtttgcagttttgtaccagcagttggatggagaggaccaaaccaagcatgaatttttgacagatggctatcaagacttgggtgctattctcaataatttgctacccaatatgagttatgttcttcagatagtagccatatgcactaatggcttatatggaaaatacagcgaccaactgattgtcgacatgcctactgataatcctgaacttgatcttttccctgaattaattggaactgaagaaataatcaaggaggaggaagagggaaaagacattgaagaaggcgctattgtgaatcctggtagagacagtgctacaaaccaaatcaggaaaaaggaaccccagatttctaccacaacacactacaatcgcatagggacgaaatacaatgaagccaagactaaccgatccccaacaagaggaagtgaattctctggaaagggtgatgttcccaatacatctttaaattccacttcccaaccagtcactaaattagccacagaaaaagatatttccttgacttctcagactgtgactgaactgccacctcacactgtggaaggtacttcagcctctttaaatgatggctctaaaactgttcttagatctccacatatgaacttgtcggggactgcagaatccttaaatacagtttctataacagaatatgaggaggagagtttattgaccagtttcaagcttgatactggagctgaagattcttcaggctccagtcccgcaacttctgctatcccattcatctctgagaacatatcccaagggtatatattttcctccgaaaacccagagacaataacatatgatgtccttataccagaatctgctagaaatgcttccgaagattcaacttcatcaggttcagaagaatcactaaaggatccttctatggagggaaatgtgtggtttcctagctctacagacataacagcacagcccgatgttggatcaggcagagagagctttctccagactaattacactgagatacgtgttgatgaatctgagaagacaaccaagtccttttctgcaggcccagtgatgtcacagggtccctcagttacagatctggaaatgccacattattctacctttgcctacttcccaactgaggtaacacctcatgcttttaccccatcctccagacaacaggatttggtctccacggtcaacgtggtatactcgcagacaacccaaccggtatacaatggtgagacacctcttcaaccttcctacagtagtgaagtctttcctctagtcacccctttgttgcttgacaatcagatcctcaacactacccctgctgcttcaagtagtgattcggccttgcatgctacgcctgtatttcccagtgtcgatgtgtcatttgaatccatcctgtcttcctatgatggtgcacctttgcttccattttcctctgcttccttcagtagtgaattgtttcgccatctgcatacagtttctcaaatccttccacaagttacttcagctaccgagagtgataaggtgcccttgcatgcttctctgccagtggctgggggtgatttgctattagagcccagccttgctcagtattctgatgtgctgtccactactcatgctgcttcagagacgctggaatttggtagtgaatctggtgttctttataaaacgcttatgttttctcaagttgaaccacccagcagtgatgccatgatgcatgcacgttcttcagggcctgaaccttcttatgccttgtctgataatgagggctcccaacacatcttcactgtttcttacagttctgcaatacctgtgcatgattctgtgggtgtaacttatcagggttccttatttagcggccctagccatataccaatacctaagtcttcgttaataaccccaactgcatcattactgcagcctactcatgccctctctggtgatggggaatggtctggagcctcttctgatagtgaatttcttttacctgacacagatgggctgacagcccttaacatttcttcacctgtttctgtagctgaatttacatatacaacatctgtgtttggtgatgataataaggcgctttctaaaagtgaaataatatatggaaatgagactgaactgcaaattccttctttcaatgagatggtttacccttctgaaagcacagtcatgcccaacatgtatgataatgtaaataagttgaatgcgtctttacaagaaacctctgtttccatttctagcaccaagggcatgtttccagggtcccttgctcataccaccactaaggtttttgatcatgagattagtcaagttccagaaaataacttttcagttcaacctacacatactgtctctcaagcatctggtgacacttcgcttaaacctgtgcttagtgcaaactcagagccagcatcctctgaccctgcttctagtgaaatgttatctccttcaactcagctcttattttatgagacctcagcttcttttagtactgaagtattgctacaaccttcctttcaggcttctgatgttgacaccttgcttaaaactgttcttccagctgtgcccagtgatccaatattggttgaaacccccaaagttgataaaattagttctacaatgttgcatctcattgtatcaaattctgcttcaagtgaaaacatgctgcactctacatctgtaccagtttttgatgtgtcgcctacttctcatatgcactctgcttcacttcaaggtttgaccatttcctatgcaagtgagaaatatgaaccagttttgttaaaaagtgaaagttcccaccaagtggtaccttctttgtacagtaatgatgagttgttccaaacggccaatttggagattaaccaggcccatcccccaaaaggaaggcatgtatttgctacacctgttttatcaattgatgaaccattaaatacactaataaataagcttatacattccgatgaaattttaacctccaccaaaagttctgttactggtaaggtatttgctggtattccaacagttgcttctgatacatttgtatctactgatcattctgttcctataggaaatgggcatgttgccattacagctgtttctccccacagagatggttctgtaacctcaacaaagttgctgtttccttctaaggcaacttctgagctgagtcatagtgccaaatctgatgccggtttagtgggtggtggtgaagatggtgacactgatgatgatggtgatgatgatgatgatgacagaggtagtgatggcttatccattcataagtgtatgtcatgctcatcctatagagaatcacaggaaaaggtaatgaatgattcagacacccacgaaaacagtcttatggatcagaataatccaatctcatactcactatctgagaattctgaagaagataatagagtcacaagtgtatcctcagacagtcaaactggtatggacagaagtcctggtaaatcaccatcagcaaatgggctatcccaaaagcacaatgatggaaaagaggaaaatgacattcagactggtagtgctctgcttcctctcagccctgaatctaaagcatgggcagttctgacaagtgatgaagaaagtggatcagggcaaggtacctcagatagccttaatgagaatgagacttccacagatttcagttttgcagacactaatgaaaaagatgctgatgggatcctggcagcaggtgactcagaaataactcctggattcccacagtccccaacatcatctgttactagcgagaactcagaagtgttccacgtttcagaggcagaggccagtaatagtagccatgagtctcgtattggtctagctgaggggttggaatccgagaagaaggcagttataccccttgtgatcgtgtcagccctgacttttatctgtctagtggttcttgtgggtattctcatctactggaggaaatgcttccagactgcacacttttacttagaggacagtacatcccctagagttatatccacacctccaacacctatctttccaatttcagatgatgtcggagcaattccaataaagcactttccaaagcatgttgcagatttacatgcaagtagtgggtttactgaagaatttgagacactgaaagagttttaccaggaagtgcagagctgtactgttgacttaggtattacagcagacagctccaaccacccagacaacaagcacaagaatcgatacataaatatcgttgcctatgatcatagcagggttaagctagcacagcttgctgaaaaggatggcaaactgactgattatatcaatgccaattatgttgatggctacaacagaccaaaagcttatattgctgcccaaggcccactgaaatccacagctgaagatttctggagaatgatatgggaacataatgtggaagttattgtcatgataacaaacctcgtggagaaaggaaggagaaaatgtgatcagtactggcctgccgatgggagtgaggagtacgggaactttctggtcactcagaagagtgtgcaagtgcttgcctattatactgtgaggaattttactctaagaaacacaaaaataaaaaagggctcccagaaaggaagacccagtggacgtgtggtcacacagtatcactacacgcagtggcctgacatgggagtaccagagtactccctgccagtgctgacctttgtgagaaaggcagcctatgccaagcgccatgcagtggggcctgttgtcgtccactgcagtgctggagttggaagaacaggcacatatattgtgctagacagtatgttgcagcagattcaacacgaaggaactgtcaacatatttggcttcttaaaacacatccgttcacaaagaaattatttggtacaaactgaggagcaatatgtcttcattcatgatacactggttgaggccatacttagtaaagaaactgaggtgctggacagtcatattcatgcctatgttaatgcactcctcattcctggaccagcaggcaaaacaaagctagagaaacaattccagctcctgagccagtcaaatatacagcagagtgactattctgcagccctaaagcaatgcaacagggaaaagaatcgaacttcttctatcatccctgtggaaagatcaagggttggcatttcatccctgagtggagaaggcacagactacatcaatgcctcctatatcatgggctattaccagagcaatgaattcatcattacccagcaccctctccttcataccatcaaggatttctggaggatgatatgggaccataatgcccaactggtggttatgattcctgatggccaaaacatggcagaagatgaatttgtttactggccaaataaagatgagcctataaattgtgagagctttaaggtcactcttatggctgaagaacacaaatgtctatctaatgaggaaaaacttataattcaggactttatcttagaagctacacaggatgattatgtacttgaagtgaggcactttcagtgtcctaaatggccaaatccagatagccccattagtaaaacttttgaacttataagtgttataaaagaagaagctgccaatagggatgggcctatgattgttcatgatgagcatggaggagtgacggcaggaactttctgtgctctgacaacccttatgcaccaactagaaaaagaaaattccgtggatgtttaccaggtagccaagatgatcaatctgatgaggccaggagtctttgctgacattgagcagtatcagtttctctacaaagtgatcctcagccttgtgagcacaaggcaggaagagaatccatccacctctctggacagtaatggtgcagcattgcctgatggaaatatagctgagagcttagagtctttagtttaacacagaaaggggtgggggaactcacatctgagcattgttttcctcttcctaaaattaggcaggaaaatcagtctagttctgttatctgttgatttcccatcacctgacagtaactttcatgacataggattctgccgccaaatttatatcattaacaatgtgtgcctttttgcaagacttgtaatttacttattatgtttgaactaaaatgattgaattttacagtatttctaagaatggaattgtggtatttttttctgtattgattttaacagaaaatttcaatttatagaggttaggaattccaaactacagaaaatgtttgtttttagtgtcaaatttttagctgtatttgtagcaattatcaggtttgctagaaatataacttttaatacagtagcctgtaaataaaacactcttccatatgatattcaacattttacaactgcagtattcacctaaagtagaaataatctgttacttattgtaaatactgccctagtgtctccatggaccaaatttatatttataattgtagatttttatattttactactgagtcaagttttctagttctgtgtaattgtttagtttaatgacgtagttcattagctggtcttactctaccagttttctgacattgtattgtgttacctaagtcattaactttgtttcagcatgtaattttaacttttgtggaaaatagaaataccttcattttgaaagaagtttttatgagaataacaccttaccaaacattgttcaaatggtttttatccaaggaattgcaaaaataaatataaatattgccattaaaaaaaaaaaa

SEQ ID NO: 5488 - DNA, 4615 bp, Homo sapiens
ggacacaaccctgagatttatccctcacaatgcggaaagacagacttcttcatttatgtcttgtgctacttcttatcctgctttctgccagtgactcaaactctacagaaccgcagtatatggtgctggtcccctccctgctccacactgaggcccctaagaagggctgtgtccttctgagccacctgaatgagacagtgactgtaagtgcttccttggagtctggcagggaaaacaggagcctcttcactgacctggtggcggagaaggacttattccactgtgtctccttcactctcccaaggatctcagcctcttcagaggtggcattccttagcatccagataaaggggcctacgcaagatttcaggaagaggaacacagttctggtactgaacacccaaagtctggtctttgtccagacagacaaacccatgtataaaccaggacagacagtaagattccgtgttgtctccgtggatgaaaattttcgccctcgaaatgaactgattccactgatataccttgagaacccaagaagaaatcgaattgcacaatggcagagtctcaagctagaagctggcatcaatcagttgtcctttcccctctcatcagagcccattcagggctcctacagggtggtggtacagacagaatcaggtggaaggatacagcaccccttcaccgtggaggaatttgtgcttcccaagtttgaggtcaaagttcaggtgccaaagataatcagtatcatggatgaaaaagtgaacataacagtctgtggagaatacacttatgggaagcctgtcccaggacttgcaactgtgagcctgtgtagaaaattatctcgtgttcttaattgtgacaagcaggaggtctgtgaggaattcagtcaacagcttaacagcaatggctgcatcacccaacaagtacacaccaaaatgctccagattacaaatacgggctttgaaatgaagcttagagtggaagccaggatcagagaagaggggacagacctggaagtcactgcaaacaggatcagtgaaatcacaaacattgtatccaaactcaaattcgtgaaagtggattcacactttagacaaggaatccccttttttgcacaggtgcttctggtggatggaaaaggtgtgcccatccccaataaactcttcttcatctctgtgaatgacgccaattattactccaatgcaaccaccaatgagcagggtcttgcacagttttcaatcaatactaccagtatctcggttaataaactttttgtccgggttttcactgtgcatcccaacttgtgttttcactattcatgggtagcagaagaccaccagggtgctcagcacactgcaaatcgtgttttctccttaagtggaagttacattcacctggagcctgtggctggtaccctgccctgtggccacacggagactatcacggcacactatacactgaatagacaggccatgggagagttatcggagctcagtttccattacctgatcatggctaagggagtcatcgtcagatctggaacccacactctgcctgtggagtcaggagacatgaaaggcagttttgccttatccttccctgtggagtcagacgttgcccccattgcacgaatgttcatctttgccattttaccagatggagaagttgttggagactctgaaaaatttgagattgaaaactgtctagccaacaaggtggatttgagcttcagcccagcacaaagtcccccagcctcacatgcccacctgcaagtagcagctgctccgcagtccctctgtgcccttcgtgctgtggaccaaagtgtgctgctcatgaagcctgaggctgagctctctgtgtcctcagtatataatctgctaactgtgaaggatctcaccaattttcctgacaatgtggaccagcaggaggaagaacaaggacactgtccccgtcctttcttcattcataatggagccatctatgttcccttatcaagtaatgaagcagatatttatagcttcctcaaggggatgggattgaaggtgttcactaactcaaaaatccgaaaaccaaagtcgtgttcagtcatcccttccgtgtctgcaggagcagtaggtcaaggatactatggagcaggtctaggagtagtagagagaccatatgttcctcaattaggcacatataatgtgatacccttaaataatgaacaaagttcagggccagtccctgaaacggtgcgaagctattttcctgagacttggatctgggagttggtggcagtgaactcatcaggtgtggctgaggtaggagtaacagtccctgacaccatcaccgagtggaaggcaggggccttctgcctgtccgaagatgctggacttggtatctcttccactgcctctctccgagccttccagcccttctttgtggagctcacaatgccttactctgtgattcgtggagaggtcttcacactcaaggccacggtcctaaactaccttcccaaatgcatccgggtcagtgtgcagctgaaagcctctccagccttcctagcttcccaaaatacaaagggagaagaatcctattgtatctgtggaaatgagagacaaaccttgtcttggacagtgactcctaaaactctggggaatgtgaacttctcagtgagtgcagaggcaatgcagtccttagaactctgtggaaatgaggttgttgaggtccctgagattaaaagaaaagacacagtcatcaaaaccctgttggtggaggctgaaggtattgagcaagaaaagactttcagttctatgacctgtgcctcaggtgctaatgtgtctgagcagttgtccttgaagctcccatcaaatgtggtcaaagaatctgccagagcttctttctcagttctgggtgacatattaggttctgctatgcaaaatatacaaaatctcctccagatgccatatggctgtggagaacagaacatggtcctatttgctcctaacatctatgtcttgaactatctgaatgaaacccagcagctgacgcaggagatcaaggccaaggccgttggctatctcatcactggttaccagagacagctgaactacaaacaccaagatggctcctacagcacctttggggaacgatatggcaggaaccagggcaacacttggctcacagcttttgtactgaagactttcgcccaggctcgatcctacatcttcattgatgaagcacacattacccaatctctcacgtggctctcccagatgcagaaggacaatggctgtttcaggagctctgggtcactgctcaacaatgccataaagggaggtgtagaagatgaagcgaccctctccgcctatgttactattgcccttctggaaattcctctcccagtcactaaccctattgttcgcaatgccctgttctgcctggagtcagcctggaatgtagcaaaggaggggacccatgggagccatgtctacaccaaggcattgctggcctatgctttttccctactgggaaagcaaaatcagaatagagaaatactgaactcacttgataaggaagctgtgaaagaagacaacctcgtccattgggagcgccctcagagacccaaggcaccagtggggcatctttaccaaacccaggctccctctgctgaggtggagatgacatcctatgtgctcctcgcttatctcacggcccagccagcccccacctcaggggacctgacctctgcaactaacattgtgaagtggatcatgaagcagcagaacgcccaaggtggtttctcctccacccaggacacagtggtggctctccatgccctgtccaggtatggagcagccactttcaccagaactgagaaaactgcacaggtcaccgttcaggattcacagaccttttctacaaatttccaagtagacaacaacaacctcctattactgcagcagatctcattgccagagctccctggagaatatgtcataacagtaactggggaaagatgtgtgtatcttcagacatccatgaaatacaatattcttccagagaaagaggactccccatttgctttaaaagtgcagactgtgccccaaacttgcgatggacacaaagcccacaccagctttcagatctcactgaccatcagttacacaggaaaccgtcctgcttccaatatggtgattgttgatgtaaagatggtatctggttttattcccctgaaaccaacagtaaaaatgcttgaaagatctagctctgtgagccggacagaagtgagcaacaaccatgtcctcatttatgtggaacaggtgacaaatcagacgctaagtttttccttcatggttctgcaagacatcccagtaggagacttgaagccagcaattgttaaagtctatgattactatgagacagatgagtctgtggttgctgagtatatcgccccctgcagcacagatacagagcatggaaatgtttgaggaccatacaggctgtatattttggtggattctctgtcctatacatttacttagaaggaatggagttatttgtctctataaaatagacactaaaaatatttgctgaataaatatgtacttctggtcaaactaaaaaa

SEQ ID NO: 5489 - DNA, 3782 bp, Homo sapiens
ttctgcccttcccccgcttaggggggcgggggtaggggaaaggaaaataatacaatttcaggggaagtcgccttcaggtctgctgcttttttattttttttttttaattaaaaaaaaaaaggacatagaaaacatcagtcttgaacttctcttcaagaacccgggctgcaaaggaaatctcctttgtttttgttatttatgtgctgtcaagttttgaagtggtgatctttagacagtgactgagtatggatcatttgaacgaggcaactcaggggaaagaacattcagaaatgtctaacaatgtgagtgatccgaagggtccaccagccaagattgcccgcctggagcagaacgggagcccgctaggaagaggaaggcttgggagtacaggtgcaaaaatgcagggagtgcctttaaaacactcgggccatctgatgaaaaccaaccttaggaaaggaaccatgctgccagttttctgtgtggtggaacattatgaaaacgccattgaatatgattgcaaggaggagcatgcagaatttgtgctggtgagaaaggatatgcttttcaaccagctgatcgaaatggcattgctgtctctaggttattcacatagctctgctgcccaggccaaagggctaatccaggttggaaagtggaatccagttccactgtcttacgtgacagatgcccctgatgctacagtagcagatatgcttcaagatgtgtatcatgtggtcacattgaaaattcagttacacagttgccccaaactagaagacttgcctcccgaacaatggtcgcacaccacagtgaggaatgctctgaaggacttactgaaagatatgaatcagagttcattggccaaggagtgccccctttcacagagtatgatttcttccattgtgaacagtacttactatgcaaatgtctcagcagcaaaatgtcaagaatttggaaggtggtacaaacatttcaagaagacaaaagatatgatggttgaaatggatagtctttctgagctatcccagcaaggcgccaatcatgtcaattttggccagcaaccagttccagggaacacagccgagcagcctccatcccctgcgcagctctcccatggcagccagccctctgtccggacacctcttccaaacctgcaccctgggctcgtatcaacacctatcagtcctcaattggtcaaccagcagctggtgatggctcagctgctgaaccagcagtatgcagtgaatagacttttagcccagcagtccttaaaccaacaatacttgaaccaccctccccctgtcagtagatctatgaataagcctttggagcaacaggtttcgaccaacacagaggtgtcttccgaaatctaccagtgggtacgcgatgaactgaaacgagcaggaatctcccaggcggtatttgcacgtgtggcttttaacagaactcagggcttgctttcagaaatcctccgaaaggaagaggaccccaagactgcatcccagtctttgctggtaaaccttcgggctatgcagaatttcttgcagttaccggaagctgaaagagaccgaatataccaggacgaaagggaaaggagcttgaatgctgcctcggccatgggtcctgcccccctcatcagcacaccacccagccgtcctccccaggtgaaaacagctactattgccactgaaaggaatgggaaaccagagaacaataccatgaacattaatgcttccatttatgatgagattcagcaggaaatgaagcgtgctaaagtgtctcaagcactgtttgcaaaggttgcagcaaccaaaagccagggatggttgtgcgagctgttacgctggaaagaagatccttctccagaaaacagaaccctgtgggagaacctctccatgatccgaaggttcctcagtcttcctcagccagaacgtgatgccatttatgaacaggagagcaacgcggtgcatcaccatggcgacaggccgccccacattatccatgttccagcagagcagattcagcaacagcagcagcaacagcaacagcagcagcagcagcagcaggcaccgccgcctccacagccacagcagcagccacagacaggccctcggctccccccacggcaacccacggtggcctctccagcagagtcagatgaggaaaaccgacagaagacccggccacgaacaaaaatttcagtggaagccttgggaatcctccagagtttcatacaagacgtgggcctgtaccctgacgaagaggccatccagactctgtctgcccagctcgaccttcccaagtacaccatcatcaagttctttcagaaccagcggtactatctcaagcaccacggcaaactgaaggacaattccggtttagaggtcgatgtggcagaatataaagaagaggagctgctgaaggatttggaagagagtgtccaagataaaaatactaacacccttttttcagtgaaactagaagaagagctgtcagtggaaggaaacacagacattaatactgatttgaaagactgagataaaagtatttgtttcgttcaacagtgccactggtatttactaacaaaatgaaaagtccaccttgtcttctctcagaaaacctttgttgttcattgtttggccaatgaatcttcaaaaacttgcacaaacagaaaagttggaaaaggataatacagactgcactaaatgttttcctctgttttacaaactgcttggcagccccaggtgaagcatcaaggattgtttggtattaaaatttgtgttcacgggatgcaccaaagtgtgtaccccgtaagcatgaaaccagtgttttttgttttttttttagttcttattccggagcctcaaacaagcattataccttctgtgattatgatttcctctcctataattatttctgtagcactccacactgatctttggaaacttgccccttatttaaaaaaaaaaaagaaaaaaaagagtttgttactctattgtatgttacaaaagaactatagactgtggaatgcagtttaaagatgacatatgccaacaaatgccttgtattatatggcactgccgtaattcaaatttgtttttattttggaaataaaagttcactgtacttttttttcattctcattgttacatgattttttaaaaaaaggaaaagaaaatgtgaaacacaatttagtcctcattatttatttgtagatcctgcagcatcatgttgtaattaattttttggaagtttccgttaaatgtaatattgcttctcttgttaccatactgattcttttctatttataaatgtattttgatgggcagtaaaacaaagtgtcttaaaagttttaaatagagaaaatgtgctttacacagttgcctataaaaagtgctctatgttatccaagcaattcatactataagcttcactcttattgttgtatgcaatttttactatcatgcaaataagcttaggtaaataaaactaatagatcaccttagaaaattatgcaattaatgtgaaaataattgatgtttgcaatgtgtcttcctttggtttacaatcaattttaaagctacatctgtataaaatttctgtataaaggtgtatttcttttttatgagtttatggctatgaaaacagctattttgttacagctggctgtttttataagtgtatcacaattttctttatgcagaaatgttctgactaggagtggttattgactgtaactacacaattaaaattgtttgtatcgtaaaaaaaaaaaaaaaaaa

SEQ ID NO: 5490 - DNA, 3304 bp, Homo sapiens
ctgagctctgccgcctggctctagccgcctgcctggcccccgccgggactcttgcccaccctcagccatggctccgatatctctgtcgtggctgctccgcttggccaccttctgccatctgactgtcctgctggctggacagcaccacggtgtgacgaaatgcaacatcacgtgcagcaagatgacatcaaagatacctgtagctttgctcatccactatcaacagaaccaggcatcatgcggcaaacgcgcaatcatcttggagacgagacagcacaggctgttctgtgccgacccgaaggagcaatgggtcaaggacgcgatgcagcatctggaccgccaggctgctgccctaactcgaaatggcggcaccttcgagaagcagatcggcgaggtgaagcccaggaccacccctgccgccgggggaatggacgagtctgtggtcctggagcccgaagccacaggcgaaagcagtagcctggagccgactccttcttcccaggaagcacagagggccctggggacctccccagagctgccgacgggcgtgactggttcctcagggaccaggctccccccgacgccaaaggctcaggatggagggcctgtgggcacggagcttttccgagtgcctcccgtctccactgccgccacgtggcagagttctgctccccaccaacctgggcccagcctctgggctgaggcaaagacctctgaggccccgtccacccaggacccctccacccaggcctccactgcgtcctccccagccccagaggagaatgctccgtctgaaggccagcgtgtgtggggtcagggacagagccccaggccagagaactctctggagcgggaggagatgggtcccgtgccagcgcacacggatgccttccaggactgggggcctggcagcatggcccacgtctctgtggtccctgtctcctcagaagggacccccagcagggagccagtggcttcaggcagctggacccctaaggctgaggaacccatccatgccaccatggacccccagaggctgggcgtccttatcactcctgtccctgacgcccaggctgccacccggaggcaggcggtggggctgctggccttccttggcctcctcttctgcctgggggtggccatgttcacctaccagagcctccagggctgccctcgaaagatggcaggagagatggcggagggccttcgctacatcccccggagctgtggtagtaattcatatgtcctggtgcccgtgtgaactcctctggcctgtgtctagttgtttgattcagacagctgcctgggatccctcatcctcatacccacccccacccaagggcctggcctgagctgggatgattggaggggggaggtgggatcctccaggtgcacaagctccaagctcccaggcattccccaggaggccagccttgaccattctccaccttccagggacagagggggtggcctcccaactcaccccagccccaaaactctcctctgctgctggctggttagaggttccctttgacgccatcccagccccaatgaacaattatttattaaatgcccagccccttctgacccatgctgccctgtgagtactacagtcctcccatctcacacatgagcatcaggccaggccctctgcccactccctgcaacctgattgtgtctcttggtcctgctgcagttgccagtcaccccggccacctgcggtgctatctcccccagccccatcctctgtacagagcccacgcccccactggtgacatgtcttttcttgcatgaggctagtgtggtgtttcctggcactgcttccagtgaggctctgcccttggttaggcattgtgggaaggggagataagggtatctggtgactttcctctttggtctacactgtgctgagtctgaaggctgggttctgatcctagttccaccatcaagccaccaacatactcccatctgtgaaaggaaagagggaggtaaggaatacctgtccccctgacaacactcattgacctgaggcccttctctccagcccctggatgcagcctcacagtccttaccagcagagcaccttagacagtccctgccaatggactaacttgtctttggaccctgaggcccagagggcctgcaagggagtgagttgatagcacagaccctgccctgtgggcccccaaatggaaatgggcagagcagagaccatccctgaaggccccgcccaggcttagtcactgagacagcccgggctctgcctcccatcacccgctaagagggagggagggctccagacacatgtccaagaagcccaggaaaggctccaggagcagccacattcctgatgcttcttcagagactcctgcaggcagccaggccacaagacccttgtggtcccaccccacacacgccagattctttcctgaggctgggctcccttcccacctctctcactccttgaaaacactgttctctgccctccaagaccttctccttcacctttgtccccaccgcagacaggaccagggatttccatgatgttttccatgagtcccctgtttgtttctgaaagggacgctacccgggaagggggctgggacatgggaaaggggaagttgtaggcataaagtcaggggttcccttttttggctgctgaaggctcgagcatgcctggatggggctgcaccggctggcctggcccctcagggtccctggtggcagctcacctctcccttggattgtccccgacccttgccgtctacctgaggggcctcttatgggctgggttctacccaggtgctaggaacactccttcacagatgggtgcttggaggaaggaaacccagctctggtccatagagagcaagacgctgtgctgccctgcccacctggcctctgcactcccctgctgggtgtggcgcagcatattcaggaagctcagggcctggctcaggtggggtcactctggcagctcagagagggtgggagtgggtccaatgcactttgttctggctcttccaggctgggagagcctttcaggggtgggacaccctgtgatggggccctgcctcctttgtgaggaagccgctggggccagttggtcccccttccatggactttgttagtttctccaagcaggacatggacaaggatgatctaggaagactttggaaagagtaggaagactttggaaagacttttccaaccctcatcaccaacgtctgtgccattttgtattttactaataaaatttaaaagtcttgtgaaaaaaaaaaaaaaaaaaaaaaaaaaaaaaaaa

SEQ ID NO: 5491 - DNA, 4465 bp, Homo sapiens
cctgcagcctccggagtcagtgccgcgcgcccgccgccccgcgccttcctgctcgccgcacctccgggagccggggcgcacccagcccgcagcgccgcctccccgcccgcgccgcctccgaccgcaggccgagggccgccactggccggggggaccgggcagcagcttgcggccgcggagccgggcaacgctggggactgcgccttttgtccccggaggtccctggaagtttgcggcaggacgcgcgcggggaggcggcggaggcagccccgacgtcgcggagaacagggcgcagagccggcatgggcatcgggcgcagcgaggggggccgccgcggggcagccctgggcgtgctgctggcgctgggcgcggcgcttctggccgtgggctcggccagcgagtacgactacgtgagcttccagtcggacatcggcccgtaccagagcgggcgcttctacaccaagccacctcagtgcgtggacatccccgcggacctgcggctgtgccacaacgtgggctacaagaagatggtgctgcccaacctgctggagcacgagaccatggcggaggtgaagcagcaggccagcagctgggtgcccctgctcaacaagaactgccacgccggcacccaggtcttcctctgctcgctcttcgcgcccgtctgcctggaccggcccatctacccgtgtcgctggctctgcgaggccgtgcgcgactcgtgcgagccggtcatgcagttcttcggcttctactggcccgagatgcttaagtgtgacaagttccccgagggggacgtctgcatcgccatgacgccgcccaatgccaccgaagcctccaagccccaaggcacaacggtgtgtcctccctgtgacaacgagttgaaatctgaggccatcattgaacatctctgtgccagcgagtttgcactgaggatgaaaataaaagaagtgaaaaaagaaaatggcgacaagaagattgtccccaagaagaagaagcccctgaagttggggcccatcaagaagaaggacctgaagaagcttgtgctgtacctgaagaatggggctgactgtccctgccaccagctggacaacctcagccaccacttcctcatcatgggccgcaaggtgaagagccagtacttgctgacggccatccacaagtgggacaagaaaaacaaggagttcaaaaacttcatgaagaaaatgaaaaaccatgagtgccccacctttcagtccgtgtttaagtgattctcccgggggcagggtggggagggagcctcgggtggggtgggagcgggggggacagtgccccgggaacccggtgggtcacacacacgcactgcgcctgtcagtagtggacattgtaatccagtcggcttgttcttgcagcattcccgctcccttccctccatagccacgctccaaaccccagggtagccatggccgggtaaagcaagggccatttagattaggaaggtttttaagatccgcaatgtggagcagcagccactgcacaggaggaggtgacaaaccatttccaacagcaacacagccactaaaacacaaaaagggggattgggcggaaagtgagagccagcagcaaaaactacattttgcaacttgttggtgtggatctattggctgatctatgcctttcaactagaaaattctaatgattggcaagtcacgttgttttcaggtccagagtagtttctttctgtctgctttaaatggaaacagactcataccacacttacaattaaggtcaagcccagaaagtgataagtgcagggaggaaaagtgcaagtccattatgtaatagtgacagcaaagggaccaggggagaggcattgccttctctgcccacagtctttccgtgtgattgtctttgaatctgaatcagccagtctcagatgccccaaagtttcggttcctatgagcccggggcatgatctgatccccaagacatgtggaggggcagcctgtgcctgcctttgtgtcagaaaaaggaaaccacagtgagcctgagagagacggcgattttcgggctgagaaggcagtagttttcaaaacacatagttaaaaaagaaacaaatgaaaaaaattttagaacagtccagcaaattgctagtcagggtgaattgtgaaattgggtgaagagcttaggattctaatctcatgttttttccttttcacatttttaaaagaacaatgacaaacacccacttatttttcaaggttttaaaacagtctacattgagcatttgaaaggtgtgctagaacaaggtctcctgatccgtccgaggctgcttcccagaggagcagctctccccaggcatttgccaagggaggcggatttccctggtagtgtagctgtgtggctttccttcctgaagagtccgtggttgccctagaacctaacaccccctagcaaaactcacagagctttccgtttttttctttcctgtaaagaaacatttcctttgaacttgattgcctatggatcaaagaaattcagaacagcctgcctgtccccccgcactttttacatatatttgtttcatttctgcagatggaaagttgacatgggtggggtgtccccatccagcgagagagtttcaaaagcaaaacatctctgcagtttttcccaagtaccctgagatacttcccaaagcccttatgtttaatcagcgatgtatataagccagttcacttagacaactttacccttcttgtccaatgtacaggaagtagttctaaaaaaaatgcatattaatttcttcccccaaagccggattcttaattctctgcaacactttgaggacatttatgattgtccctctgggccaatgcttatacccagtgaggatgctgcagtgaggctgtaaagtggccccctgcggccctagcctgacccggaggaaaggatggtagattctgttaactcttgaagactccagtatgaaaatcagcatgcccgcctagttacctaccggagagttatcctgataaattaacctctcacagttagtgatcctgtccttttaacaccttttttgtggggttctctctgacctttcatcgtaaagtgctggggaccttaagtgatttgcctgtaattttggatgattaaaaaatgtgtatatatattagctaattagaaatattctacttctctgttgtcaaactgaaattcagagcaagttcctgagtgcgtggatctgggtcttagttctggttgattcactcaagagttcagtgctcatacgtatctgctcattttgacaaagtgcctcatgcaaccgggccctctctctgcggcagagtccttagtggaggggtttacctggaacattagtagttaccacagaatacggaagagcaggtgactgtgctgtgcagctctctaaatgggaattctcaggtaggaagcaacagcttcagaaagagctcaaaataaattggaaatgtgaatcgcagctgtgggttttaccaccgtctgtctcagagtcccaggaccttgagtgtcattagttactttattgaaggttttagacccatagcagctttgtctctgtcacatcagcaatttcagaaccaaaagggaggctctctgtaggcacagagctgcactatcacgagcctttgtttttctccacaaagtatctaacaaaaccaatgtgcagactgattggcctggtcattggtctccgagagaggaggtttgcctgtgatttcctaattatcgctagggccaaggtgggatttgtaaagctttacaataatcattctggatagagtcctgggaggtccttggcagaactcagttaaatctttgaagaatatttgtagttatcttagaagatagcatgggaggtgaggattccaaaaacattttatttttaaaatatcctgtgtaacacttggctcttggtacctgtgggttagcatcaagttctccccagggtagaattcaatcagagctccagtttgcatttggatgtgtaaattacagtaatcccatttcccaaacctaaaatctgtttttctcatcagactctgagtaactggttgctgtgtcataacttcatagatgcaggaggctcaggtgatctgtttgaggagagcaccctaggcagcctgcagggaataacatactggccgttctgacctgttgccagcagatacacaggacatggatgaaattcccgtttcctctagtttcttcctgtagtactcctcttttagatcctaagtctcttacaaaagctttgaatactgtgaaaatgttttacattccatttcatttgtgttgtttttttaactgcattttaccagatgttttgatgttatcgcttatgttaatagtaattcccgtacgtgttcattttattttcatgctttttcagccatgtatcaatattcacttgactaaaatcactcaattaatcaatgaaaaaaaaaaa

SEQ ID NO: 5492 - DNA, 1299 bp, Homo sapiens
agtttgcttggagctcctggggcctaacaaaaagaaacctgccatgctgctcttcctcctctctgcactggtcctgctcacacagcccctgggctacctggaagcagaaatgaagacctactcccacagaacaatgcccagtgcttgcaccctggtcatgtgtagctcagtggagagtggcctgcctggtcgcgatggacgggatgggagagagggccctcggggcgagaagggggacccaggtttgccaggagctgcagggcaagcagggatgcctggacaagctggcccagttgggcccaaaggggacaatggctctgttggagaacctggaccaaagggagacactgggccaagtggacctccaggacctcccggtgtgcctggtccagctggaagagaaggtcccctggggaagcaggggaacataggacctcagggcaagccaggcccaaaaggagaagctgggcccaaaggagaagtaggtgccccaggcatgcagggctcggcaggggcaagaggcctcgcaggccctaagggagagcgaggtgtccctggtgagcgtggagtccctggaaacacaggggcagcagggtctgctggagccatgggtccccagggaagtccaggtgccaggggacccccgggattgaagggggacaaaggcattcctggagacaaaggagcaaagggagaaagtgggcttccagatgttgcttctctgaggcagcaggttgaggccttacagggacaagtacagcacctccaggctgctttctctcagtataagaaagttgagctcttcccaaatggccaaagtgtcggggagaagattttcaagacagcaggctttgtaaaaccatttacggaggcacagctgctgtgcacacaggctggtggacagttggcctctccacgctctgccgctgagaatgccgccttgcaacagctggtcgtagctaagaacgaggctgctttcctgagcatgactgattccaagacagagggcaagttcacctaccccacaggagagtccctggtctattccaactgggccccaggggagcccaacgatgatggcgggtcagaggactgtgtggagatcttcaccaatggcaagtggaatgacagggcttgtggagaaaagcgtcttgtggtctgcgagttctgagccaactggggtgggtggggcagtgcttggcccaggagtttggccagaagtcaaggcttagaccctcatgctgccaatatcctaataaaaaggtgaccatctgtgccgggaaaaaaaaaaaaaaaaaa

SEQ ID NO: 5493 - DNA, 5758 bp, Homo sapiens
tttctgtactctgggtgactcagagagggaagagattcagccagcacactcctcgcgagcaagcattactctactgactggcagagacaggagaggtagatgtccacgcccacagaccctggtgcgatgccccacccagggccttcgccggggcctgggccttcccctgggccaattcttgggcctagtccaggaccaggaccatccccaggttccgtccacagcatgatggggccaagtcctggacctccaagtgtctcccatcctatgccgacgatggggtccacagacttcccacaggaaggcatgcatcaaatgcataagcccatcgatggtatacatgacaaggggattgtagaagacatccattgtggatccatgaagggcactggtatgcgaccacctcacccaggcatgggccctccccagagtccaatggatcaacacagccaaggttatatgtcaccacacccatctccattaggagccccagagcacgtctccagccctatgtctggaggaggcccaactccacctcagatgccaccaagccagccgggggccctcatcccaggtgatccgcaggccatgagccagcccaacagaggtccctcacctttcagtcctgtccagctgcatcagcttcgagctcagattttagcttataaaatgctggcccgaggccagcccctccccgaaacgctgcagcttgcagtccaggggaaaaggacgttgcctggcttgcagcaacaacagcagcagcaacagcagcagcagcagcagcagcagcagcagcagcagcagcaacagcagccgcagcagcagccgccgcaaccacagacgcagcaacaacagcagccggcccttgttaactacaacagaccatctggcccggggccggagctgagcggcccgagcaccccgcagaagctgccggtgcccgcgcccggcggccggccctcgcccgcgccccccgcagccgcgcagccgcccgcggccgcagtgcccgggccctcagtgccgcagccggccccggggcagccctcgcccgtcctccagctgcagcagaagcagagccgcatcagccccatccagaaaccgcaaggcctggaccccgtggaaattctgcaagagcgggaatacagacttcaggcccgcatagctcataggatacaagaactggaaaatctgcctggctctttgccaccagatttaagaaccaaagcaaccgtggaactaaaagcacttcggttactcaatttccagcgtcagctgagacaggaggtggtggcctgcatgcgcagggacacgaccctggagacggctctcaactccaaagcatacaaacggagcaagcgccagactctgagagaagctcgcatgaccgagaagctggagaagcagcagaagattgagcaggagaggaaacgccgtcagaaacaccaggaatacctgaacagtattttgcaacatgcaaaagattttaaggaatatcatcggtctgtggccggaaagatccagaagctctccaaagcagtggcaacttggcatgccaacactgaaagagagcagaagaaggagacagagcggattgaaaaggagagaatgcggcgactgatggctgaagatgaggagggttatagaaaactgattgatcaaaagaaagacaggcgtttagcttaccttttgcagcagaccgatgagtatgtagccaatctgaccaatctggtttgggagcacaagcaagcccaggcagccaaagagaagaagaagaggaggaggaggaagaagaaggctgaggagaatgcagagggtggggagtctgccctgggaccggatggagagcccatagatgagagcagccagatgagtgacctccctgtcaaagtgactcacacagaaaccggcaaggttctgttcggaccagaagcacccaaagcaagtcagctggacgcctggctggaaatgaatcctggttatgaagttgcccctagatctgacagtgaagagagtgattctgattatgaggaagaggatgaggaagaagagtccagtaggcaggaaaccgaagagaaaatactcctggatccaaatagcgaagaagtttctgagaaggatgctaagcagatcattgagacagctaagcaagacgtggatgatgaatacagcatgcagtacagtgccaggggctcccagtcctactacaccgtggctcatgccatctcggagagggtggagaaacagtctgccctcctaattaatgggaccctaaagcattaccagctccagggcctggaatggatggtttccctgtataataacaacttgaacggaatcttagccgatgaaatggggcttggaaagaccatacagaccattgcactcatcacttatctgatggagcacaaaagactcaatggcccctatctcatcattgttcccctttcgactctatctaactggacatatgaatttgacaaatgggctccttctgtggtgaagatttcttacaagggtactcctgccatgcgtcgctcccttgtcccccagctacggagtggcaaattcaatgtcctcttgactacttatgagtatattataaaagacaagcacattcttgcaaagattcggtggaaatacatgatagtggacgaaggccaccgaatgaagaatcaccactgcaagctgactcaggtcttgaacactcactatgtggcccccagaaggatcctcttgactgggaccccgctgcagaataagctccctgaactctgggccctcctcaacttcctcctcccaacaatttttaagagctgcagcacatttgaacaatggttcaatgctccatttgccatgactggtgaaagggtggacttaaatgaagaagaaactatattgatcatcaggcgtctacataaggtgttaagaccatttttactaaggagactgaagaaagaagttgaatcccagcttcccgaaaaagtggaatatgtgatcaagtgtgacatgtcagctctgcagaagattctgtatcgccatatgcaagccaaggggatccttctcacagatggttctgagaaagataagaaggggaaaggaggtgctaagacacttatgaacactattatgcagttgagaaaaatctgcaaccacccatatatgtttcagcacattgaggaatcctttgctgaacacctaggctattcaaatggggtcatcaatggggctgaactgtatcgggcctcagggaagtttgagctgcttgatcgtattctgccaaaattgagagcgactaatcaccgagtgctgcttttctgccagatgacatctctcatgaccatcatggaggattattttgcttttcggaacttcctttacctacgccttgatggcaccaccaagtctgaagatcgtgctgctttgctgaagaaattcaatgaacctggatcccagtatttcattttcttgctgagcacaagagctggtggcctgggcttaaatcttcaggcagctgatacagtggtcatctttgacagcgactggaatcctcatcaggatctgcaggcccaagaccgagctcaccgcatcgggcagcagaacgaggtccgggtactgaggctctgtaccgtgaacagcgtggaggaaaagatcctcgcggccgcaaaatacaagctgaacgtggatcagaaagtgatccaggcgggcatgtttgaccaaaagtcttcaagccacgagcggagggcattcctgcaggccatcttggagcatgaggaggaaaatgaggaagaagatgaagtaccggacgatgagactctgaaccaaatgattgctcgacgagaagaagaatttgacctttttatgcggatggacatggaccggcggagggaagatgcccggaacccgaaacggaagccccgtttaatggaggaggatgagctgccctcctggatcattaaggatgacgctgaagtagaaaggctcacctgtgaagaagaggaggagaaaatatttgggagggggtcccgccagcgccgtgacgtggactacagtgacgccctcacggagaagcagtggctaagggccatcgaagacggcaatttggaggaaatggaagaggaagtacggcttaagaagcgaaaaagacgaagaaatgtggataaagatcctgcaaaagaagatgtggaaaaagctaagaagagaagaggccgccctcccgctgagaaactgtcaccaaatccccccaaactgacaaagcagatgaacgctatcatcgatactgtgataaactacaaagataggtgtaacgtggagaaggtgcccagtaattctcagttggaaatagaaggaaacagttcagggcgacagctcagtgaagtcttcattcagttaccttcaaggaaagaattaccagaatactatgaattaattaggaagccagtggatttcaaaaaaataaaggaaaggattcgtaatcataagtaccggagcctaggcgacctggagaaggatgtcatgcttctctgtcacaacgctcagacgttcaacctggagggatcccagatctatgaagactccatcgtcttacagtcagtgtttaagagtgcccggcagaaaattgccaaagaggaagagagtgaggatgaaagcaatgaagaggaggaagaggaagatgaagaagagtcagagtccgaggcaaaatcagtcaaggtgaaaattaagctcaataaaaaagatgacaaaggccgggacaaagggaaaggcaagaaaaggccaaatcgaggaaaagccaaacctgtagtgagcgattttgacagcgatgaggagcaggatgaacgtgaacagtcagaaggaagtgggacggatgatgagtgatcagtatggacctttttccttggtagaactgaattccttcctcccctgtctcatttctacccagtgagttcatttgtcatataggcactgggttgtttctatatcatcatcgtctataaactagctttaggatagtgccagacaaacatatgatatcatggtgtaaaaaacacacacatacacaaatatttgtaacatattgtgaccaaatgggcctcaaagattcagattgaaacaaacaaaaagcttttgatggaaaatatgtgggtggatagtatatttctatgggtgggtctaatttggtaacggtttgattgtgcctggttttatcacctgttcagatgagaagatttttgtcttttgtagcactgataaccaggagaagccattaaaagccactggttattttatttttcatcaggcaattttcgaggtttttatttgttcggtattgtttttttacactgtggtacatataagcaactttaataggtgataaatgtacagtagttagatttcacctgcatatacatttttccattttatgctctatgatctgaacaaaagctttttgaattgtataagatttatgtctactgtaaacattgcttaatttttttgctcttgatttaaaaaaaagttttgttgaaagcgctattgaatattgcaatctatatagtgtattggatggcttcttttgtcaccctgatctcctatgttaccaatgtgtatcgtctccttctccctaaagtgtacttaatctttgctttctttgcacaatgtctttggttgcaagtcataagcctgaggcaaataaaattccagtaatttcgaagaatgtggtgttggtgctttcctaataaagaaataatttagcttgacaaaa

SEQ ID NO: 5494 - DNA, 4264 bp, Homo sapiens
agccgccttcctatttccgcccggcgggcagcgctgcggggcgagtgccagcagagaggcgctcggtcctccctccgccctcccgcgccgggggcaggccctgcctagtctgcgtctttttcccccgcaccgcggcgccgctccgccactcgggcaccgcaggtagggcaggaggctggagagcctgctgcccgcccgcccgtaaaatggtcccctcggctggacagctcgccctgttcgctctgggtattgtgttggctgcgtgccaggccttggagaacagcacgtccccgctgagtgcagacccgcccgtggctgcagcagtggtgtcccattttaatgactgcccagattcccacactcagttctgcttccatggaacctgcaggtttttggtgcaggaggacaagccagcatgtgtctgccattctgggtacgttggtgcacgctgtgagcatgcggacctcctggccgtggtggctgccagccagaagaagcaggccatcaccgccttggtggtggtctccatcgtggccctggctgtccttatcatcacatgtgtgctgatacactgctgccaggtccgaaaacactgtgagtggtgccgggccctcatctgccggcacgagaagcccagcgccctcctgaagggaagaaccgcttgctgccactcagaaacagtggtctgaagagcccagaggaggagtttggccaggtggactgtggcagatcaataaagaaaggcttcttcaggacagcactgccagagatgcctgggtgtgccacagaccttcctacttggcctgtaatcacctgtgcagccttttgtgggccttcaaaactctgtcaagaactccgtctgcttggggttattcagtgtgacctagagaagaaatcagcggaccacgatttcaagacttgttaaaaaagaactgcaaagagacggactcctgttcacctaggtgaggtgtgtgcagcagttggtgtctgagtccacatgtgtgcagttgtcttctgccagccatggattccaggctatatatttctttttaatgggccacctccccacaacagaattctgcccaacacaggagatttctatagttattgttttctgtcatttgcctactggggaagaaagtgaaggaggggaaactgtttaatatcacatgaagaccctagctttaagagaagctgtatcctctaaccacgagaccctcaaccagcccaacatcttccatggacacatgacattgaagaccatcccaagctatcgccacccttggagatgatgtcttatttattagatggataatggttttatttttaatctcttaagtcaatgtaaaaagtataaaaccccttcagacttctacattaatgatgtatgtgttgctgactgaaaagctatactgattagaaatgtctggcctcttcaagacagctaaggcttgggaaaagtcttccagggtgcggagatggaaccagaggctgggttactggtaggaataaaggtaggggttcagaaatggtgccattgaagccacaaagccggtaaatgcctcaatacgttctgggagaaaacttagcaaatccatcagcagggatctgtcccctctgttggggagagaggaagagtgtgtgtgtctacacaggataaacccaatacatattgtactgctcagtgattaaatgggttcacttcctcgtgagccctcggtaagtatgtttagaaatagaacattagccacgagccataggcatttcaggccaaatccatgaaagggggaccagtcatttattttccattttgttgcttggttggtttgttgctttatttttaaaaggagaagtttaactttgctatttattttcgagcactaggaaaactattccagtaatttttttttcctcatttccattcaggatgccggctttattaacaaaaactctaacaagtcacctccactatgtgggtcttcctttcccctcaagagaaggagcaattgttcccctgagcatctgggtccatctgacccatggggcctgcctgtgagaaacagtgggtcccttcaaatacatagtggatagctcatccctaggaattttcattaaaatttggaaacagagtaatgaagaaataatatataaactccttatgtgaggaaatgctactaatatctgaaaagtgaaagatttctatgtattaactcttaagtgcacctagcttattacatcgtgaaaggtacatttaaaatatgttaaattggcttgaaattttcagagaattttgtcttcccctaattcttcttccttggtctggaagaacaatttctatgaattttctctttatttttttttataattcagacaattctatgacccgtgtcttcatttttggcactcttatttaacaatgccacacctgaagcacttggatctgttcagagctgaccccctagcaacgtagttgacacagctccaggtttttaaattactaaaataagttcaagtttacatcccttgggccagatatgtgggttgaggcttgactgtagcatcctgcttagagaccaatcaacggacactggtttttagacctctatcaatcagtagttagcatccaagagactttgcagaggcgtaggaatgaggctggacagatggcggaagcagaggttccctgcgaagacttgagatttagtgtctgtgaatgttctagttcctaggtccagcaagtcacacctgccagtgccctcatccttatgcctgtaacacacatgcagtgagaggcctcacatatacgcctccctagaagtgccttccaagtcagtcctttggaaaccagcaggtctgaaaaagaggctgcatcaatgcaagcctggttggaccattgtccatgcctcaggatagaacagcctggcttatttggggatttttcttctagaaatcaaatgactgataagcattggatccctctgccatttaatggcaatggtagtctttggttagctgcaaaaatactccatttcaagttaaaaatgcatcttctaatccatctctgcaagctccctgtgtttccttgccctttagaaaatgaattgttcactacaattagagaatcatttaacatcctgacctggtaagctgccacacacctggcagtggggagcatcgctgtttccaatggctcaggagacaatgaaaagcccccatttaaaaaaataacaaacattttttaaaaggcctccaatactcttatggagcctggatttttcccactgctctacaggctgtgactttttttaagcatcctgacaggaaatgttttcttctacatggaaagatagacagcagccaaccctgatctggaagacagggccccggctggacacacgtggaaccaagccagggatgggctggccattgtgtccccgcaggagagatgggcagaatggccctagagttcttttccctgagaaaggagaaaaagatgggattgccactcacccacccacactggtaagggaggagaatttgtgcttctggagcttctcaagggattgtgttttgcaggtacagaaaactgcctgttatcttcaagccaggttttcgagggcacatgggtcaccagttgctttttcagtcaatttggccgggatggactaatgaggctctaacactgctcaggagacccctgccctctagttggttctgggctttgatctcttccaacctgcccagtcacagaaggaggaatgactcaaatgcccaaaaccaagaacacattgcagaagtaagacaaacatgtatatttttaaatgttctaacataagacctgttctctctagccattgatttaccaggctttctgaaagatctagtggttcacacagagagagagagagtactgaaaaagcaactcctcttcttagtcttaataatttactaaaatggtcaacttttcattatctttattataataaacctgatgcttttttttagaactccttactctgatgtctgtatatgttgcactgaaaaggttaatatttaatgttttaatttattttgtgtggtaagttaattttgatttctgtaatgtgttaatgtgattagcagttattttccttaatatctgaattatacttaaagagtagtgagcaatataagacgcaattgtgtttttcagtaatgtgcattgttattgagttgtactgtaccttatttggaaggatgaaggaatgaatctttttttcctaaa

SEQ ID NO: 5495 - DNA, 1847 bp, Homo sapiens
gtccccgcgccagagacgcagccgcgctcccaccacccacacccaccgcgccctcgttcgcctcttctccgggagccagtccgcgccaccgccgccgcccaggccatcgccaccctccgcagccatgtccaccaggtccgtgtcctcgtcctcctaccgcaggatgttcggcggcccgggcaccgcgagccggccgagctccagccggagctacgtgactacgtccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaaattgcaggaggagatgcttcagagagaggaagccgaaaacaccctgcaatctttcagacaggatgttgacaatgcgtctctggcacgtcttgaccttgaacgcaaagtggaatctttgcaagaagagattgcctttttgaagaaactccacgaagaggaaatccaggagctgcaggctcagattcaggaacagcatgtccaaatcgatgtggatgtttccaagcctgacctcacggctgccctgcgtgacgtacgtcagcaatatgaaagtgtggctgccaagaacctgcaggaggcagaagaatggtacaaatccaagtttgctgacctctctgaggctgccaaccggaacaatgacgccctgcgccaggcaaagcaggagtccactgagtaccggagacaggtgcagtccctcacctgtgaagtggatgcccttaaaggaaccaatgagtccctggaacgccagatgcgtgaaatggaagagaactttgccgttgaagctgctaactaccaagacactattggccgcctgcaggatgagattcagaatatgaaggaggaaatggctcgtcaccttcgtgaataccaagacctgctcaatgttaagatggcccttgacattgagattgccacctacaggaagctgctggaaggcgaggagagcaggatttctctgcctcttccaaacttttcctccctgaacctgagggaaactaatctggattcactccctctggttgatacccactcaaaaaggacacttctgattaagacggttgaaactagagatggacaggttatcaacgaaacttctcagcatcacgatgaccttgaataaaaattgcacacactcagtgcagcaatatattaccagcaagaataaaaaagaaatccatatcttaaagaaacagctttcaagtgcctttctgcagtttttcaggagcgcaagatagatttggaataggaataagctctagttcttaacaaccgacactcctacaagatttagaaaaaagtttacaacataatctagtttacagaaaaatcttgtgctagaatactttttaaaaggtattttgaataccattaaaactgcttttttttttccagcaagtatccaaccaacttggttctgcttcaataaatctttggaaaaactc

SEQ ID NO: 5496 - DNA, 2834 bp, Homo sapiens
gcccactcccaccgccagctggaaccctggggactacgacgtccctcaaaccttgcttctaggagataaaaagaacatccagtcatggataaaaatgagctggttcagaaggccaaactggccgagcaggctgagcgatatgatgacatggcagcctgcatgaagtctgtaactgagcaaggagctgaattatccaatgaggagaggaatcttctctcagttgcttataaaaatgttgtaggagcccgtaggtcatcttggagggtcgtctcaagtattgaacaaaagacggaaggtgctgagaaaaaacagcagatggctcgagaatacagagagaaaattgagacggagctaagagatatctgcaatgatgtactgtctcttttggaaaagttcttgatccccaatgcttcacaagcagagagcaaagtcttctatttgaaaatgaaaggagattactaccgttacttggctgaggttgccgctggtgatgacaagaaagggattgtcgatcagtcacaacaagcataccaagaagcttttgaaatcagcaaaaaggaaatgcaaccaacacatcctatcagactgggtctggcccttaacttctctgtgttctattatgagattctgaactccccagagaaagcctgctctcttgcaaagacagcttttgatgaagccattgctgaacttgatacattaagtgaagagtcatacaaagacagcacgctaataatgcaattactgagagacaacttgacattgtggacatcggatacccaaggagacgaagctgaagcaggagaaggaggggaaaattaaccggccttccaacttttgtctgcctcattctaaaatttacacagtagaccatttgtcatccatgctgtcccacaaatagttttttgtttacgatttatgacaggtttatgttacttctatttgaatttctatatttcccatgtggtttttatgtttaatattaggggagtagagccagttaacatttagggagttatctgttttcatcttgaggtggccaatatggggatgtggaatttttatacaagttataagtgtttggcatagtacttttggtacattgtggcttcaaaagggccagtgtaaaactgcttccatgtctaagcaaagaaaactgcctacatactggtttgtcctggcggggaataaaagggatcattggttccagtcacaggtgtagtaattgtgggtactttaaggtttggagcacttacaaggctgtggtagaatcataccccatggataccacatattaaaccatgtatatctgtggaatactcaatgtgtacacctttgactacagctgcagaagtgttcctttagacaaagttgtgacccattttactctggataagggcagaaacggttcacattccattatttgtaaagttacctgctgttagctttcattatttttgctacactcattttatttgtatttaaatgttttaggcaacctaagaacaaatgtaaaagtaaagatgcaggaaaaatgaattgcttggtattcattacttcatgtatatcaagcacagcagtaaaacaaaaacccatgtatttaacttttttttaggatttttgcttttgtgattttttttttttttttttgatacttgcctaacatgcatgtgctgtaaaaatagttaacagggaaataacttgagatgatggctagctttgtttaatgtcttatgaaattttcatgaacaatccaagcataattgttaagaacacgtgtattaaattcatgtaagtggaataaaagttttatgaatggacttttcaactactttctctacagcttttcatgtaaattagtcttggttctgaaacttctctaaaggaaattgtacattttttgaaatttattccttattccctcttggcagctaatgggctcttaccaagtttaaacacaaaatttatcataacaaaaatactactaatataactactgtttccatgtcccatgatcccctctcttcctccccaccctgaaaaaaatgagttcctattttttctgggagagggggggattgattagaaaaaaatgtagtgtgttccatttaaaattttggcatatggcattttctaacttaggaagccacaatgttcttggcccatcatgacattgggtagcattaactgtaagttttgtgcttccaaatcactttttggtttttaagaatttcttgatactcttatagcctgccttcaattttgatcctttattctttctatttgtcaggtgcacaagattaccttcctgttttagccttctgtcttgtcaccaaccattcttacttggtggccatgtacttggaaaaaggccgcatgatctttctggctccactcagtgtctaaggcaccctgcttcctttgcttgcatcccacagactatttccctcatcctatttactgcagcaaatctctccttagttgatgagactgtgtttatctccctttaaaaccctacctatcctgaatggtctgtcattgtctgcctttaaaatccttcctctttcttcctcctctattctctaaataatgatggggctaagttatacccaaagctcactttacaaaatatttcctcagtactttgcagaaaacaccaaacaaaaatgccattttaaaaaaggtgtattttttcttttagaatgtaagctcctcaagagcagggacaatgttttctgtatgttctattgtgcctagtacactgtaaatgctcaataaatattgatgatgggaggcagtgagtcttgatgataagggtgagaaactgaaatccc

SEQ ID NO: 5497 - DNA, 4350 bp, Homo sapiens
agttgagggattgacacaaatggtcaggcggcggcggcggagaaggaggcggaggcgcaggggggagccgagcccgctgggctgcggagagttgcgctctctacggggccgcggccactagcgcggcgccgccagccgggagccagcgagccgagggccaggaaggcgggacacgaccccggcgcgccctagccacccgggttctccccgccgcccgcgcttcatgaatcgcaagtttccgcggcggcggcggctgcggtacgcagaacaggagccgggggagcgggccgaaagcggcttgggctcgacggagggcacccgcgcagaggtctccctggccgcagggggagccgccgccggccgtgcccctggcagccccagcggagcggcgccaagagaggagccgagaaagtatggctgaggaggaggcgcctaagaagtcccgggccgccggcggtggcgcgagctgggaactttgtgccggggcgctctcggcccggctggcggaggagggcagcggggacgccggtggccgccgccgcccgccagttgacccccggcgattggcgcgccagctgctgctgctgctttggctgctggaggctccgctgctgctgggggtccgggcccaggcggcgggccaggggccaggccaggggcccgggccggggcagcaaccgccgccgccgcctcagcagcaacagagcgggcagcagtacaacggcgagcggggcatctccgtcccggaccacggctattgccagcccatctccatcccgctgtgcacggacatcgcgtacaaccagaccatcatgcccaacctgctgggccacacgaaccaggaggacgcgggcctggaggtgcaccagttctaccctctagtgaaagtgcagtgttccgctgagctcaagttcttcctgtgctccatgtacgcgcccgtgtgcaccgtgctagagcaggcgctgccgccctgccgctccctgtgcgagcgcgcgcgccagggctgcgaggcgctcatgaacaagttcggcttccagtggccagacacgctcaagtgtgagaagttcccggtgcacggcgccggcgagctgtgcgtgggccagaacacgtccgacaagggcaccccgacgccctcgctgcttccagagttctggaccagcaaccctcagcacggcggcggagggcaccgtggcggcttcccggggggcgccggcgcgtcggagcgaggcaagttctcctgcccgcgcgccctcaaggtgccctcctacctcaactaccacttcctgggggagaaggactgcggcgcaccttgtgagccgaccaaggtgtatgggctcatgtacttcgggcccgaggagctgcgcttctcgcgcacctggattggcatttggtcagtgctgtgctgcgcctccacgctcttcacggtgcttacgtacctggtggacatgcggcgcttcagctacccggagcggcccatcatcttcttgtccggctgttacacggccgtggccgtggcctacatcgccggcttcctcctggaagaccgagtggtgtgtaatgacaagttcgccgaggacggggcacgcactgtggcgcagggcaccaagaaggagggctgcaccatcctcttcatgatgctctacttcttcagcatggccagctccatctggtgggtgatcctgtcgctcacctggttcctggcggctggcatgaagtggggccacgaggccatcgaagccaactcacagtattttcacctggccgcctgggctgtgccggccatcaagaccatcaccatcctggcgctgggccaggtggacggcgatgtgctgagcggagtgtgcttcgtggggcttaacaacgtggacgcgctgcgtggcttcgtgctggcgcccctcttcgtgtacctgtttatcggcacgtcctttctgctggccggctttgtgtcgctcttccgcatccgcaccatcatgaagcacgatggcaccaagaccgagaagctggagaagctcatggtgcgcattggcgtcttcagcgtgctgtacactgtgccagccaccatcgtcatcgcctgctacttctacgagcaggccttccgggaccagtgggaacgcagctgggtggcccagagctgcaagagctacgctatcccctgccctcacctccaggcgggcggaggcgccccgccgcacccgcccatgagcccggacttcacggtcttcatgattaagtaccttatgacgctgatcgtgggcatcacgtcgggcttctggatctggtccggcaagaccctcaactcctggaggaagttctacacgaggctcaccaacagcaaacaaggggagactacagtctgagacccggggctcagcccatgcccaggcctcggccggggcgcagcgatcccccaaagccagcgccgtggagttcgtgccaatcctgacatctcgaggtttcctcactagacaactctctttcgcaggctcctttgaacaactcagctcctgcaaaagcttccgtccctgaggcaaaaggacacgagggcccgactgccagagggaggatggacagacctcttgccctcacactctggtaccaggactgttcgcttttatgattgtaaatagcctgtgtaagatttttgtaagtatatttgtatttaaatgacgaccgatcacgcgtttttctttttcaaaagtttttaattatttagggcggtttaaccatttgaggcttttccttcttgcccttttcggagtattgcaaaggagctaaaactggtgtgcaaccgcacagcgctcctggtcgtcctcgcgcgcctctccctaccacgggtgctcgggacggctgggcgccagctccggggcgagttcagcactgcggggtgcgactagggctgcgctgccagggtcacttcccgcctcctccttttgccccctccccctccttctgtcccctccctttctttcctggcttgaggtaggggctcttaaggtacagaactccacaaaccttccaaatctggaggagggcccccatacattacaattcctcccttgctcggcggtggattgcgaaggcccgtcccttcgacttcctgaagctggatttttaactgtccagaactttcctccaacttcatgggggcccacgggtgtgggcgctggcagtctcagcctccctccacggtcaccttcaacgcccagacactcccttctcccaccttagttggttacagggtgagtgagataaccaatgccaaactttttgaagtctaatttttgaggggtgagctcatttcattctctagtgtctaaaacctggtatgggtttggccagcgtcatggaaagatgtggttactgagatttgggaagaagcatgaagctttgtgtgggttggaagagactgaagatatgggttataaaatgttaattctaattgcatacggatgcctggcaaccttgcctttgagaatgagacagcctgcgcttagattttaccggtctgtaaaatggaaatgttgaggtcacctggaaagctttgttaaggagttgatgtttgctttccttaacaagacagcaaaacgtaaacagaaattgaaaacttgaaggatatttcagtgtcatggacttcctcaaaatgaagtgctattttcttatttttaatcaaataactagacatatatcagaaactttaaaatgtaaaagttgtacactttcaacattttattacgattattattcagcagcacattctgaggggggaacaattcacaccaccaataataacctggtaagatttcaggaggtaaagaaggtggaataattgacggggagatagcgcctgaaataaacaaaatatgggcatgcatgctaaagggaaaatgtgtgcaggtctactgcattaaatcctgtgtgctcctcttttggatttacagaaatgtgtcaaatgtaaatctttcaaagccatttaaaaatattcactttagttctctgtgaagaagaggagaaaagcaatcctcctgattgtattgttttaaactttaagaatttatcaaaatgccggtacttaggacctaaatttatctatgtctgtcatacgctaaaatgatattggtctttgaatttggtatacatttattctgttcactatcacaaaatcatctatatttatagaggaatagaagtttatatatatataataccatatttttaatttcacaaataaaaaattcaaagttttgtacaaaattatatggattttgtgcctgaaaataatagagcttgagctgtctgaactattttacattttatggtgtctcatagccaatcccacagtgtaaaaattca

SEQ ID NO: 5498 - DNA, 4992 bp, Homo sapiens
cagaagcaacaataattgtgaaaaatacttcagcagttatggactcatctgtcattcaaaggaaaaaagtagctgtcattggtggtggcttggttggctcattacaagcatgctttcttgcaaagaggaatttccagattgatgtatatgaagctagggaagatactcgagtggctaccttcacacgtggaagaagcattaacttagccctttctcatagaggacgacaagccttgaaagctgttggcctggaagatcagattgtatcccaaggtattcccatgagagcaagaatgatccactctctttcaggaaaaaagtctgcaattccctatgggacaaagtctcagtatattctttctgtaagcagagaaaatctaaacaaggatctattgactgctgctgagaaataccccaatgtgaaaatgcactttaaccacaggctgttgaaatgtaatccagaggaaggaatgatcacagtgcttggatctgacaaagttcccaaagatgtcacttgtgacctcattgtaggatgtgatggagcctattcaactgtcagatctcacctgatgaagaaacctcgctttgattacagtcagcagtacattcctcatgggtacatggagttgactattccacctaagaacggagattatgccatggaacctaattatctgcatatttggcctagaaatacctttatgatgattgcacttcctaacatgaacaaatcattcacatgtactttgttcatgccctttgaagagtttgaaaaacttctaaccagtaatgatgtggtagatttcttccagaaatactttccggatgccatccctctaattggagagaaactcctagtgcaagatttcttcctgttgcctgcccagcccatgatatctgtaaagtgctcttcatttcactttaaatctcactgtgtactgctgggagatgcagctcatgctatagtgccgttttttgggcaaggaatgaatgcgggctttgaagactgcttggtatttgatgagttaatggataaattcagtaacgaccttagtttgtgtcttcctgtgttctcaagattgagaatcccagatgatcacgcgatttcagacctatccatgtacaattacatagagatgcgagcacatgtcaactcaagctggttcatttttcagaagaacatggagagatttcttcatgcgattatgccatcgacctttatccctctctatacaatggtcactttttccagaataagataccatgaggctgtgcagcgttggcattggcaaaaaaaggtgataaacaaaggactctttttcttgggatcactgatagccatcagcagtacctacctacttatacactacatgtcaccacgatctttcctctgcttgagaagaccatggaactggatagctcacttccggaatacaacatgtttccccgcaaaggccgtggactccctagaacaaatttccaatctcattagcaggtgatagaaaggttttgtggtagcaaatgcatgatttctctgtgaccaaaattaagcatgaaaaaaatgtttccattgccatatttgattcactagtggaagatagtgttctgcttataattaaactgaatgtagagtatctctgtatgttaattgcaattactggttggggggtgcattttaaaagatgaaacatgcagcttccctacattacacacactcaggttgagtcattctaactataaaagtgcaatgactaagatccttcacttctctgaaagtaaggccctagatgcctcagggaagacagtaatcatgccttttctttaaaagacacaataggactcgcaacagcattgactcaacacctaggactaaaaatcacaacttaactagcatgttaactgcacttttcattacgtgaatggaacttacctaaccacagggctcagacttactagataaaaccagaaatggaaataaggaattcaggggagttccagagacttacaaaatgaactcattttattttcccaccttcaaatataagtattatcatctatctgtttatcgtctatctatctatcatctatctatctatctatcatctatctatctatctatctatctatctatctatctatctatctatctatctctatttatttatgtatttagagatcaggtctcactctgttgaccaggctggagtgcagtggtgagatctgggttcactgcaacctctgcctcctgggctcaagcaatcctcccacttcagcctcccaaatagctggggctaccatggtatttttcagtagagaccgggtcttgccatgctgcccaggccagtctcaaactcctggcctcatgtgatctgcccacctcagcctcccaaagtacagggattagagttgtgagccaccgctgccagcccagagttaccctctaaagataagaaaaaggctattaatatcatactaagtgaaggacaggaaagggttttattcataaattaaatgtctacatgtgccagaatggaaaggaaacaaggggagacaacttttatagaaatacaaagccattactttattcaatttcagaccctcagaagcaatttactaatttattcttcgactacatactgcagcagaaccagcaatacacttgatttttaaaagcacatttagtgaaatgttttctttggttcatccttctttaacaggctgctgagtcactcagaaatccttcaaacatgattaattatgaagatgaaacactagagtcatataagaaataaaaattgggcaataaaataaaatgattcagtgtttcttttctatattgtcaatgaaaaccttgagttctaataatccatgttcagtttgtagggaaagaaaaaataatttttccttctacccactttaggttccttggctggggcccctataacaaaagacagattgacaagagaaaaacaaacataaatttattagcgggtatatgtaatatatatgtgggaaatacaggggaatgagcaaatctcaaagagctggcgtcttagaactccctggcttatatagcatcgacaaagaacagtaaatttttagagaaacaacaaaacaaagaaaaagagctttgagtctgtaggggcagcaatttgggggaagcaaatatatgggagtttgccttgtagattcctctggtggtggtctccaggctgacaaggattcaaagttgtctctgaaactcctctttgtcatactgcacatataaaacgtcttttgtttccaacaagaggatttctttttcattctagaattatctccttgataacttgatcagatataggacatgacactgaatagagtccaacagtacaaaaaaaattcagtatgttctagctacttcacacatgtgtacgcgacagttatttttacagtaaggtattttcgagaaaaatgcattacgtgttttggaaaatagagtaatttaaaaaatatatttgaaatgaaaatctccaacacattagaagatgatgatgttagatgcccatcgtgtgccacaagtggttttttcattatgtaaagcacccgttgaattaaaagaatttgtttttgttcaacctcttcctgaggcccaagagcatatgggcaattcggatttcctgctggaccacaaggttctgttgatattacatagaaacgggtattccagacacttcttatgatgaaagtccaaaagtggcatccaatttaaggccccatctttcgttgccattcttcattcctacaaaggacgaacttggattacatcaactttggacccattggttttgtcgctgtcgtcaactgacagtgattcaccactggtgatgataaaaatgatggaagaagagttgaaagtcacttttttctttggcctgtccccatctttctgtgacatcacaatgggtctgatctgcatttcacttccagctgctggtaggtctttagcaggcctctggcacctcagcagtcggaggcacagaagctgcaaaagggatcttcgaaactgggcagagaaaaaataaagtggaatattaagtaaaagttgggcactaatctggattaacattcgaggaaatcagttgagctgatttaagttgttttttgtttgttagcaggtgtggatgtggggttatgtggtcatgctcagatctacctaaatcaccccagagctttatgtcttttattcattctaaatcttattaaccggaatatgtaggaccatttcaataccttgtaatcctccaagcttcaatctgcacacactttctatgagggcaggtacaactattaagagattttgaacattaagttagtccacaaatattcagtgggcatctactaggtgacagccactgtgctataattagagactttttactataagcatcaaaaacagataaggctcttcctggcagagtttacagcctggtgtacttgctaatgtctctttaattaggtgaagaattttttttttctatcgaaattactaatcagttggggaaaaaaatactatagcagacagcactaatgtcatcaacaaacattgttcttctccgtgtcctgggtacaacatcgaataatatttcttggcctcctttccgcttctcctctctgctgttcctctctacaagaacctgggaggccaacgcctaaagatcataatatcacaatggaaggaacctagattcctaaatgactgcataggacagatcccatctcctccacccaatacattattagactgaactgtgacctgaaatgagcaataaactctgtattaattcactgaaatgttggggttgcttgttatagtagtcggtccatcatgaccagtaaaacataaatcaaaagttaatgtaattgttatcccattatttagagcgaaataaatgttgaatatatggactttctcagattaggaaataccaattaaaaatataataaatagct

SEQ ID NO: 5499 - DNA, 4932 bp, Homo sapiens
cccggctttatatctatatatacacaggtatatgtgtatattttatataattgttctccgttcgttgatatcaaagacagttgaaggaaatgaattttgaaacttcacggtgtgccaccctacagtactgccctgacccttacatccagcgtttcgtagaaaccccagctcatttctcttggaaagaaagttattaccgatccaccatgtcccagagcacacagacaaatgaattcctcagtccagaggttttccagcatatctgggattttctggaacagcctatatgttcagttcagcccattgacttgaactttgtggatgaaccatcagaagatggtgcgacaaacaagattgagattagcatggactgtatccgcatgcaggactcggacctgagtgaccccatgtggccacagtacacgaacctggggctcctgaacagcatggaccagcagattcagaacggctcctcgtccaccagtccctataacacagaccacgcgcagaacagcgtcacggcgccctcgccctacgcacagcccagctccaccttcgatgctctctctccatcacccgccatcccctccaacaccgactacccaggcccgcacagtttcgacgtgtccttccagcagtcgagcaccgccaagtcggccacctggacgtattccactgaactgaagaaactctactgccaaattgcaaagacatgccccatccagatcaaggtgatgaccccacctcctcagggagctgttatccgcgccatgcctgtctacaaaaaagctgagcacgtcacggaggtggtgaagcggtgccccaaccatgagctgagccgtgaattcaacgagggacagattgcccctcctagtcatttgattcgagtagaggggaacagccatgcccagtatgtagaagatcccatcacaggaagacagagtgtgctggtaccttatgagccaccccaggttggcactgaattcacgacagtcttgtacaatttcatgtgtaacagcagttgtgttggagggatgaaccgccgtccaattttaatcattgttactctggaaaccagagatgggcaagtcctgggccgacgctgctttgaggcccggatctgtgcttgcccaggaagagacaggaaggcggatgaagatagcatcagaaagcagcaagtttcggacagtacaaagaacggtgatggtacgaagcgcccgtttcgtcagaacacacatggtatccagatgacatccatcaagaaacgaagatccccagatgatgaactgttatacttaccagtgaggggccgtgagacttatgaaatgctgttgaagatcaaagagtccctggaactcatgcagtaccttcctcagcacacaattgaaacgtacaggcaacagcaacagcagcagcaccagcacttacttcagaaacagacctcaatacagtctccatcttcatatggtaacagctccccacctctgaacaaaatgaacagcatgaacaagctgccttctgtgagccagcttatcaaccctcagcagcgcaacgccctcactcctacaaccattcctgatggcatgggagccaacattcccatgatgggcacccacatgccaatggctggagacatgaatggactcagccccacccaggcactccctcccccactctccatgccatccacctcccactgcacacccccacctccgtatcccacagattgcagcattgtcagtttcttagcgaggttgggctgttcatcatgtctggactatttcacgacccaggggctgaccaccatctatcagattgagcattactccatggatgatctggcaagtctgaaaatccctgagcaatttcgacatgcgatctggaagggcatcctggaccaccggcagctccacgaattctcctccccttctcatctcctgcggaccccaagcagtgcctctacagtcagtgtgggctccagtgagacccggggtgagcgtgttattgatgctgtgcgattcaccctccgccagaccatctctttcccaccccgagatgagtggaatgacttcaactttgacatggatgctcgccgcaataagcaacagcgcatcaaagaggagggggagtgagcctcaccatgtgagctcttcctatccctctcctaactgccagccccctaaaagcactcctgcttaatcttcaaagccttctccctagctcctccccttcctcttgtctgatttcttaggggaaggagaagtaagaggctacctcttacctaacatctgacctggcatctaattctgattctggctttaagccttcaaaactatagcttgcagaactgtagctgccatggctaggtagaagtgagcaaaaaagagttgggtgtctccttaagctgcagagatttctcattgacttttataaagcatgttcacccttatagtctaagactatatatataaatgtataaatatacagtatagatttttgggtggggggcattgagtattgtttaaaatgtaatttaaatgaaagaaaattgagttgcacttattgaccattttttaatttacttgttttggatggcttgtctatactccttcccttaaggggtatcatgtatggtgataggtatctagagcttaatgctacatgtgagtgacgatgatgtacagattctttcagttctttggattctaaatacatgccacatcaaacctttgagtagatccatttccattgcttattatgtaggtaagactgtagatatgtattcttttctcagtgttggtatattttatattactgacatttcttctagtgatgatggttcacgttggggtgatttaatccagttataagaagaagttcatgtccaaacgtcctctttagtttttggttgggaatgaggaaaattcttaaaaggcccatagcagccagttcaaaaacacccgacgtcatgtatttgagcatatcagtaacccccttaaatttaataccagataccttatcttacaatattgattgggaaaacatttgctgccattacagaggtattaaaactaaatttcactactagattgactaactcaaatacacatttgctactgttgtaagaattctgattgatttgattgggatgaatgccatctatctagttctaacagtgaagttttactgtctattaatattcagggtaaataggaatcattcagaaatgttgagtctgtactaaacagtaagatatctcaatgaaccataaattcaactttgtaaaaatcttttgaagcatagataatattgtttggtaaatgtttcttttgtttggtaaatgtttcttttaaagaccctcctattctataaaactctgcatgtagaggcttgtttacctttctctctctaaggtttacaataggagtggtgatttgaaaaatataaaattatgagattggttttcctgtggcataaattgcatcactgtatcattttcttttttaaccggtaagagtttcagtttgttggaaagtaactgtgagaacccagtttcccgtccatctcccttagggactacccatagacatgaaaggtccccacagagcaagagataagtctttcatggctgctgttgcttaaaccacttaaacgaagagttcccttgaaactttgggaaaacatgttaatgacaatattccagatctttcagaaatataacacatttttttgcatgcatgcaaatgagctctgaaatcttcccatgcattctggtcaagggctgtcattgcacataagcttccattttaattttaaagtgcaaaagggccagcgtggctctaaaaggtaatgtgtggattgcctctgaaaagtgtgtatatattttgtgtgaaattgcatactttgtattttgattattttttttttcttcttgggatagtgggatttccagaaccacacttgaaacctttttttatcgtttttgtattttcatgaaaataccatttagtaagaataccacatcaaataagaaataatgctacaattttaagaggggagggaagggaaagtttttttttattatttttttaaaattttgtatgttaaagagaatgagtccttgatttcaaagttttgttgtacttaaatggtaataagcactgtaaacttctgcaacaagcatgcagctttgcaaacccattaaggggaagaatgaaagctgttccttggtcctagtaagaagacaaactgcttcccttactttgctgagggtttgaataaacctaggacttccgagctatgtcagtactattcaggtaacactagggccttggaaattcctgtactgtgtctcatggatttggcactagccaaagcgaggcacccttactggcttacctcctcatggcagcctactctccttgagtgtatgagtagccagggtaaggggtaaaaggatagtaagcatagaaaccattagaaagtgggcttaatggagttcttgtggcctcagctcaatgcagttagctgaagaattgaaaagtttttgtttggagacgtttataaacagaaatggaaagcagagttttcattaaatccttttaccttttttttttcttggtaatcccctaaaataacagtatgtgggatattgaatgttaaagggatatttttttctattatttttataattgtacaaaattaagcaaatgttaaaagttttatatgctttattaatgttttcaaaaggtattatacatgtgatacattttttaagcttcagttgcttgtcttctggtactttctgttatgggcttttggggagccagaagccaatctacaatctctttttgtttgccaggacatgcaataaaatttaaaaaataaataaaaactaattaagaaaaaaaaaaaaaaaaaaaaaaaaaaaaa

SEQ ID NO: 5500 - DNA, 15353 bp, Homo sapiens
ctgcagccatgggtgccctatggagctggtggatactctgggctggagcaaccctcctgtggggattgacccaggaggcttcagtggacctcaagaacactggcagagaggaattcctcacagccttcctgcagaactatcagctggcctacagcaaggcctacccccgcctccttatctccagtctgtcagagagccccgcttcagtctccatcctcagccaggcagacaacacctcaaagaaggtcacagtgaggcccggggagtcggtcatggtcaacatcagtgccaaggctgagatgataggcagcaagatcttccagcatgcggtggtgatccattctgactatgccatctctgtgcaggcactaaatgccaagcctgacacagcggagctgacactgctgcggcccatccaggccctaggcaccgagtattttgtgctcacaccccccggcacctcagccaggaatgtcaaggagtttgccgtggtggccggtgccgcaggtgcctcggtcagtgtcacgctgaaggggtcagtgacattcaatggcaagttctatccagcaggcgatgtcctaagagtgactctacagccctacaatgtggcccagctacagagctcagtggatctctcggggtcaaaggtcacagctagtagccccgtggctgtcctctctggccacagctgtgcgcagaaacatacgacctgcaaccatgtggttgagcagctgctacccacgtctgcctggggcacccactatgtagtacccacgctggcctcccaatctcgctatgatttggccttcgttgtggccagccaggccacaaagctgacctacaaccatgggggtatcactggctcccgtgggctccaggcaggtgatgtggtagagtttgaggtccggccatcctggccactctacctgtctgcaaatgtgggcatccaggtcctgttgtttggcacaggtgccataaggaatgaagtgacttatgacccctacctggtcctgatcccagatgtggcggcctactgcccagcctatgtggtcaagagtgtaccaggctgtgagggcgtggccctggtagtggcacagacgaaggctatcagcgggctgaccatagatgggcatgcagtgggggccaagctcacctgggaggctgtgccaggcagtgagttctcgtatgctgaagtggagctcggcacagctgacatgatccacacggccgaggccaccaccaacttgggactgctcaccttcgggctggccaaggctataggctacgcaacagctgctgattgcggccggactgtactgtccccagtggagccctcctgcgaaggcatgcagtgcgcagccgggcagcgctgccaggtggtaggcgggaaggccgggtgtgtggcggagtccaccgctgtctgccgcgcccagggcgacccccattacaccaccttcgacggccgtcgctacgacatgatgggcacctgttcgtacacgatggtggagctgtgcagcgaggacgacaccctgcccgccttcagcgtggaggccaagaacgagcaccggggcagccgccgcgtctcctacgtgggcctcgtcactgtgcgcgcctacagccactctgtgtcgctgacccgcggtgaagttggcttcgtcctggttgacaaccagcgctcgcgcctgccagtctccctgagtgagggtcgcctgcgtgtgtaccagagcggaccacgggccgtggtggagctggtctttgggctggtggtcacttatgactgggactgccagctggcactcagcctgcctgcacgcttccaagaccaggtgtgcgggctgtgtggcaactataatggtgacccagcagacgacttcctcacgcctgacggggctctggctcctgacgctgtggagttcgcaagtagctggaagctggatgatggggactacctgtgtgaggatggctgccagaacaactgtcccgcctgcaccccaggccaggcccaacactatgagggcgaccgactctgtggcatgctgaccaagctcgatggccccttcgctgtctgccatgacaccctggaccccaggcccttcctggagcagtgtgtatatgacctgtgtgtggtcggtggggagcggctcagcctgtgccgtggcctcagcgcctatgcccaggcctgtctggagcttggcatctcggttggggactggagatcaccagccaactgccccctgtcctgccctgccaacagccgctatgagctctgcggccctgcttgcccgacctcctgcaacggggctgcggcgccgtccaactgctccgggcgcccctgcgtggagggctgcgtgtgcctcccaggcttcgtggccagcggcggcgcctgcgtgccggcctcgtcgtgtggctgcaccttccagggtctccagctcgctccgggccaggaagtgtgggcggacgagttgtgccaaaggcgctgcacctgcaacggcgccacccatcaggtcacctgccgcgacaagcagagctgcccggcgggtgagcgctgcagcgtccagaacggcctcctgggctgctaccccgatcgcttcgggacctgccaggggtccggggacccacactatgtgagcttcgacggccggcgcttcgacttcatgggcacctgcacgtacctgctggtcggctcatgcggccagaacgcagcgctgcctgccttccgggtgctggtggaaaacgagcatcggggcagccagactgtgagctacacgcgcgccgtgcgggtggaggcccgcggggtgaaggtggccgtgcgccgggagtaccccgggcaagtgctggtggatgacgtccttcagtatctgcccttccaagcagcagatgggcaggtgcaggtgttccgacagggcagggatgccgtcgtgcgcacggactttggcctgactgtcacttatgactggaatgcacgagtgactgccaaggtgcccagcagctatgctgaggccctgtgtggactctgtgggaacttcaacggggacccagctgatgacctggctctgcggggtgggggtcaagctgccaatgcactggcctttgggaacagctggcaagaagagacgaggcccggctgtggagcaactgaaccgggtgactgtcccaagctggactccctggtggcccagcagctgcagagcaagaatgagtgtggaatccttgccgaccccaaggggcccttccgggagtgccatagcaagctggacccccagggtgccgtgcgcgactgtgtctatgaccgctgcctgctgccaggccagtctgggccactgtgtgacgcactggccacctatgctgctgcatgccaggctgctggagccacagtgcacccctggaggagtgaagaactttgcccactgagctgcccaccccacagccactatgaggcgtgttcctacggctgcccgctgtcctgtggagacctcccagtgcccgggggctgtggctcagaatgccatgagggctgcgtgtgcgatgagggctttgcgctcagtggtgagtcctgcctgcccctggcctcctgtggctgcgtacaccagggcacctaccacccaccaggccagaccttctaccctggccccggatgtgattccctttgccactgccaggagggcggcctggtgtcctgtgagtcctccagctgcggaccgcacgaggcctgccagccatccggtggcagcttgggctgtgtggccgtgggctctagcacctgccaggcgtcaggagacccccactacaccaccttcgatggccgccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccccggaaactactaccagcagatgtgtggcctgtgtgggaactacaacggcgaccccaaggatgacttccagaagcccaatggctcacaggcaggcaacgccaatgagttcggcaactcctgggaggaggtggtgcccgactctccctgcctgccgcccaccccttgcccgccggggagcgaggactgtatccccagccacaagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggactgaaactttctgtcccatggagtgccctccgaacagtcactacgagctctgtgcggacacctgctccctgggctgctcagctctcagtgcccctccacagtgccaggatgggtgtgctgagggctgccagtgtgactccggcttcctctacaatggccaagcctgcgtgcccatccagcaatgcggctgctaccacaatggtgtctactatgagccggagcagacagtcctcattgacaactgtcggcagcagtgcacgtgccatgcgggtaaaggcatggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctctgtggccgacgggcggatttcagtgacccagggtgcatcgaaggcactgctggtggctgactttggactgcaagtcagctatgactggaactggcgggtagacgtgacgctgcccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccgtgacattctttgcaaggctctggcttcctatgtggccgcctgccaggctgctggggttgtcatcgaagactggcgggcacaggttggctgtgagatcacctgcccagaaaacagccactatgaggtctgtggctcaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcaatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgacggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccgccgcttcgacttcatgggcacctgcgtgtatgtgctggctcagacctgcggcacccggcctggcctacatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgagggctgtatccccagcgaggagtgtcctcccgagctggagaagaagtatcagaaggaggagttctgtgggctcctctccagccccacagggccactgtcctcttgccacaagctggtggatccccagggtcccttgaaagattgcatctttgatctctgcctgggtggtgggaacctgagcattctctgcagcaacatccatgcctacgtgagtgcttgccaggcagctggaggccaggtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgcctactatgagccggagcagacagtcctcattgacaactgtcggcagcagtgcacgtgccatgtgggtaaagtcgtggtgtgccaggaacacagctgcaagccggggcaggtgtgccagccctccggaggcatcctgagctgcgtcaacaaagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctctgtggccgacgggcggatttcagtgacccagggtgcatcgaaggcactgctggtggctgactttggactgcaagtcagctatgactggaactggcgggtagacgtgacgctgcccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctggcccccggcacagggggccctttcaccacctgccatgctcatgtgccacctgagagcttcttcaagggctgtgttctggacgtctgcatgggtggtggggaccgtgacattctttgcaaggctctggcttcctatgtggccgcctgccaggctgctggggttgtcatcgaagactggcgggcacaggttggctgtgagatcacctgcccagaaaacagccactatgaggtctgtggcccaccctgcccggccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtggacggcgtgttcgtcactctgcccttccagctggactcgctcctgcacgcacacctgagcggcgccgacgtggtggtgaccacaacctcagggctctcgctggctttcgatggggacagcttcgtgcgcctgcgcgtgccggcggcgtacgcgggctctctctgtggcttatgcgggaactacaaccaggaccccgcagacgacctgaaggcggtgggcgggaagcccgccggatggcaggtgggcggcgcccagggctgcggggaatgtgtgtccaagccatgcccgtcgccgtgcaccccagagcagcaagagtccttcggcggcccggacgcctgcggcgtgatctccgccaccgacggcccgctggcgccctgccacggccttgtgccgcccgcgcagtacttccagggctgcttgctggacgcctgccaagttcagggccatcctggaggcctctgtcctgcagtggccacctacgtggcagcctgtcaggccgctggggcccagctccgcgagtggaggcggccggacttctgtcccttccagtgccctgcccacagccactacgagctctgcggtgactcctgtcctgggagctgcccgagcctgtcggcacccgagggctgtgagtcggcctgccgtgaaggctgtgtctgcgatgctggcttcgtgctcagtggtgacacgtgtgtacctgtgggccagtgtggctgcctccacgatgaccgctactacccactgggccagaccttctaccctggccctgggtgtgattccctttgccgctgccgggagggcggtgaggtgtcctgtgagccctccagctgcggcccgcatgagacctgccggccatccggtggcagcttgggctgcgtggccgtgggctctaccacctgccaggcgtcgggagatccccactacaccaccttcgatggccaccgcttcgacttcatgggcacctgcgtgtatgtgctggctcagacctgcggcacccggcctggcctgcatcggtttgccgtcctgcaggagaacgtggcctggggtaatgggcgagtcagtgtgaccagggtgatcacggtccaggtggcaaacttcaccctgcggctggagcagagacagtggaaggtcacggtgaacggtgtggacatgaagctgcccgtggtgctggccaacggccagatccgtgcctcccagcatggttcagatgttgtgattgagaccgacttcggcctgcgtgtggcctacgaccttgtgtactatgtgcgggtcaccgtccctggaaactactaccagctgatgtgtggcctgtgtgggaactacaacggcgaccccaaggatgacttccagaagcccaatggctcgcaggcaggcaacgccaatgagttcggcaactcctgggaggaggtggtgcccgactctccctgcctgccgccgcccacctgcccgccggggagcgcgggctgtatccccagcgacaagtgtcctcccgagctggagaagaagtatcagaaggaggagttctgtgggctcctctccagccccacagggccactgtcctcctgccacaagctggtggatccccagggtcccttgaaagattgcatctttgatctctgcctgggtggtgggaacctgagcattctctgcagcaacatccatgcctacgtgagtgcttgccaggcggctggaggccacgtggagccctggaggaatgaaactttctgtcccatggaatgccctcagaacagtcactacgagctctgtgcggacacctgctccctgggctgctcggctctcagtgcccctctgcagtgcccagatgggtgtgctgagggctgccagtgtgactccggcttcctctacaacggccaagcctgcgtgcccatccagcaatgtggctgctaccacaatggtgtctactatgagccggagcagacagtcctcattgacaactgtcggcagcagtgcacgtgccatgtgggtaaagtcgtggtgtgccaggaacacagctgcaagccggggcaggtgtgccagccctccggaggcatcctgagctgcgtcaccaaagacccgtgccacggcgtgacatgccggccacaggagacatgcaaggagcagggtggccagggcgtgtgcctgcccaactatgaggccacgtgctggctgtggggcgacccacactaccactccttcgatggccggaagtttgacttccagggcacctgtaactatgtgctggcaacaactggctgcccgggggtcagcacccagggcctgacacccttcaccgtcaccaccaagaaccagaaccggggcaaccctgctgtgtcctacgtgagagtcgtcaccgtggctgccctcggcaccaacatctccatccacaaggacgagatcggcaaagtccgggtgaacggtgtgctcacagccttgcctgtctccgtggccgacgggcggatttcagtggcccagggtgcatcgaaggcactgctggtggctgactttggactgcaagtcagctatgactggaactggcgggtagacgtgacgctccccagcagctatcatggcgcagtgtgcgggctctgcggtaacatggaccgcaaccccaacaatgaccaggtcttccctaatggcacactggctccctccatacccatctggggcggcagctggcgagccccaggctgggacccactgtgttgggacgaatgtcgggggtcctgcccaacgtgccctgaggaccggttggagcagtacgagggccctggcttctgcggacccctttcatctggcacagggggccccttcaccacctgccatgctcatgtgccacctgagagcttcttcaagggctgtgttctggacgtctgcatgggtggtggggaccgtgacattctttgcaaggctctggcttcctacgtggccgcctgccaggccgctggggttgtcatcgaagactggcgggcacaggttggctgtgagatcacctgcccagaaaacagccactatgaggtctgtggcccaccctgcccagccagctgtccgtcccctgcaccccttacgacgccagccgtatgtgagggcccctgtgtggagggctgccagtgcgacgcgggtttcgtgttaagtgctgaccgctgtgttcccctcaacaacggctgcggctgctgggccaatggcacctaccacgaggcgggcagtgagttttgggctgatggcacctgctcccagtggtgtcgctgcgggcctgggggtggctcgctggtctgcacacctgccagctgtgggctgggtgaagtgtgtggcctcctgccatccggccagcacggctgccagcccgtcagcacagctgagtgccaggcgtggggtgacccccattacgtcactctggatgggcaccgattcgatttccaaggcacctgcgagtacctgctgagtgcaccctgccacggaccacccttgggggctgagaacttcactgtcactgtagccaatgagcaccggggcagccaggctgtcagctacacccgcagtgtcaccctgcaaatctacaaccacagcctgacactgagtgcccgctggccccggaagctacaggtcgacggcgtgttcgtggctctgcctttccagctggactcgctcctgcacgcacacctgagcggcgccgacgtggtggtgaccacaacctcagggctctcgctggctttcgatggggacagcttcgtgcgcctgcgcgtgccggcggcgtacgcggcctctctctgtggcttatgcgggaactacaaccaggaccccgcagacgacctcaaggctgtgggcgggaagcccgctggatggcaggtgggcggggcccagggctgcggggaatgtgtgtccaagccatgcccgtcgccgtgcaccccagagcagcaggagtccttcggcggcccggacgcctgcggcgtgatctccgccaccgacggcccgctggcaccctgccacggccttgtgccgcccgcgcagtacttccagggctgcttgctggacgcctgccaagttcagggccatcctggaggcctctgtcctgcagtggctacctacgtggcagcctgtcaggccgctggggcccagctcggcgagtggaggcggccggacttctgtcccttgcagtgccctgcccacagccactatgagctctgcggtgactcctgccctgtgagctgcccgagcctctcagcacccgagggctgtgagtcggcctgccgtgaaggctgtgtctgcgatgctggcttcgtactcagtggtgacacctgcgtacccgtgggccagtgtggctgcctccatgatggccgctactacccactgggcgaggtcttctacccgggccctgagtgtgagcggcgctgtgagtgtgggccaggtggccatgtcacctgccaggagggcgcagcctgtgggccccatgaggagtgccggttagaggatggtgtccaggcctgtcatgccacaggctgtggccgctgcctggccaacgggggcatccactacatcacccttgatggccgtgtctacgacctgcatggctcctgctcctatgtcttggcccaagtctgccacccaaagcctggggacgaggacttttccatcgtgcttgagaagaatgcagctggagatctccaacgcctcctggttactgtggctggccaggttgtgagcctagctcaggggcagcaggtcaccgtggacggcgaggctgtggccctgcctgtggctgtgggccgcgtgcgggtgaccgccgagggccgaaacatggttctgcagacgaccaaggggctgcggcttctctttgatggcgatgcccacctcctcatgtccatccccagccccttccgtggacggctctgtggcctctgtgggaacttcaatggcaactggagtgacgactttgtcctgcccaatggctcagcagcgtccagtgtggagaccttcggggctgcatggcgggcgcccggctcctccaagggctgtggcgagggctgcgggccccaaggctgcccagtgtgcttggcagaggagactgcaccctatgagagcaacgaggcctgcgggcagctccggaacccccagggccccttcgcgacctgccaggcggtgctgagtccctctgagtacttccgccaatgcgtatacgacctgtgcgcgcaaaagggtgacaaagccttcctgtgccgcagcctggcagcctacacggcggcctgtcaggcagctggcgtggccgtgaagccctggaggacagacagc

SEQ ID NO: 5501 - DNA, 11825 bp, Homo sapiens
gctctccgccccgcgctctccgcgcccgctcgccccgcgccgatctacttgccgggaaggcggcgccggtggcggctgctctccctgagcccgctcccgagcgctgctttcccgccgcgggtgggcttcgcagcctcaggccagccgcggcccttggcccgctgcagccccggccctccaccttccccgtgcaggggcggcccggccagtgtcgctcatcccgggacgctcccttctcccacccaggactgccccgcggagctggcttggacacccaactttgccacctcgagggtcgtctctgctgggcgcgaacctgcccacccaccggttggccgcgcgctcggggaccgtgctcgtggcccccaagccggtgcccccattctggaactcagcgagtagggggcggctctggggaagtggcagggggcggctgcagctgctgcctccacttccctagccaggtgctgaagaggatcctcggagccgctctggcccccaggcgctggatgactggcaccagcgctcctcgcacctgtgttggtgtgtgagacttgggctggagtgcccacgtggctgtggagtcagtgtgattcatgattgaggaaacgcgtcctccatcctctctctccttggcactttccacacatgaggagaagaagagcttctgtttagaagacacgtgcccagagtcagaggccccttgcccaccatgaagggaacctgtgttatagcatggctgttctcaagcctggggctgtggagactcgcccacccagaggcccagggtacgactcagtgccagagaaccgagcatccagtcatctcctataaagaaattggcccctggttacgggagttcagagcgaagaatgctgtggatttctcgcagttaacatttgacccaggacagaaagaacttgttgtaggagcaagaaactacctcttcaggttacagcttgaggatctgtctcttatccaggctgtggaatgggagtgtgatgaagctaccaaaaaggcctgttacagcaaaggcaaatcaaaggaggaatgtcagaactacatccgggtgcttctggtgggtggcgaccggttattcacctgtgggaccaatgcattcacgcctgtctgcaccaaccgctcgttgagcaacctgactgagatccatgatcagatcagtggcatggcccgctgtccctacagtccccagcacaattccacagcgctcctcacagctggtggggagctctatgctgctacagccatggattttccaggacgtgatcctgccatttaccgaagcctaggcattttacctcctctccgcacggcgcagtacaactccaaatggctcaatgagccaaactttgtgtcatcttatgacatcggaaattttacctacttctttttccgagaaaatgcagtagagcatgactgtgggaaaacagtgttctccagagctgcccgggtgtgcaagaacgatattggtgggcgcttcctgctggaagacacctggaccacattcatgaaggctcgcctgaactgctcccgtcctggggaagtccccttttactacaacgaattgcagagtactttcttcctgcctgagctggatttgatctatggcatctttaccaccaatgtgaacagcattgcggcctcagctgtgtgcgtcttcaacctgagcgccatcgcgcaggccttctctgggcccttcaagtaccaagaaaactcgcgctcggcctggctaccgtatcccaacccaaacccccacttccagtgtggcaccgtggaccagggcctgtacgtgaacctgaccgagagaaatctgcaggatgctcagaagttcattctgatgcatgaggtggtacagccagtgaccacagtgccctccttcatggaggacaatagccgcttttcccacgtggcagtcgacgtggtgcagggcagagaagcgctcgtccacatcatctatttggccacagattacggaaccattaagaaagtgcgggtacccctgaatcagacctcaagcagctgtttgctggaagagattgagctcttccctgagaggcggagggagcccatcaggagcctgcagatcctgcacagccagagtgtcctgttcgtgggcctgcgggagcacgtggtcaagatccccctgaagaggtgccagttctaccgcacacgcagcacctgcattggggcccaggacccttactgtggctgggatgtggtaatgaagaaatgcacaagcctggaggagagcctgagcatgacgcagtgggaacagagcatctctgcgtgtccgaccaggaatctcaccgtggatgggcactttggtgtgtggtctccgtggacgccttgcacgcacacagatggcagcgccgtgggatcctgcctctgtcgaacccgctcctgcgacagcccggccccgcagtgtggtggctggcagtgcgagggccctggcatggagatcgccaactgttccaggaacggaggctggactccctggacctcgtggtctccctgcagcactacctgtgggatcggcttccaggtgcggcagcgctcctgcagcaaccccactcccaggcacgggggccgggtgtgcgtgggacagaaccgcgaggaaagatactgcaatgaacatttgctatgtcccccacacatgttctggacaggctggggtccttgggaacggtgcacagcccaatgcgggggtggcattcaagctcgccgcaggatctgtgagaatgggcctgactgtgcaggctgcaatgtggagtaccagtcttgcaacaccaacccgtgtcctgagctgaagaagaccacgccctggacaccctggacacctgtcaacatctctgacaacggcggccactatgagcaacgattccgatacacatgcaaagcccgcctggctgatccgaatttgctggaagtgggaagacagagaatcgaaatgcggtactgttctagcgacggcaccagtggctgctccacagatgggctttctggggatttcctgcgtgctgggagatactctgcccacacggtcaacggggcttggtcagcctggacgtcgtggtcacagtgcagccgtgactgcagcaggggcattcggaaccggaagcgtgtttgcaacaaccccgaacccaagtatgggggaatgccttgccttggcccatctctggaataccaggaatgcaacattttgccctgcccagtggatggcgtgtggtcttgctggtccccctggacaaaatgttcagcaacatgcggcggtggacactatatgaggacccgctcttgctccaatccagccccggcctatggaggggacatctgcctggggctgcacacagaagaggcactctgcaacacgcagccctgcccagagagctggtcggagtggtcggactggtctgagtgtgaagcctctggcgtccaagtccgcgcccgccagtgcatcctcctgttccccatgggcagccagtgctccgggaacaccacggagagccggccgtgtgtgtttgactctaatttcatcccagaagtatctgtggcaagatccagtagcgtagaagagaaaaggtgtggagagttcaacatgttccacatgatcgccgtggggctgagcagctccatcctcggctgcctcctcaccctgctcgtctatacttactgccagcggtaccagcagcaatcccacgatgcgactgtcatccaccccgtctcacctgccccccttaataccagcataaccaaccacatcaacaaactggacaagtacgactcggtggaggccatcaaggcatttaacaaaaacaacttgatcctagaggaaagaaacaaatacttcaacccacatctcactgggaagacctattctaatgcctactttacagatctcaataattatgatgagtactaacagctttcatgtttttggcttcttgtaaatccccagttcctcaaggcctgtgccccatgactgcccatgtttctgaggcttcagagtcgaagtttggatacatttcaagtgcatttcaagccaccagagtgtcccattgctgccaaaaatacacgtctttaaaagcaacaaaaattgaaataagacatcgtgaaaatcttgaccattgttgaatgagccagggtgtgaagtttttaattgtgttcatcctatttttctgacaagtccattggtttgttttttgagcattattttataaatgtgccacccacattggaaggagtctttctttagaactttggagtgtaaatcttcatgatgttgtaattcaagaaaataggcactttctctgaaagacctgctccttccacaagaagtgcataggtccataatatttcataaaatgaagaaaaagaatgtggccaaacaattattcaccatggattgcccaactttccaaatctggataaagctgtgggattcttggaagcagcttgagtgttttcatcttgcctgggaagcccaggaattccacctggtccacaccggcagaagttacagtagactgtgaggcaccccaccttgctcctgatgcagtttctgtgccattgctggtgctggtggaggcagcggagcagaggctcaggcacaatgaagcgtggatgtgttctgcaggttgctgcaaaactcaccttattctgacttttggatttcatggcattccaggaagctccttgccatgctgttggcctggaagtccacctgtctggtccatagtgacgtcctgaagagccagtctgtaaaataaccaaccacttacttagcgtttggatagactccatgccttctctctccctgcaaagaaaaatcttgaacatttatgatgtcaattagtgaaagtattgaaaatactaaattataactaaaagcaactttttatgttattgaaaatattgaaagaactgatattaatgataatcattttatttttcatctctctgatatacccaatgtgtggcaatcagcccctaccacgagcattaatgccatgtaaagctggctttctggagtctgccaggtccacacgaagtgctacccccagtttctgctgttacttgctgcctccaggccaggggagcaggagatgctcagctctggtgccttttcttttatttcagtgctgccttcccacccacccagtccattcaccctcacctctccctgcatggaggcaacagcatttcaagatgtaccttgggaagtcaggatagctggaagtaagggtttttgggatccctgtggtctcttcactgatcatcgataagcatttaagagtgtgctaacaccattcacagaggtccctggaaaaaaatatataattttctcacaaacaaccaatacataacctatggcagttggttgaataattattgaaaaaaagaacacgactgaaaaagttcatctgatgcctctgagcatgtgataaagtcctgggtagacacggaaacgtgttcttacaaatgaaccttcggatctatgaaagaaaatatagtagggggactaaggaacatagaattttattagcatatgtgattttacccttatctttgtttctaatttaaagaaacaatttcagaaagtgttagaagaattctatgtttaataatgaatattgttgagttcaaaatattctcatatacccagatttacagagatgacacagtattgaaatggcaggtgggctctgtaagttattttggattaatgacattcagggtctttgcagtggggacttcatgttgcctctcactcattcctcatatgtcagagtcttctgtctatatgcacatgctcaaagtccatactcagtaggggaaatctagccggatggttctccaattgttcctcggctggattttcatcatcagatatttcaactcatctcatcagtttcttgtaagaaaaaaacattttcactttgtagcacattttagttatttttgagtcttcttccctaatagtttgtaagcttaaagggacattttattttccctggtaaagaggattctaatatttcaagaatgtttcactggaattgatgggaaatggtttctaaatggcatcgaagctggtctttaatgagtcttttgcaatgacttgggaaaaacaccctccctcactacaggatcttcatgttgttaataatataaacaaacctttgaaattagcattgcaaaagaatcccatttttgtttcgtaccacactgttcaaaggaaaattgtttatctctcttcctttctctctctctcttatttgacagaatagcaagtgtttagataatttcagatatattctaagtattttaccagctgtggaataagttgtgtttgtccatcactgtgtagctaccgttcacatgttctggctctgtactccacgcttatcgcgtgaaccctcacatgttggactttcacagtgtgatctctcacctgtcttggaaactccttcataaagccgctcttccttaggcctgggctgtttggaagtcctggtgaaactttgcggttcacattttaaattcctgaatgaccttttcattctctctttctttatctttgtttttgtccttcattccctccttttgttcttccttcctgccttcttttcttctttcctttcttctttctttaattcttcctttcttcctattttcttggtacaagtggaacaaaaaccaacacatagttttaagctacacctttctgcacctgatgtaaaatgacattaatcactatttaacttctaaaattatttctgaatacagttggagataggctggttttcatgaggaagctggcttggctttagtcttacatttaaattctttgaaagtggctcccagtgctattcagggtcctttcttgaggccagactcatcaccatctactattgattttacagtgcactgacagtttacaggaaggagaagaacagaatttctgcacactacacaacatgtgggcttcctgtagctccagggacatgtagctttggtgaaactggggttttgtaacctctgaatgatatggacttagtgaattctaaggaactcagggggcacgtggtcaggctccaccgcacagaagagccacagtctccagactcatggcgttccctccagaactccccattcccctctgagcatatttctatgctgctgcttcttgtgacttacatgaggcatctcagcttcttcatgtttgtagggatggttccctaagcctgttcaagtaggctctcactagagttaccattcatatttgagaagaaaagaacatttaataaatgtatgtgtggggctgaggttctaaaggaattgaaaagagacgataaacattgaatgagggtgagggcatccctgctggggagaaacctctgtccctaggaagagtccgttcatgtcatgtggtttgggatgaaccaggggtctggccccatcgggtcacaggtgatggcaaatagaaaagaagcaaatggaggaaatagtcggataagtaggtgacgtgaaaggcaggacctggtcaccccagcaagtgctatggacagttcccggaaacggttgcccacttcacaggtccatgggtctgacccttggactctgccaggatcaactgcccagagtgccagagttttagccaaaggtgtacttacttccttatttatctgcaaaaggatggaaactgtgggagtcaaagcctattttgctgagtgttcccactggagtctctggtagaattagcaggtcatgctgtcaaaatcatggacaaaggctgggtgcagtggctcatgcctataatcccagcactttgggaggccaaggtgggcggatcacctgagctcaggagtttgagaccagcctgggcaacatggggaaactccatctctacaaaatatacaaaatattagccagccatcgtggtgcgtgcctgtggtcccagtttcttgggaggctgaggcgggagtatcatttgagccaggaggttgaggttgcagtgagctgagatcacatcactgcactccatcctgggtgacagagagagaccctgtctcaaaaaaaaaaaaaaagaacaaagtcttagcggggggtctctatgtccccaagtggctctctaaggggatccattagcgtataattgaatatcaaagggaattttaccttaaacatatatcaagtctatactcagctaatcgttttgtctaaacacagccttgttagcatttgaatttacaaatattcatttgcttatttgcagtgttccttttgcttttagaataaatcataaatatttccccaatactgtcaagatacttcttcaactttgtccctgaaccatcagctttctttagggtccgggtatcctttacacttcaatggggttttcttgtgtgtgtcattgggggtaactccattgacctcagcatttctatctcaagagatggctctggaacacagaaccagaggcaacaggtactaatggttgataaaattaacagcgactgcataaccattttccacatggcagggctgtgcttaagccccacacctccaataatcaatttctatgacggtactaataaccttaactatatgcaaattcttcaccacttatgatatggtacaaactggagtttacagatggccttggccttgcctagcccatttgttcatcctaacttcttcatcacttcctgatgcacttggggaagcatgttgacacaacgttaccaatatttgattacctatggttatctgcaattacctacgcttatcttatcagaccctagatgccatttgagccccttacttctttgggcagtgggtgaaatgggagaacatagagaaatgttcactttgacctaagaaacgcataaaagggaatgccatgcacaatgtaagataaaatgtttggggacaggggatcatcgtgaaatttatttctgctattctgccctattgaggtcattaattataatggatttaaagatttttttttaaactctacaaacactaagccaaggaattcaggttatctgctatgttaacctaataaagcaaaggaaaataagttgctttaatccttgcttgttaacctaataaagcaaaggaaaatatgttgctttaatccttgcttcttttctcttttggtaatagaaaaggtaaataagatgtaatgttgaactgctggtgatgatttctaaaacgactctttaaatactcctttcctatggacttatattaaagatgcattgtacacattgttttagcagatagatcaaagatatactcagtggtcatctgttgcattatcagaaatttgatacatgttacagaagcatgaggaagggaatcctatccacttttgaaaatagagttcacattgcaagcgacatagggcattatcaaaaccaattcagagcctggcacaaaatgtatacttcctagtgaaagctgtctcaaaacacagcctttttgatggatcatattagctcatatctgccatagaaaggcaatcaagcttactccctgcaatcggagtcaatatcaattcttgctcaagcaaacatgttttacagtgttggcgcaatggcaggaactagtcaagggcactttcagatctggaaagaggaaagaggaggtagaaaatcactcttttgtgtttcttaaactgtcaatcaagcaagaaaatttattccaccccttcatatttgctctaaaatctggggccagtagttgaaatgtgatcttgttctttctcagccttttggcaatttaatgccaaatattccaaatgttagatgaatggcagtaataaaatgattcaaatgtttgataaatacaagctgagagcaaaatctggactctgaaaaatcggaactattttatcatgttgctaaaatgagagcatcattttcttccctctctgtaagtgcggtagtttaatttcctagaaaaagttgctagtgccttgtttaagatgatcatttatcatttcatgtggatattattggtctaattagaaggagaagattgattggatttactttaaagaaaattattctcctatgtctctttgaactcaggaatagaaaatgaccaagaagcacatcatcttcagatgtgatttttgccctcactggggatgtagaaccagaataggtacaacatatgctcagaagagaggtgacttcagtattagccttctagaaactaacatcactttaatttttacatgttccaaaaaaaatcatagtgattgttctgtaataagaatgttaacgtgatgcctatagaagttagaggtttttgtttctgtttctcttcaggcaagtccatagatagaggaaaatcagacacaggctggtgacaactggtatagatacagtgagcatggaatgagaaccacctacaacattgcctgattatttttaagtttatatcaaaactgcttcacaagttcacaaaagttgtcactcttaatttgggttaagaaaagtaatagtattatctctgctgaagttgattgtttttctcttttaccatgactgttggccaaaagcaagctgaacctctgcactttgaaacaaagcacagtatgaatctttaacccaagcacttagtttcaccactgagattctacatcatctgcaagaaaatgcacaaacttttggtccaatgttggattcttcaaaagtgcatagcaaaacttttgtgctatgccgcttgatgtaacttttaaagatgttatcaaatgttaaatgcctcattctgcgttaatttgctgttggctgttttgtgaacacaaaataaacttgagatttttttttttttttttttttgtgaaactcctccaaagccaatttcagcccttggtaagcttgcagacagttactgatcttaaatttaattttaaaagacaatgtatcttaattataatttagctttttaaaacaatgagatagctttacatttcccctttgtttgaatgagaaaatggatcttgggttgctatgctagaacacttgtagattgctgggtcctttgtaagggggccatggacacaccacactttctttcaatccttacatttgaagcattgatattcttcaaaaccttcttgttacatgtgcgcaatagaaatttctaatgttcatgacttttatctttcctgtccatcaattcactggttgtaaatgcttcctgagagctgtctaggtctgtatcccagattgttgcttaatgacatctgacagatgcattgttttctgaaatcagcttaagacaccaattgtggcaactggaaactcattacctgctgcattggatcaactatggaagttggagcaggggtgggcggaggtcacctaaccaatcaatggaaggcaactcacacctgctccaagcctcagctttgagaaacaaacacgtttataagaaaaaatatatagctattattacagaagtgaatatgttgtgctctcttactgctcttggtgcattgacagtttctgtatctcaaccctattcatctttatgaaaaagcattctgaagatctatcctcagcactgctgagtgtgcagtcacactttcctaccaacccccttcttaccatctctagctgccatttgtggggggaacaaaacaagggaatcctgattgtgtacagtataaattgtattatattttttgtacttatgttttatgtaaatagtttgtctcattcaattgtatgtgagcattgaaataaatcctaccatttaggggacaatttaaaaaaaaaaaaaaaaaa

SEQ ID NO: 5502 - DNA, 3128 bp, Homo sapiens
gcttcgccccgtggcgcggtttgaaattttgcggggctcaacggctcgcggagcggctacgcggagtgacatcgccggtgtttgcgggtggttgttgctctcggggccgtgtggagtaggtctggacctggactcacggctgcttggagcgtccgccatgaggagaagtgaggtgctggcggaggagtccatagtatgtctgcagaaagccctaaatcaccttcgggaaatatgggagctaattgggattccagaggaccagcggttacaaagaactgaggtggtaaagaagcatatcaaggaactcctggatatgatgattgctgaagaggaaagcctgaaggaaagactcatcaaaagcatatccgtctgtcagaaagagctgaacactctgtgcagcgagttacatgttgagccatttcaggaagaaggagagacgaccatcttgcaactagaaaaagatttgcgcacccaagtggaattgatgcgaaaacagaaaaaggagagaaaacaggaactgaagctacttcaagagcaagatcaagaactgtgcgaaattctttgtatgccccactatgatattgacagtgcctcagtgcccagcttagaagagctgaaccagttcaggcaacatgtgacaactttgagggaaacaaaggcttctaggcgtgaggagtttgtcagtataaagagacagatcatactgtgtatggaagaattagaccacaccccagacacaagctttgaaagagatgtggtgtgtgaagacgaagatgccttttgtttgtctttggagaatattgcaacactacaaaagttgctacggcagctggaaatgcagaaatcacaaaatgaagcagtgtgtgaggggctgcgtactcaaatccgagagctctgggacaggttgcaaatacctgaagaagaaagagaagctgtggccaccattatgtctgggtcaaaggccaaggtccggaaagcgctgcaattagaagtggatcggttggaagaactgaaaatgcaaaacatgaagaaagtgattgaggcaattcgagtggagctggttcagtactgggaccagtgcttttatagccaggagcagagacaagcttttgcccctttctgtgctgaggactacacagaaagtctgctccagctccacgatgctgagattgtgcggttaaaaaactactatgaagttcacaaggaactctttgaaggtgtccagaagtgggaagaaacctggaggcttttcttagagtttgagagaaaagcttcagatccaaatcgatttacaaaccgaggaggaaatcttctaaaagaagaaaaacaacgagccaagctccagaaaatgctgcccaagctggaagaagagttgaaggcacgaattgaattgtgggaacaggaacattcaaaggcatttatggtgaatgggcagaaattcatggagtatgtggcagaacaatgggagatgcatcgattggagaaagagagagccaagcaggaaagacaactgaagaacaaaaaacagacagagacagagatgctgtatggcagcgctcctcgaacacctagcaagcggcgaggactggctcccaatacaccgggcaaagcacgtaagctgaacactaccaccatgtccaatgctacggccaatagtagcattcggcctatctttggagggacagtctaccactcccccgtgtctcgacttcctccttctggcagcaagccagtcgctgcttccacctgttcagggaagaaaacaccccgtactggcaggcatggagccaacaaggagaacctggagctcaacggcagcatcctgagtggtgggtaccctggctcggcccccctccagcgcaacttcagcattaattctgttgccagcacctattctgagtttgcgaaggatccgtccctctctgacagttccactgttgggcttcagcgagaactttcaaaggcttccaaatctgatgctacttctggaatcctcaattcaaccaacatccagtcctgagaagccctgatcagtcaaccagctgtggcttcctgtgcctagactggacctaattatatgggggtgactttagtttttcttcagcttaggcgtgcttgaaaccttggccaggttccatgaccatgggcctaacttaaagatgtgaatgagtgttacagttgaaagcccatcataggtttagtggtcctaggagacttggttttgacttatatacatgaaaagtttatggcaagaagtgcaaattttagcatatggggcctgacttctctaccacataattctacttgctgaagcatgatcaaagcttgttttatttcaccactgtaggaaaatgattgactatgcccatccctgggggtaattttggcatgtatacctgtaactagtaattaacatcttttttgtttaggcatgttcaattaatgctgtagctatcatagctttgctcttacctgaagccttgtccccaccacacaggacagccttcctcctgaagagaatgtctttgtgtgtccgaagttgagatggcctgccctactgccaaagaggtgacaggaaggctgggagcagctttgttaaattgtgttcagttctgttacacagtgcattgccctttgttgggggtatgcatgtatgaacacacatgcttgtcggaacgctttctcggcgtttgtcccttggctctcatctcccccattcctgtgcctactttgcctgagttcttctacccccgcagttgccagccacattgggagtctgtttgttccaatgggttgagctgtctttgtcgtggagatctggaactttgcacatgtcactactggggaggtgttcctgctctagcttccacgatgaggcgccctctttacctatcctctcaatcactactcttcttgaagcactattatttattcttccgctgtctgcctgcagcagtactactgtcaacatagtgtaaatggttctcaaaagcttaccagtgtggacttggtgttagccacgctgtttactcatacagtacgtgtcctgtttttaaaatatacaattattcttaaaaataaattaaaatctgtatacttacatttcaaaaagaaaaaaaaaaaaaaaa

SEQ ID NO: 5503 - DNA, 1936 bp, Homo sapiens
gcttgtgggcgggcccgggcaggagcgggcttgccctgcggagcagtagctaggaacagatccacttgcaggttgctgttcccagccatggcttcgcgctgctggcgctggtggggctggtcggcgtggcctcggacccggctgcctcccgccgggagcaccccgagcttctgccaccatttctccacacaggagaagaccccccagatctgtgtggtgggcagtggcccagctggcttctacacggcccaacacctgctaaagcacccccaggcccacgtggacatctacgagaaacagcctgtgccctttggcctggtgcgctttggtgtggcgcctgatcaccccgaggtgaagaatgtcatcaacacatttacccagacggcccattctggccgctgtgccttctggggcaacgtggaggtgggcagggacgtgacggtgccggagctgcgggaggcctaccacgctgtggtgctgagctacggggcagaggaccatcgggccctggaaattcctggtgaggagctgccaggtgtgtgctccgcccgggccttcgtgggctggtacaacgggcttcctgagaaccaggagctggagccagacctgagctgtgacacagccgtgattctggggcaggggaacgtggctctggacgtggcccgcatcctactgaccccacctgagcacctggaggccctccttttgtgccagagaacggacatcacgaaggcagccctgggtgtactgaggcagagtcgagtgaagacagtgtggctagtgggccggcgtggacccctgcaagtggccttcaccattaaggagcttcgggagatgattcagttaccgggagcccggcccattttggatcctgtggatttcttgggtctccaggacaagatcaaggaggtcccccgcccgaggaagcggctgacggaactgctgcttcgaacggccacagagaagccagggccggcggaagctgcccgccaggcatcggcctcccgtgcctggggcctccgctttttccgaagcccccagcaggtgctgccctcaccagatgggcggcgggcagcaggtgtccgcctagcagtcactagactggagggtgtcgatgaggccacccgtgcagtgcccacgggagacatggaagacctcccttgtgggctggtgctcagcagcattgggtataagagccgccctgtcgacccaagcgtgccctttgactccaagcttggggtcatccccaatgtggagggccgggttatggatgtgccaggcctctactgcagcggctgggtgaagagaggacctacaggtgtcatagccacaaccatgactgacagcttcctcaccggccagatgctgctgcaggacctgaaggctgggttgctcccctctggccccaggcctggctacgcagccatccaggccctgctcagcagccgaggggtccggccagtctctttctcagactgggagaagctggatgccgaggaggtggcccggggccagggcacggggaagcccagggagaagctggtggatcctcaggagatgctgcgcctcctgggccactgagcccagccccagccccggcccccagcagggaagggatgagtgttgggaggggaagggctgggtccgtctgagtgggactttgcacctctgctgatcccggccggccctggcttggaggcttggctgctcttccagcgtctctcctccctcctggggaaggtcgcccttgcgcgcaaggttttagctttcagcaactgaggtaaccttagggacaggtggaggtgtgggccgatctaaccccttacccatctctctactgctggactgtggagggtcaccaggttgggaacatgctggaaataaaacagctgcaaccaagaaaaaaaaaaaaaaaaaaaaaaaaaaaaaaaaaaaa

SEQ ID NO: 5504 - DNA, 1203 bp, Homo sapiens
gtggaaattgaggggagaaaaaaaaagggaaaaaaagggtctgtccttcctgggattcctagccgaggccagtctgctgccgtgtgcgtgtgcgtcagggctctccgggcggcaatgggggcttgagagccgggtccccagcgccgggaagggagcgcggtggccgccaccgccaccgccccggagtccggcgccgaagctgcgggcgggcgggcgggcaccagctcggtcaggggctgcttggcgcggcactgtgcggtgcagcggcggcgcggcgcggtgcgggcttttcccaggcgccccggggtcgggtggccaacggcgcggccgcgggcgctgagcgcgaccggttcgcggtagcggtggcggcggcgtgcgtgccaggggctgggggctccgccgcctctcttgcggctcaccgagctccgcgcttccctctctccagggcaggcggcttctcagagcacaacagctccagctggcagcatcacttcccgccaatttatccaacttctgccaaggctctgaaatgccaacaacgtcgaggcctgcacttgatgtcaagggtggcacctcacctgcgaaggaggatgccaaccaagagatgagctccgtggcctactccaaccttgcggtgaaagatcgcaaagcagtggccattctgcactaccctggggtagcctcaaatggaaccaaggccagtggggctcccactagttcctcgggatctccaataggctctcctacaaccacccctcccactaaacccccatccttcaacctgcaccccgcccctcacttgctggctagtatgcagctgcagaaacttaatagccagtatcaggggatggctgctgccactccaggccaacccggggaggcaggacccctgcaaaactgggactttggggcccaggcgggaggggcagaatcactctctccttctgctggtgcccagagccctgctatcatcgattcggacccagtggatgaggaagtgctgatgtcgctggtggtggaactggggttggaccgagccaatgagcttccggagctgtggctggggcagaatgagtttgacttcactgcggactttccatctagctgctaatgccaagtgtccctaaagatggaggaataaagccaccaattctgttgtaaataaaaataaagttacttacaaaaaaaaaaaaaaaaaaaaaa

SEQ ID NO: 5505 - DNA, 2089 bp, Homo sapiens
gtttgagcagcattgttagagcctgtggaaaacactttacaactgtgtaactgtcttcatctttacagaggaatagtctacaaaggaagacttgtaacctggagaagagacctgtcatttactccatcctttatagtgatgctacaggacgaagaggaatggataaaaacattggcgagcaactcaataaagcgtatgaagccttccggcaggcatgcatggatagagattctgcagtaaaagaattacagcaaaagactgagaactatgagcagagaatacgtgaacaacaggaacagctgtcacttcaacagactattattgacaagctaaaatctcagttacttcttgtgaattccactcaagataacaattatggctgtgttcctctgcttgaagacagtgaaacaagaaagaataatttgactcttgatcagccacaagataaagtgatttcaggaatagcaagagaaaaactaccaaaggtaagaagacaagaggtttcttctcctagaaaagaaacttcagcaaggagtcttggcagtcctttgctccatgaaaggggtaatatagagaagactttctgggatctgaaagaagaatttcataaaatatgcatgctagcaaaagcacagaaagaccacttaagcaaacttaatataccagacactgcaactgaaacacagtgctctgtgcctatacagtgtacggataaaacagataaacaagaagcgctgtttaagcctcaggctaaagatgatataaatagaggtgcaccatccatcacatctgtcacaccaagaggactgtgcagagatgaggaagacacctcttttgaatcactttctaaattcaatgtcaagtttccacctatggacaatgactcaactttcttacatagcactccagagagacccggcatccttagtcctgccacgtctgaggcagtgtgccaagagaaatttaatatggagttcagagacaacccagggaactttgttaaaacagaagaaactttatttgaaattcagggaattgaccccatagcttcagctatacaaaaccttaaaacaactgacaaaacaaagccctcaaatctcgtaaacacttgtatcaggacaactctggatagagctgcgtgtttgccacctggagaccataatgcattatatgtaaatagcttcccacttctggacccatctgatgcaccttttccctcactcgattccccgggaaaagcaatccgaggaccacagcagcccatttggaagccctttcctaatcaagacagtgactcggtggtactaagtggcacagactcagaactgcatatacctcgagtatgtgaattctgtcaagcagttttcccaccatccattacatccaggggggatttccttcggcatcttaattcacacttcaatggagagacttaagacacatttgaaaacagacatatcaagttctatgtgatgattttgggtttttaatactataaatacttgattgtaaactaaattcaagatcatttataggaaaatctagtttcacagctatttgaatttttttctggatttactatataactcttattttttaaaagatcattctgttctttcaaggagaaataagcctaaaagaagaaaaacaaaaaaaattctgtataaaactgtaatcctttgtattcatgtttacagtgctattactataattcaaaattatgtatgtgacttagagttatataatcataatttatgtttatttcaaatatctaagtttattgcttggatttctagtgagagctgttgaatttggtgatgtcaaatgtttctagggtttttttagtttgtttttattgaaaaatttaattatttatgctataggtgatattctctttgaataaacctataatagaaaatagcagacaacataaacatctttgtaaatatcaaacctaatacatttcttgtccagtgataaaacaactggtagaattatttaaacactttagatttttaaataatatacatggctttaatttttactgtgtgtatagctacatgatgaaattaattaaatattaagaggt

SEQ ID NO: 5506 - DNA, 728 bp, Homo sapiens
gcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattcttcaacagaaaaaaaaaaaaaaaaa

SEQ ID NO: 5507 - DNA, 2478 bp, Homo sapiens
gtatttccggagtcccttctgagacagaaggttgtgttggggaactgaaggagtttctgtgggcggacagggaaccctgcgtttctactgtgtgattctgccaccttcctggcccgacgccatgggagtgacttgtgtgtcccagatgcctgtggccgagggcaagagtgttcagcaaaccgtagagctccttacccggaaattggagatgcttggggcagagaagcaaggaacattttgtgtggactgtgagacttaccatacggccgcctctacccttggcagccaaggtcagaccgggaagctgatgtatgtgatgcacaactcagagtacccattgagctgtttcgccctctttgagaatggcccttgccttattgctgacaccaactttgatgtgcttatggtgaagctcaagggctttttccagagtgctaaggccagcaagattgagacccggggcaccaggtaccagtactgtgacttcctggtgaaggtgggcacggtcacaatggggcccagtgcccggggcatctctgtggaggtggagtatggcccctgtgtggtagctagtgactgctggagtctgctgctcgagttcctacagagttttctaggcagccacacaccaggggctcccgcagtgtttgggaacagacatgatgcggtctacggcccagcagataccatggtccagtacatggaactcttcaacaagatccgcaagcagcagcaggtgccggtggctgggattcgttagtgatgagcagctgccagctgagctctgtcaccaggggtactccacaggaggagcaggtgctgactttcaggtccctggaccccagaaacccagggtagacatggactctactctccttctctggttctcagctgtggcttttgttctggggctgagtcccctccccaaccccctgactctcacacatagccccccatcagctgttttactccgtgccttactggatttggcctgtcctcaagaatggtaattatgaagagtggagaagtttggaccttgcctcctttaggggaaaggtaggacaggaatgtccctgcctggtactggtgggggaaatagtccgtatccccaactattaaggatttgtcccaggccaatggtgaacatgctgcattttatgtttggattgtgctgtaataagagcctcttccttccctcagaggatgtggctgggcttctatcctagagatggagtagaaggcacaactggtttgatagttactattttctgacctgtttgctgaagtgatttgcgaattgactttcctagggtgttgcctgagtcctttgaaatctccttctgacatctttcccttctgttgtgaaatatgttaagccacaggccaaactgctataagatcgaagtttgtttttttctcacctaataatagagaggtaatcagatggtctagggcagatttaactctacaaggttatcaggaactttgtttccttctgtcttattcagccattcccagtatgttttcttacccataagatcaaagcagactcatcagctccatatctgcattccactggggaaagagagagagaaaagagcagattttaaaaaaaagatatgactgagcattgctcagatcactgtggccacactttgctgaaagagatgctgggacatagaacctcttatctgggcagtcatgtgctgagttaaaactcagggattctgtgactacaagatgaaagacaatttggttgctgagatgcagttaatggcttctgttacatggagctcaatggacgtgcccaggaatgcttttggctgttattttgcagttaatacctcctgtaactaaagcatttgtttatgagttgacttgagagaagggctgatctcagagccgctttgagctaagttggattagtcacactaggaagttaattccacacctttcgtctaagtctcagtattgaggcctctccagttctcatgcaccctgatcttagggttagaatacttgaccctgatacctgcaccatgcttcatggttcctgagctctttctcctgtttcatttgagcctccaaactacatatttggtcatattgcctgcctaccccatgcctgctgcagaaatattcatccaggttaaccttgatatacacagagatggtcttggagaattgtgaatgtatgtactgtattgtcatcaaggatactgtcccttatttgaaggcatctaaagagaaactgttttcagatccaagtgctcagatctaaagcctctgcaacaagtcaggtggtggtcatgtttcccttctagttttggctgacaggaagctcagttcagtaccataactacagaacctgtcatctgtattttttgttctcaccccgtttttgttattttgtttctggttttttatattgaggtatgttttagatatagtttacaaaaataaaacgcacagatctta

SEQ ID NO: 5508 - DNA, 2959 bp, Homo sapiens
actacattgcccagtaacctcctgggctccgctgtgtttttctattctggggtgtaaggggcagctggaccactccagctgggactgctaggaaggttgcgggtccacccggccgagccgaacgagggaaatggtcctcacccggccactcgccggttgaaaaggggccgccctggcagggaagcggccgccgcggcgcggtgcagcgcagcggcgagaaggagtgcgttatcgtcttgcgctactgctgaatgtccgtcccggaggaggaggagaggcttttgccgctgacccagagatggccccgagcgagcaaattcctactgtccggctgcgcggctaccgtggccgagctagcaacctttcccctggatctcacaaaaactcgactccaaatgcaaggagaagcagctcttgctcggttgggagacggtgcaagagaatctgccccctataggggaatggtgcgcacagccctagggatcattgaagaggaaggctttctaaagctttggcaaggagtgacacccgccatttacagacacgtagtgtattctggaggtcgaatggtcacatatgaacatctccgagaggttgtgtttggcaaaagtgaagatgagcattatcccctttggaaatcagtcattggagggatgatggctggtgttattggccagtttttagccaatccaactgacctagtgaaggttcagatgcaaatggaaggaaaaaggaaactggaaggaaaaccattgcgatttcgtggtgtacatcatgcatttgcaaaaatcttagctgaaggaggaatacgagggctttgggcaggctgggtacccaatatacaaagagcagcactggtgaatatgggagatttaaccacttatgatacagtgaaacactacttggtattgaatacaccacttgaggacaatatcatgactcacggtttatcaagtttatgttctggactggtagcttctattctgggaacaccagccgatgtcatcaaaagcagaataatgaatcaaccacgagataaacaaggaaggggacttttgtataaatcatcgactgactgcttgattcaggctgttcaaggtgaaggattcatgagtctatataaaggctttttaccatcttggctgagaatgaccccttggtcaatggtgttctggcttacttatgaaaaaatcagagagatgagtggagtcagtccattttaaacccctaaagatgcaacccttaaagatacagtgttcagtattattgaaatatgggcatctgcaacacataccccctattatttctacctctttaggaagacacctattccacagagactgatttatagggggcagcactttatttttttctggaaacccaagttctctttgactcctctttttgtccaaaagtgatctggtcggatctcacaaggccatccaatgagaccccgcacagcattttctaaagaagaatcgaagcctgaccactttcaccttgggcaagaaggtttggcctttgagttgctattctatgctgaagagcctgcttagaggaggagtaccaggagggagccagcatttcagatctgaagtagacgataggaatgtggaagaacacatacatagtgcttaagaaatacatttaacctgttatgtcagtatttatcaatgaagtttgataattcacttttctgtcattgttaaagcgtacatactgtaaattaaagggaggtgaatggaaattaatgaataaacattttgagtttccctagtgttgaaggaaggtgtactttttcttgtcagaaagataaaaaaaatcaagttgagatgatgtttgaatttcaagaaaagaggctgctttctgtcagtgccctctcattagatctgtgttaattagttagcactccactgcacatgctaatgacttcctctgacagccacacaccgaatcttgatgaaaaaagagaagagcatttgccttgttacatagtctgttacaagccagatatgttgctagctctcaagagttgtaatatattaagaactacaacttatttgattaaaactcagctgtatagatccttttataaagcaccttttgttaaacatcagcctttcattggtattttaaaagcaaggcagatagatatgaagtcagccaactctgacatgcgtcctttcttatctcccttacctgacactaggggctctagagaggcagagagagcactcacaaatcacactaaaactgccagcggcctgactcttactcagtttagcaaaaattcttgcctaaaaagtgataagtaaaaatctgtttatggtatacagttatgtctcgaatctttgaatcaaatccatgttcttattttagaaaggtaagagttcttcaaattcagctacataccaccggctctcccaacctcagacggtgggcatttctggatggatggctgcggttatggataaaggctgtaactgttaacacagaaaaacatgaaaagctcaggcccaagaaaggccttggagccagccaaacagaatttgttctaatggacatggatgatgttgaacagaaaaaagtttacaagtgctttgtggttgcactaatgtatactcactgccattttaagagggggaagtacattttaaaatatatttgaatgtcatgtactgatatgcagtagcttattgtttttctagttgcagagaatgtgaagtttaatctcttaaaatatttagatggtctactttttcattgaatttgtcaatatgtaattgcgttgtaaaatattatatatatatatatatatatatatatatatatatgcttaacttcccaagtgttctgcattgaaccacttagggaaaattttgtttgtttttatgttttgtaatttttaaaattaagtaaagactggatcaaaataattgcatccaacctggaccgtgaa

SEQ ID NO: 5509 - DNA, 3486 bp, Homo sapiens
gagccgactgcggctgcgcggggtattcgaatcggcggcggcttctagtttgcggttcaggtttggccgctgccggccagcgtcctctggccatggacaccccggaaaatgtccttcagatgcttgaagcccacatgcagagctacaagggcaatgaccctcttggtgaatgggaaagatacatacagtgggtagaagagaattttcctgagaataaagaatacttgataactttactagaacatttaatgaaggaatttttagataagaagaaataccacaatgacccaagattcatcagttattgtttaaaatttgctgagtacaacagtgacctccatcaattttttgagtttctgtacaaccatgggattggaaccctgtcatcccctctgtacattgcctgggcggggcatctggaagcccaaggagagctgcagcatgccagtgctgtccttcagagaggaattcaaaaccaggctgaacccagagagttcctgcaacaacaatacaggttatttcagacacgcctcactgaaacccatttgccagctcaagctagaacctcagaacctctgcataatgttcaggttttaaatcaaatgataacatcaaaatcaaatccaggaaataacatggcctgcatttctaagaatcagggttcagagctttctggagtgatatcttcagcttgtgataaagagtcaaatatggaacgaagagtgatcacgatttctaaatcagaatattctgtgcactcatctttggcatccaaagttgatgttgagcaggttgttatgtattgcaaggagaagcttattcgtggggaatcagaattttcctttgaagaattgagagcccagaaatacaatcaacggagaaagcatgagcaatgggtaaatgaagacagacattatatgaaaaggaaagaagcaaatgcttttgaagaacagctattaaaacagaaaatggatgaacttcataagaagttgcatcaggtggtggagacatcccatgaggatctgcccgcttcccaggaaaggtccgaggttaatccagcacgtatggggccaagtgtaggctcccagcaggaactgagagcgccatgtcttccagtaacctatcagcagacaccagtgaacatggaaaagaacccaagagaggcacctcctgttgttcctcctttggcaaatgctatttctgcagctttggtgtccccagccaccagccagagcattgctcctcctgttcctttgaaagcccagacagtaacagactccatgtttgcagtggccagcaaagatgctggatgtgtgaataagagtactcatgaattcaagccacagagtggagcagagatcaaagaagggtgtgaaacacataaggttgccaacacaagttcttttcacacaactccaaacacatcactgggaatggttcaggcaacgccatccaaagtgcagccatcacccaccgtgcacacaaaagaagcattaggtttcatcatgaatatgtttcaggctcctacacttcctgatatttctgatgacaaagatgaatggcaatctctagatcaaaatgaagatgcatttgaagcccagtttcaaaaaaatgtaaggtcatctggggcttggggagtcaataagatcatctcttctttgtcatctgcttttcatgtgtttgaagatggaaacaaagaaaattatggattaccacagcctaaaaataaacccacaggagccaggacctttggagaacgctctgtcagcagacttccttcaaaaccaaaggaggaagtgcctcatgctgaagagtttttggatgactcaactgtatggggtattcgctgcaacaaaaccctggcacccagtcctaagagcccaggagacttcacatctgctgcacaacttgcgtctacaccattccacaagcttccagtggagtcagtgcacattttagaagataaagaaaatgtggtagcaaaacagtgtacccaggcgactttggattcttgtgaggaaaacatggtggtgccttcaagggatggaaaattcagtccaattcaagagaaaagcccaaaacaggccttgtcgtctcacatgtattcagcatccttacttcgtctgagccagcctgctgcaggtggggtacttacctgtgaggcagagttgggcgttgaggcttgcagactcacagacactgacgctgccattgcagaagatccaccagatgctattgctgggctccaagcagaatggatgcagatgagttcacttgggactgttgatgctccaaacttcattgttgggaacccatgggatgataagctgattttcaaacttttatctgggctttctaaaccagtgagttcctatccaaatacttttgaatggcaatgtaaacttccagccatcaagcccaagactgaatttcaattgggttctaagctggtctatgtccatcaccttcttggagaaggagcctttgcccaggtgtacgaagctacccagggagatctgaatgatgctaaaaataaacagaaatttgttttaaaggtccaaaagcctgccaacccctgggaattctacattgggacccagttgatggaaagactaaagccatctatgcagcacatgtttatgaagttctattctgcccacttattccagaatggcagtgtattagtaggagagctctacagctatggaacattattaaatgccattaacctctataaaaatacccctgaaaaagtgatgcctcaaggtcttgtcatctcttttgctatgagaatgctttacatgattgagcaagtgcatgactgtgaaatcattcatggagacattaaaccagacaatttcatacttggaaacggatttttggaacaggatgatgaagatgatttatctgctggcttggcactgattgacctgggtcagagtatagatatgaaactttttccaaaaggaactatattcacagcaaagtgtgaaacatctggttttcagtgtgttgagatgctcagcaacaaaccatggaactaccagatcgattactttggggttgctgcaacagtatattgcatgctctttggcacttacatgaaagtgaaaaatgaaggaggagagtgtaagcctgaaggtctttttagaaggcttcctcatttggatatgtggaatgaattttttcatgttatgttgaatattccagattgtcatcatcttccatctttggatttgttaaggcaaaagctgaagaaagtatttcaacaacactatactaacaagattagggccctacgtaataggctaattgtactgctcttagaatgtaagcgttcacgaaaataaaatttggatatagacagtccttaaaaatcacactgtaaatatgaatctgctcactttaaacctgtttttttttcatttattgtttatgtaaatgtttgttaaaaataaatcccatggaatatttccatgtaaaaaa

SEQ ID NO: 5510 - DNA, 444 bp, Homo sapiens
ctttagtcaggaaggacgttggtgttgaggttagcatacgtatcaaggacagtaactaccatggctcccgaagttttgccaaaacctcggatgcgtggccttctggccaggcgtctgcgaaatcatatggctgtagcattcgtgctatccctgggggttgcagctttgtataagtttcgtgtggctgatcaaagaaagaaggcatacgcagatttctacagaaactacgatgtcatgaaagattttgaggagatgaggaaggctggtatctttcagagtgtaaagtaatcttggaatataaagaatttcttcaggttgaattacctagaagtttgtcactgacttgtgttcctgaactatgacacatgaatatgtgggctaagaaatagttcctcttgataaataaacaattaacaaatactttgaaaaaaaaaaaaaaaaaaa

SEQ ID NO: 5511 - DNA, 4071 bp, Homo sapiens
gagtccagccgctggtgcgcggagcggttcaccgtcttcggagcggttcggcccagcctttcgcccaggcgcccaggcccgctgcgcgcgtgcgtgagcgcgcctgcgccgccagggccgctgcaaggggaggagagcggccgcctcaggaggatcccttttcccccagaaattactcaatgctgaaacctctcaaagtggtattagagacgctgaaagcaccatggacgggttttatgatcagcaagtcccttttatggtcccagggaaatctcgatctgaggaatgcagagggcggcctgtgattgacagaaagaggaagtttttggacacagatctggctcacgattctgaagagctatttcaggatctcagtcaacttcaagaggcttggttagctgaagcacaagttcctgatgatgaacagtttgtcccagattttcagtctgataacctggtgcttcatgccccacctccaaccaagatcaaacgggagctgcacagcccctcctctgagctgtcgtcttgtagccatgagcaggctcttggtgctaactatggagaaaagtgcctctacaactattgtgcctatgataggaagcctccctctgggttcaagccattaacccctcctacaacccccctctcacccacccatcagaatcccctatttcccccacctcaggcaactctgcccacctcagggcatgcccctgcagctggcccagttcaaggtgtgggccccgcccccgccccccattcgcttccagagcctggaccacagcagcaaacatttgcggtcccccgaccaccacatcagcccctgcagatgccaaagatgatgcctgaaaaccagtatccatcagaacagagatttcagagacaactgtctgaaccctgccaccccttccctcctcagccaggagttcctggagataatcgccccagttaccatcggcaaatgtcagaacctattgtccctgcagctcccccgccccctcagggattcaaacaagaataccatgacccactctatgaacatggggtcccgggcatgccagggcccccagcacacgggttccagtcaccaatgggaatcaagcaggagcctcgggattactgcgtcgattcagaagtgcctaactgccagtcatcctacatgagagggggttatttctccagcagccatgaaggtttttcatatgaaaaagatccccgattatactttgacgacacttgtgttgtgcctgagagactggaaggcaaagtcaaacaggagcctaccatgtatcgagaggggcccccttaccagaggcgaggttcccttcagctgtggcagttcctggtcacccttcttgatgacccagccaatgcccacttcattgcctggacaggtcgaggcatggagttcaagctgatagaaccggaagaggttgctcggcgctggggcatccagaagaaccggccagccatgaactatgacaagctgagccgctctctccgctattactatgaaaagggcatcatgcagaaggtggctggagagcgatacgtctacaaatttgtctgtgacccagatgccctcttctccatggctttcccggataaccagcgtccgttcctgaaggcagagtccgagtgccacctcagcgaggaggacaccctgccgctgacccactttgaagacagccccgcttacctcctggacatggaccgctgcagcagcctcccctatgccgaaggctttgcttactaagtttctgagtggcggagtggccaaaccctagagctagcagttcccattcaggcaaacaagggcagtggttttgtttgtgtttttggttgttcctaaagcttgccctttgagtattatctggagaacccaagctgtctctggattggcacccttaaagacagatacattggctggggagtgggaacagggaggggcagaaaaccaccaaaaggccagtgcctcaactcttgattctgatgaggtttctgggaagagatcaaaatggagtctccttaccatggacaatacatgcaaagcaatatcttgttcaggttagtacccgcaaaacgggacatgatgtgacaatctcgatcgatcatggactactaaatggcctttacatagaagggctctgatttgcacaatttgttgaaaaatcacaaacccatagaaaagtgagtaggctaagttggggaggctcaaaccattaagggttaaaaatacatcttaaacattggaaagctcttctagctgaatctgaaatattaccccttgtctagaaaaaggggggcagtcagaacagctgttccccactccgtgttctcaaaatcataaaccatggctactcttgggaaccacccggccatgtggtcgccaagtagagcaagccccctttctcttcccaatcacgtggctgagtgtggatgacttttattttaggagaagggcgattaacacttttgacagtattttgttttgccctgatttgggggattgttttgttttggtggttgttttggaaaaacagtttataaactgatttttgtagttttggtatttaaagcaaaaaaacgaaaaacaaaaaacaaaaacaaaccttttggtaatgtgcactgtgtctttagccagggccgtgcaacttatgaagacactgcagcttgagaggggctttgctgaggcttccccttggccatgtgaaagcccgccttgttgcctgctttgtgctttctgcaccagacaacctgatggaacatttgcacctgagttgtacatttttgaagtgtgcagggcagcctggacacaagcttagattctctatgtatagttccccgtgttcactaacatgccctctctggaaagcatatgtatataacatgtgtcatgtcctttggaaacctggtcacctggtgaaaacccttgggattcttccctgggcatgactgatgacaatttccatttcatcagtttgttttgttttcctttttctttaaatcttggactttaaaccctacctgtgtgattcagtagggtttgagacttagctgtgatactgacaggtaagcaacagtgctagcattctagattcctgcctttttttaaaaagaaattattctcattgctgtattatattggaaaagttttaaacaaccaagctaaagctatgtgaaagttgagctcaaagtagaggaaaagttactggtggtaccttgctgcctgctctgctggtagaattctgtgctccccgtgacacttagtacattaagaatgactacactgttcctcgtatgtgaaggaggcagtgctgactccgtgagtgtgagacacgtgctttgaactgcttttctattcatggagcactccatagtctcaaactgtcccccttatgaccaacagcacatttgtgaagaggttcgcagggataaggggtgcactttatagctatggaaacatgagattctcctctattggaagctaattagcccacaaaggtggtaaacctgtagattgggccttaattagcattgtactctaatcaaaggactctttctaaaccatatttatagctttcttaacctacacatagtctatacatagatgcatattttacccccagctggctagagatttatttgttgtaaatgctgtatagatttggttttcctttctttacttaccctggtttggattttttttttttttttttttgaatggatttatgctgtcttagcaatatgacaataatcctctgtagcttgagctacccctcccctgctgtaacttacgtgacctgtgctgtcactgggcataggacagcggcatcacggttgcattcccattggactcatgcacctcccggatggtttttgtttttttcgggggttctttggggtttgtttgtttgcttcttttccagagtgtggaaagtctacagtgcagaaaggcttgaacctgccagctgatttgaaatactttcaccctgcgcagggccgtatgcatcctgccaagctgcgttatattctgtactgtgtacaataaagaagtttgcttttcgttta

SEQ ID NO: 5512 - DNA, 4908 bp, Homo sapiens
acctgcgtgcagtcggtcctccaggccacgcagcgcccgagagtaccagggagactccggcccctgtcggcgccaagcccctccgcccctcacagcgcccaggtccgcggccgggccttgattttttggcggggaccgtcatggcgtcgcagccaaattcgtctgcgaagaagaaagaggagaaggggaagaacatccaggtggtggtgagatgcagaccatttaatttggcagagcggaaagctagcgcccattcaatagtagaatgtgatcctgtacgaaaagaagttagtgtacgaactggaggattggctgacaagagctcaaggaaaacatacacttttgatatggtgtttggagcatctactaaacagattgatgtttaccgaagtgttgtttgtccaattctggatgaagttattatgggctataattgcactatctttgcgtatggccaaactggcactggaaaaacttttacaatggaaggtgaaaggtcacctaatgaagagtatacctgggaagaggatcccttggctggtataattccacgtacccttcatcaaatttttgagaaacttactgataatggtactgaattttcagtcaaagtgtctctgttggagatctataatgaagagctttttgatcttcttaatccatcatctgatgtttctgagagactacagatgtttgatgatccccgtaacaagagaggagtgataattaaaggtttagaagaaattacagtacacaacaaggatgaagtctatcaaattttagaaaagggggcagcaaaaaggacaactgcagctactctgatgaatgcatactctagtcgttcccactcagttttctctgttacaatacatatgaaagaaactacgattgatggagaagagcttgttaaaatcggaaagttgaacttggttgatcttgcaggaagtgaaaacattggccgttctggagctgttgataagagagctcgggaagctggaaatataaatcaatccctgttgactttgggaagggtcattactgcccttgtagaaagaacacctcatgttccttatcgagaatctaaactaactagaatcctccaggattctcttggagggcgtacaagaacatctataattgcaacaatttctcctgcatctctcaatcttgaggaaactctgagtacattggaatatgctcatagagcaaagaacatattgaataagcctgaagtgaatcagaaactcaccaaaaaagctcttattaaggagtatacggaggagatagaacgtttaaaacgagatcttgctgcagcccgtgagaaaaatggagtgtatatttctgaagaaaattttagagtcatgagtggaaaattaactgttcaagaagagcagattgtagaattgattgaaaaaattggtgctgttgaggaggagctgaatagggttacagagttgtttatggataataaaaatgaacttgaccagtgtaaatctgacctgcaaaataaaacacaagaacttgaaaccactcaaaaacatttgcaagaaactaaattacaacttgttaaagaagaatatatcacatcagctttggaaagtactgaggagaaacttcatgatgctgccagcaagctgcttaacacagttgaagaaactacaaaagatgtatctggtctccattccaaactggatcgtaagaaggcagttgaccaacacaatgcagaagctcaggatatttttggcaaaaacctgaatagtctgtttaataatatggaagaattaattaaggatggcagctcaaagcaaaaggccatgctagaagtacataagaccttatttggtaatctgctgtcttccagtgtctctgcattagataccattactacagtagcacttggatctctcacatctattccagaaaatgtgtctactcatgtttctcagatttttaatatgatactaaaagaacaatcattagcagcagaaagtaaaactgtactacaggaattgattaatgtactcaagactgatcttctaagttcactggaaatgattttatccccaactgtggtgtctatactgaaaatcaatagtcaactaaagcatattttcaagacttcattgacagtggccgataagatagaagatcaaaaaaaggaactagatggctttctcagtatactgtgtaacaatctacatgaactacaagaaaataccatttgttccttggttgagtcacaaaagcaatgtggaaacctaactgaagacctgaagacaataaagcagacccattcccaggaactttgcaagttaatgaatctttggacagagagattctgtgctttggaggaaaagtgtgaaaatatacagaaaccacttagtagtgtccaggaaaatatacagcagaaatctaaggatatagtcaacaaaatgacttttcacagtcaaaaattttgtgctgattctgatggcttctcacaggaactcagaaattttaaccaagaaggtacaaaattggttgaagaatctgtgaaacactctgataaactcaatggcaacctggaaaaaatatctcaagagactgaacagagatgtgaatctctgaacacaagaacagtttatttttctgaacagtgggtatcttccttaaatgaaagggaacaggaacttcacaacttattggaggttgtaagccaatgttgtgaggcttcaagttcagacatcactgagaaatcagatggacgtaaggcagctcatgagaaacagcataacatttttcttgatcagatgactattgatgaagataaattgatagcacaaaatctagaacttaatgaaaccataaaaattggtttgactaagcttaattgctttctggaacaggatctgaaactggatatcccaacaggtacgacaccacagaggaaaagttatttatacccatcaacactggtaagaactgaaccacgtgaacatctccttgatcagctgaaaaggaaacagcctgagctgttaatgatgctaaactgttcagaaaacaacaaagaagagacaattccggatgtggatgtagaagaggcagttctggggcagtatactgaagaacctctaagtcaagagccatctgtagatgctggtgtggattgttcatcaattggcggggttccatttttccagcataaaaaatcacatggaaaagacaaagaaaacagaggcattaacacactggagaggtctaaagtggaagaaactacagagcacttggttacaaagagcagattacctctgcgagcccagatcaacctttaattcacttgggggttggcaattttatttttaaagaaaacttaaaaataaaacctgaaaccccagaacttgagccttgtgtatagattttaaaagaatatatatatcagccgggcgcggtggctcatgcctgtaatcccagcactttgggaggctgaggcgggtggattgcttgagcccaggagtttgagaccagcctggccaacgtggcaaaacctcgtctctgttaaaaattagccgggcgtggtggcacactcctgtaatcccagctactggggaggctgaggcacgagaatcacttgaacccaggaagcggggttgcagtgagccaaaggtacaccactacactccagcctgggcaacagagcaagactcggtctcaaaaacaaaatttaaaaaagatataaggcagtactgtaaattcagttgaattttgatatctacccatttttctgtcatccctatagttcactttgtattaaattgggtttcatttgggatttgcaatgtaaatacgtatttctagttttcatataaagtagttcttttataacaaatgaaaagtatttttcttgtatattattaagtaatgaatatataagaactgtactcttctcagcttgagcttaacataggtaaatatcaccaacatctgtccttagaaaggaccatctcatgttttttttcttgctatgacttgtgtattttcttgcatcctccctagacttccctatttcgctttctcctcggctcactttctccctttttatttttcaccaaaccatttgtagagctacaaaacctatcctttcttattttcagtagtcagaattttatctagaaatcttttaacacctttttagtggttatttctaaaatcactgtcaacaataaatctaaccctagttgtatccctcctttaagtatttaaaacttgttgccccaaatgtgaaagcatttaattcctttaagaggcctaactcattcaccctgacagagttcacaaaaagcccactttagagtatacattgctattatgggagaccacccagacatctgactaatggctctgtgccacactccaagacctgtgccttttagagaagctcacaatgatttaaggactgtttgaaacttccaattatgtctataatttatattcttttgtttacatgatgaaactttttgttgttgcttgtttgtatataatacaatgtgtacatgtatctttttctcgattcaaatcttaacccttaggactctggtatttttgatctggcaaccatatttctggaagttgagatgtttcagcttgaagaaccaaaacagaaggaatatgtacaaagaataaattttctgctcacgatgagtttagtgtgtaaagtttagagacatctgactttgatagctaaattaaaccaaaccctattgaagaattgaatatatgctacttcaagaaactaaattgatctcgtagaattatcttaataaaataatggctataatttctctgcaaaatcagatgtcagcataagcgatggataatacctaataaactgccctcagtaaatccatggttaataaatgtggtttctacatt

SEQ ID NO: 5513 - DNA, 4845 bp, Homo sapiens
tgagatcgtgtttcatttcaggaagatatatgcgtcaggaaaatttctatcttcttttgtattatcaaggagatatttggagcagagtcaaccctctcagttacataaaataaaaaatggcatattcttggcaaacggatccaaatcctaatgaatcacacgaaaagcagtatgaacaccaagaatttctctttgtaaatcaaccccattcttctagccaagtcagtctgggttttgatcagatagtagatgagatcagtggcaaaattccacactacgagagtgaaattgatgaaaacaccttttttgtgcccactgcaccaaaatgggactcaacagggcattcattaaatgaagcacaccaaatatccttgaatgaattcacttctaaaagccgtgaactctcctggcatcaagttagcaaagcaccagcaattggttttagtccttctgtgttaccaaaacctcaaaatacgaataaagaatgctcctggggaagccccataggaaaacatcatggtgctgatgattccagattcagtattttagctccatcattcacaagtttggataaaattaatctagagaaagaattagaaaatgaaaatcataactaccatataggatttgaaagtagcattcctccaacaaattcatccttctcaagtgacttcatgccgaaagaagagaataaaaggagtggacatgtgaacattgtggaaccatctttgatgcttttgaaaggctctcttcaacccggaatgtgggaaagtacatggcagaagaatatagagtcaataggttgttccattcagctagtggaagtacctcaaagcagcaatacgagtctggcctctttttgcaacaaagtaaaaaaaatcagagaaagatatcatgcagctgatgttaatttcaattctgggaagatctggagcactactacagcatttccgtatcagctcttttctaagaccaagtttaatatacatatttttattgataactcaacacaacctcttcattttatgccatgtgctaattatcttgtcaaagatctaattgcagaaattctgcatttttgcacaaatgaccagctactccccaaagatcatattctaagtgtatgtggctctgaagaatttttacaaaacgaccactgtttggggagccacaaaatgtttcaaaaagataaatctgttattcagctccacctgcagaaaagtagggaagctccaggaaagctatctcgaaagcatgaagaggaccacagtcagttttatctgaatcaacttctagaatttatgcatatttggaaagtatccagacaatgtctcttaacactcatcagaaaatatgacttccacctgaaatacctattgaaaacccaggaaaacgtgtataatattattgaagaagttaaaaaaatatgcagtgttctagggtgtgtggaaaccaaacaaattacagatgcagtaaatgaactaagtctaattcttcagagaaaaggagagaatttttatcaaagttcagagacttcagcaaaaggcttgatagagaaggtaacaactgaactatccacatccatctaccagctaatcaatgtctactgtaacagcttttatgcagattttcagcctgtaaatgtacctagatgcacttcctatctaaatcccgggcttccttcccacctcagcttcacagtgtatgcagcacacaacattccagaaacctgggtgcacaggatcaattttccccttgaaataaagtcacttccaagggaatccatgctcactgtaaaactgtttgggattgcctgtgcaaccaacaatgcaaatttactggcgtggacttgtcttccactgtttccaaaagaaaaatccattctcgggtctatgctgttcagcatgacattacagagtgagcctcccgtagaaatgataactccaggagtgtgggatgtaagtcagccatccccggtgaccctgcagattgattttccagctactgggtgggagtatatgaaacctgattctgaagagaatagaagtaatcttgaagagccactaaaggagtgtataaaacatattgccagactttcacagaaacagactcccctactactctctgaagaaaagaaaagatatttatggttttatcgcttctactgcaataatgaaaactgctcccttcctttagtcctgggtagtgcccctggatgggatgaaaggactgtttcagaaatgcataccattttgagaagatggacattttctcaacctttagaggctcttgggcttttgacttccagttttccagatcaagaaattcgtaaagtggcagttcaacaattagacaacctcttgaatgatgaactactggaatatctcccacagctagttcaggctgtcaagtttgaatggaaccttgagagtcctttagtgcaacttctactccaccgctccttgcagagcatccaggttgcccatcgtctttactggctgctaaaaaatgcagaaaatgaagcttattttaaaagctggtatcagaagctactagctgctctccaattctgtgcaggtaaagccttgaatgatgagttttccaaggagcagaaacttatcaaaattctgggagatattggggaaagagtcaagtctgccagtgaccatcaaagacaggaggtactgaagaaagaaattggcagactagaagagttctttcaagatgtaaatacttgtcatcttcctctgaaccctgccctatgtataaaagggattgatcacgatgcatgttcatattttacatctaatgctttgccattgaagattactttcatcaatgctaatccgatgggcaaaaacatcagcattatttttaaggctggagatgatcttcgtcaggatatgcttgttctgcagcttattcaagtgatggacaatatttggctgcaggaaggcttggatatgcaaatgatcatttatagatgtctatccacaggaaaagaccaaggattggtgcagatggtacctgatgctgtgaccctagcaaagattcatcgccattctggactgataggaccattgaaagaaaatacaattaaaaagtggttcagtcagcacaaccacttaaaggcagattatgaaaaggccttgaggaactttttctactcctgtgctggctggtgtgtggtaacattcatcctgggagtatgtgaccgtcacaatgataatatcatgctgacaaagtcgggccacatgtttcatattgactttggaaaattcttaggtcatgcacaaacatttggagggataaaaagggaccgagctcctttcatttttacttcagagatggaatactttattacagagggtgggaaaaacccacagcattttcaagattttgtggaactttgctgtcgtgcttataatattatcagaaagcacagccaactgctcttgaacctgctggaaatgatgctgtatgcaggactgcctgagctaagtggaattcaagacctgaaatatgtgtataataatcttcgtccacaagacacagacctggaagcaacaagtcattttaccaagaaaataaaggaaagtctggagtgtttccctgttaaattgaataacttgatccacacacttgcacaaatgtcagccataagccctgccaaatctacttcacagacttttcctcaggaatcctgtttgctgagtacaactaggtcgattgaaagagcaacaattttagggttcagcaagaaatccagtaatctgtatctgatccaggtgacacacagcaacaacgaaacaagcctgacagaaaaatcatttgagcagttttcaaaacttcacagccaacttcagaagcagtttgcatcactgactctcccagagtttcctcattggtggcacctaccttttacaaattcagatcacagaagattcagagatctaaatcattacatggaacagatattaaatgtatcacatgaagttacaaacagtgattgtgtacttagctttttcctctctgaggctgtgcaacaaacagttgaagaatcatcacctgtgtacctaggtaagaagaagtttccagacaagaagcctaaggtgcagttagtcatatcctacgaggatgtgaagctgaccatactagtgaaacacatgaaaaacattcatctcccagatggctctgcgcccagtgcacatgttgaattttatcttttaccatatcccagtgaagttcgtaggaggaaaacaaaatctgttccaaaatgtacggaccccacttacaatgaaattgtagtatatgatgaagtcacagagctccaaggacatgtcttaatgcttattgtgaagagtaaaactgtatttgtgggagcaattaacatccgactctgtagtgtcccactcgataaagaaaaatggtatccattaggaaacagtataatttgaccattgctatgaacatatgcattattcattaactacttgtatttttttcacttctgggcctctgaatcacataagtaaggcatctttgttgtcaaagacagcacagggtattaaggacacagaaaaaaaatcagaattagtcttttgtgttgtttattttctacctgtgctttcattgttttttcataatcttttctccttcagtggagtactgattgcatgaaatttgatgtgtaaaataataaaagacctttattaaatcattttaatatattttaaattaaacataggtttacatttgttttaattgtgtgcctacagttaaaagcagtatttttaatgtattttataagaaagacaatcaaataaacctcatcaattaattcaa

SEQ ID NO: 5514 - DNA, 1635 bp, Homo sapiens
gccttttttgcagtctcaggacgggcgctttggagccggccccaggcagcgtgtgtcggtcgcctagtctggagaactagtcctcgactcacgtgcaaggatgatgctgaaaggaataacaaggcttatctctaggatccataagttggaccctgggcgttttttacacatggggacccaggctcgccaaagcattgctgctcacctagataaccaggttccagttgagagtccgagagctatttcccgcaccaatgagaatgacccggccaagcatggggatcagcacgagggtcagcactacaacatctccccccaggatttggagactgtatttccccatggccttcctcctcgctttgtgatgcaggtgaagacattcagtgaagcttgcctgatggtaaggaaaccagccctagaacttctgcattacctgaaaaacaccagttttgcttatccagctatacgatatcttctgtatggagagaagggaacaggaaaaaccctaagtctttgccatgttattcatttctgtgcaaaacaggactggctgatactacatattccagatgctcatctttgggtgaaaaattgtcgggatcttctgcagtccagctacaacaaacagcgctttgatcaacctttagaggcttcaacctggctgaagaatttcaaaactacaaatgagcgcttcctgaaccagataaaagttcaagagaagtatgtctggaataagagagaaagcactgagaaagggagtcctctgggagaagtggttgaacagggcataacacgggtgaggaacgccacagatgcagttggaattgtgctgaaagagctaaagaggcaaagttctttgggtatgtttcacctcctagtggccgtggatggaatcaatgctctttggggaagaaccactctgaaaagagaagataaaagcccgattgcccccgaggaattagcacttgttcacaacttgaggaaaatgatgaaaaatgattggcatggaggcgccattgtgtcggctttgagccagactgggtctctctttaagccccggaaagcctatctgccccaggagttgctgggaaaggaaggatttgatgccctggatccctttattcccatcctggtttccaactataacccaaaggaatttgaaagttgtattcagtattatttggaaaacaattggcttcaacatgagaaagctcctacagaagaagggaaaaaagagctgctgttcctaagtaacgcgaacccctcgctgctggagcggcactgtgcctacctctaagccaagatcacagcatgtgaggaagacagtggacatctgctttatgctggacccagtaagatgaggaagtcgggcagtacacaggaagaggagccaggcccttgtacctatgggattggacaggactgcagttggctctggacctgcattaaaatgggtttcactgtgaatgcgtgacaataagatattcccttgttcctaaaactttatatcagtttattggatgtggtttttcacatttaagataattatggctcttttcctaaaaaataaaatatctttctaaaaaaaaaaaaaaaaaaaaaaaaaaaaaaaaaaaaaaaaaaaaaaaaaaaaaa

SEQ ID NO: 5515 - DNA, 2806 bp, Homo sapiens
gcatgagaggccagcctgccagggaaatccaggaatctgcaacaaaaacgatgacagtctgaaatactctctggtgccaacctccaaattctcgtctgtcacttcagacccccactagttgacagagcagcagaatatcaactccagtagacttgaatgtgcctctgggcaaagaagcagagctaacgaggaaagggatttaaagagtttttcttgggtgtttgtcaaacttttattccctgtctgtgtgcagaggggattcaacttcaattttctgcagtggctctgggtccagccccttacttaaagatctggaaagcatgaagactgggccttttttcctatgtctcttgggaactgcagctgcaatcccgacaaatgcaagattattatctgatcattccaaaccaactgctgaaacggtagcacctgacaacactgcaatccccagtttatgggctgaagctgaagaaaatgaaaaagaaacagcagtatccacagaagacgattcccaccataaggctgaaaaatcatcagtactaaagtcaaaagaggaaagccatgaacagtcagcagaacagggcaagagttctagccaagagctgggattgaaggatcaagaggacagtgatggtcacttaagtgtgaatttggagtatgcaccaactgaaggtacattggacataaaagaagatatgattgagcctcaggagaaaaaactctcagagaacactgattttttggctcctggtgttagttccttcacagattctaaccaacaagaaagtatcacaaagagagaggaaaaccaagaacaacctagaaattattcacatcatcagttgaacaggagcagtaaacatagccaaggcctaagggatcaaggaaaccaagagcaggatccaaatatttccaatggagaagaggaagaagaaaaagagccaggtgaagttggtacccacaatgataaccaagaaagaaagacagaattgcccagggagcatgctaacagcaagcaggaggaagacaatacccaatctgatgatattttggaagagtctgatcaaccaactcaagtaagcaagatgcaggaggatgaatttgatcagggtaaccaagaacaagaagataactccaatgcagaaatggaagaggaaaatgcatcgaacgtcaataagcacattcaagaaactgaatggcagagtcaagagggtaaaactggcctagaagctatcagcaaccacaaagagacagaagaaaagactgtttctgaggctctgctcatggaacctactgatgatggtaataccacgcccagaaatcatggagttgatgatgatggcgatgatgatggcgatgatggcggcactgatggccccaggcacagtgcaagtgatgactacttcatcccaagccaggcctttctggaggccgagagagctcaatccattgcctatcacctcaaaattgaggagcaaagagaaaaagtacatgaaaatgaaaatataggtaccactgagcctggagagcaccaagaggccaagaaagcagagaactcatcaaatgaggaggaaacgtcaagtgaaggcaacatgagggtgcatgctgtggattcttgcatgagcttccagtgtaaaagaggccacatctgtaaggcagaccaacagggaaaacctcactgtgtctgccaggatccagtgacttgtcctccaacaaaaccccttgatcaagtttgtggcactgacaatcagacctatgctagttcctgtcatctattcgctactaaatgcagactggaggggaccaaaaaggggcatcaactccagctggattattttggagcctgcaaatctattcctacttgtacggactttgaagtgattcagtttcctctacggatgagagactggctcaagaatatcctcatgcagctttatgaagccaactctgaacatgctggttatctaaatgagaagcagagaaataaagtcaagaaaatttacctggatgaaaagaggcttttggctggggaccatcccattgatcttctcttaagggactttaagaaaaactaccacatgtatgtgtatcctgtgcactggcagtttagtgaacttgaccaacaccctatggatagagtcttgacacattctgaacttgctcctctgcgagcatctctggtgcccatggaacactgcataacccgtttctttgaggagtgtgaccccaacaaggataagcacatcaccctgaaggagtggggccactgctttggaattaaagaagaggacatagatgaaaatctcttgttttgaacgaagattttaaagaactcaactttccagcatcctcctctgttctaaccacttcagaaatatatgcagctgtgatacttgtagatttatatttagcaaaatgttagcatgtatgacaagacaatgagagtaattgcttgacaacaacctatgcaccaggtatttaacattaactttggaaacaaaaatgtacaattaagtaaagtcaacatatgcaaaatactgtacattgtgaacagaagtttaattcatagtaatttcactctctgcattgacttatgagataattaatgattaaactattaatgataaaaataatgcatttgtattgttcataatatcatgtgcacttcaagaaaatggaatgctactcttttgtggtttacgtgtattattttcaatatcttaataccctaataaagagtccataaaaatccaaaaaaaaaaaaaaaaaaaaaaaaaaaaaaaaaaaaaaaaaaaaaaaaaaaaaa

SEQ ID NO: 5516 - DNA, 2422 bp, Homo sapiens
atttatttgaaatgactatttgttgaacacagtatagttcaaggatattttttcatatgtatttccttaagagagccctgagcctgagattttggaggcttctttcacttgtttgaactttgaaggtatattttatctattttaaaaaacacttaagaattaacaaattctataaagcatcttttttcatagttttcattcatactttcagcaacttgaagggagagtttttaacgtagtctgtgtttttgagcactctgagcatttgatttcttcctggtatcaccggtaaatcactcaatatattattattcccaaaattcgtgaagctaagagatgagccatcttgaaaaacaacctggcatttgactggaggtgatactctctggaatcataggattaacaacttggaaaaggcctatgatactcctggtaaacctctttgtgctgctctctgtggtttgtgtcctcttaaatctagctggatttatcctaggctgccaaggggcccagtttgtgtccagcgtgcccaggtgtgatctggtggacttaggtgaaggcaagatttgcttctgttgtgaagaatttcaaccagccaagtgcacagacaaagaaaatgccttgaaactctttccggttcagccctgtagtgctgttcaccttctacttaagaaagtcctctttgccctgtgtgccttgaatgccctgaccaccaccgtctgcttggtggccgctgccctccgctacctccagatattcgcaaccaggagatcctgcatcgatgaatcccagatttctgctgaagaagcggaggatcatggacgcatccccgaccctgatgattttgtgccgcctgtgcctcccccttcctattttgccacgttttactcgtgcacaccccggatgaaccgcaggatggttggtcctgatgttattcccctgccacacatctacggagctcgaatcaaaggtgtggaagtgttctgtcctctggatcccccgccgccatatgaagctgtggtgagccagatggaccaggagcagggatcttcattccaaatgtcagaaggatcagaagctgctgtgatcccattggatctgggctgcacacaagtgactcaagatggggacattcctaacatacctgccgaagaaaatgcatccacctcaactcccagttcaaccctggtgcgtcctatcagaagccggagagccctcccacccttgaggaccaggtcgaagagtgaccctgtgctccatccttctgaggagagagctgccccagtgctcagctgtgaagctgcaacacagactgaaaggagactggatctggctgcagtgactctgaggagaggcttgagatctagagcttcgcgatgcagaccgcggtctttgatagattacaaatcctacatggacaccaagctgctggtggcgaggttcctggagcagtcctcttgtaccatgaccccagacatccatgaacttgtagaaaacattaaatctgttttgaaatctgatgaggagcacatggaggaagccatcacaagtgccagttttctagaacagataatggccccattgcagcccagcacatccagggcccacaggctgccctcgcggagacagcctggcctgctgcacctccagagctgcggcgaccttcacaccttcacaccagcggggaggccccgagccgagaggaggccccggcgagtggaggctgagcggccacacagcctcattggggtcatccgagagactgtcctgtgaaccctggaagacagaaggccactccaaggggaaggatccctctcctctctgccatttcttggctgggagctgtggtccacctcaaaaaaaaaggagcactctggaggacacgttttcccacctgttggctcccgtgtctgctgactgagggcattcaggagtaaatgcacaggtcggtccaggcccgtctgggtttgggatgcactgagttggaggttatgaaagctttgatcctcttcttcctctgctgggcctcgcagcattcccaagggtcacatgccctggcatgggcagaaactgggctaatgattctttgcccacttcacccctcgtgtctctctttgttgctaagttctttccctcttggaaggacagatctgccgggctgctatttatagttgcctttggcctttcactgctctgcgatttggcaggaaataaggcgattaaccctatgtgtccacaagcctcaagccttgtttcaggtcaccctcaaatcacactctctttaggcaaaacaggaaacttcttaagtgacaaattttaatgccagacatttaaggagaggattattgttgattccatttactcatgcttgcaaaactagagacccctaaggcagaactgagaataaacatgtttactttgg

SEQ ID NO: 5517 - DNA, 1874 bp, Homo sapiens
gcaggtgaggcacgtttagcctgagccggccacggactccacttcccctgctcttcccccagtggcaaatccgcgccacctcgcaaacccccaactcaggcacttgggccccttttgggccccctctcgctcctccctttaggcacctccctgggcccgcccacggtctccccccagtttgggactgcgtcataagtatcccagacctcggcttgcagtagtgttagactgaagataaagtaagtgctgtttgggctaacaggatctcctcttgcagtctgcagcccaggacgctgattccagcagcgccttaccgcgcagcccgaagattcactatggtgaaaatcgccttcaatacccctaccgccgtgcaaaaggaggaggcgcggcaagacgtggaggccctcctgagccgcacggtcagaactcagatactgaccggcaaggagctccgagttgccacccaggaaaaagagggctcctctgggagatgtatgcttactctcttaggcctttcattcatcttggcaggacttattgttggtggagcctgcatttacaagtacttcatgcccaagagcaccatttaccgtggagagatgtgcttttttgattctgaggatcctgcaaattcccttcgtggaggagagcctaacttcctgcctgtgactgaggaggctgacattcgtgaggatgacaacattgcaatcattgatgtgcctgtccccagtttctctgatagtgaccctgcagcaattattcatgactttgaaaagggaatgactgcttacctggacttgttgctggggaactgctatctgatgcccctcaatacttctattgttatgcctccaaaaaatctggtagagctctttggcaaactggcgagtggcagatatctgcctcaaacttatgtggttcgagaagacctagttgctgtggaggaaattcgtgatgttagtaaccttggcatctttatttaccaactttgcaataacagaaagtccttccgccttcgtcgcagagacctcttgctgggtttcaacaaacgtgccattgataaatgctggaagattagacacttccccaacgaatttattgttgagaccaagatctgtcaagagtaagaggcaacagatagagtgtccttggtaataagaagtcagagatttacaatatgactttaacattaaggtttatgggatactcaagatatttactcatgcatttactctattgcttatgctttaaaaaaaggaaaaaaaaaaactactaaccactgcaagctcttgtcaaattttagtttaattggcattgcttgttttttgaaactgaaattacatgagtttcattttttctttgaatttatagggtttagatttctgaaagcagcatgaatatatcacctaacatcctgacaataaattccatccgttgttttttttgtttgtttgttttttcttttcctttaagtaagctctttattcatcttatggtggagcaattttaaaatttgaaatattttaaattgtttttgaactttttgtgtaaaatatatcagatctcaacattgttggtttcttttgtttttcattttgtacaactttcttgaatttagaaattacatctttgcagttctgttaggtgctctgtaattaacctgacttatatgtgaacaattttcatgagacagtcatttttaactaatgcagtgattctttctcactactatctgtattgtggaatgcacaaaattgtgtaggtgctgaatgctgtaaggagtttaggttgtatgaattctacaaccctataataaattttactctatacaaaaaaaaaaaaaaaaaaaaaaaaaaaaaaaaaaaaaaaaaaaa

SEQ ID NO: 5518 - DNA, 6158 bp, Homo sapiens
gttgatagaagtccagatcctgaggaaatctccagctaaatgctcaaaatataaaatactgagctgagatttgcgaagagcagcagcatggatggattttatgaccagcaagtgccttacatggtcaccaatagtcagcgtgggagaaattgtaacgagaaaccaacaaatgtcaggaaaagaaaattcattaacagagatctggctcatgattcagaagaactctttcaagatctaagtcaattacaggaaacatggcttgcagaagctcaggtacctgacaatgatgagcagtttgtaccagactatcaggctgaaagtttggcttttcatggcctgccactgaaaatcaagaaagaaccccacagtccatgttcagaaatcagctctgcctgcagtcaagaacagccctttaaattcagctatggagaaaagtgcctgtacaatgtcagtgcctatgatcagaagccacaagtgggaatgaggccctccaacccccccacaccatccagcacgccagtgtccccactgcatcatgcatctccaaactcaactcatacaccgaaacctgaccgggccttcccagctcacctccctccatcgcagtccataccagatagcagctaccccatggaccacagatttcgccgccagctttctgaaccctgtaactcctttcctcctttgccgacgatgccaagggaaggacgtcctatgtaccaacgccagatgtctgagccaaacatccccttcccaccacaaggctttaagcaggagtaccacgacccagtgtatgaacacaacaccatggttggcagtgcggccagccaaagctttccccctcctctgatgattaaacaggaacccagagattttgcatatgactcagaagtgcctagctgccactccatttatatgaggcaagaaggcttcctggctcatcccagcagaacagaaggctgtatgtttgaaaagggccccaggcagttttatgatgacacctgtgttgtcccagaaaaattcgatggagacatcaaacaagagccaggaatgtatcgggaaggacccacataccaacggcgaggatcacttcagctctggcagtttttggtagctcttctggatgacccttcaaattctcattttattgcctggactggtcgaggcatggaatttaaactgattgagcctgaagaggtggcccgacgttggggcattcagaaaaacaggccagctatgaactatgataaacttagccgttcactccgctattactatgagaaaggaattatgcaaaaggtggctggagagagatatgtctacaagtttgtgtgtgatccagaagcccttttctccatggcctttccagataatcagcgtccactgctgaagacagacatggaacgtcacatcaacgaggaggacacagtgcctctttctcactttgatgagagcatggcctacatgccggaagggggctgctgcaacccccacccctacaacgaaggctacgtgtattaacacaagtgacagtcaagcagggcgtttttgcgcttttccttttttctgcaagatacagagaattgctgaatctttgttttatttctgttgtttgtattttatttttaaataataatacacaaaaaggggcttttcctgttgcattattctatggtctgccatggactgtgcactttatttgagggtgggtgggagtaatctaaacatttattctgtgtaacaggaagctaatgggtgaatgggcagagggatttggggattactttttacttaggcttgggatggggtcctacaagttttgagtatgatgaaactatatcatgtctgtttgatttcataacaacataagataatgtttattttatcggggtatctatggtacagttaatttcacgttgtgtaaatatccacttggagactatttgccttgggcattttcccctgtcatttatgagtctctgcaggtgtacaaaaaaaccccaatctactgtaaatggcagtttaattgttagaaatgactgtttttgcaccacttgtaaaaaggtatttagcgattgcatttgctgtttgttgttttattttgctttatatatgacttgcagaggataaccataaaatgggtaattctctctgaagttgaataatcaccatgactgtaaatgaggggcacaattttggactctggcgccaaactgagtcataggccagtagcattacgtgtatctggtgccaccttgctgtttagatacaaatcataccgtcttttaaatattttgaagcccatttcagttaaataatgacatgtcatggtcctttggaatcttcatttaaatgttaaatctggaatcaaaatgaagcaaaaaatatctgtctccttttcactttcttcagtacataaatacattatttaatcaataagaattaactgtactaaatcatgtattatgctgttctagttacagcaaacactctttaagaaaaatatccaatacactaaataggtactatagtaatttttagacatggtacccattgatatgcatttaaaccttttactgctgtgttatgttgataacatatataaatattagataatgctaatgcttctgctgctgtcttttctgtaatattctctttcatgctgaatttactatgaccatttataagcagtgcagttaactacagatagcatttcaggacaaaatagatgactcaaaccatttattgcttaaaaaatagcttacgccatgctatgctataagcagcttttatgcacattgacaaatgaagagtaagcttcagcttgctaaaggaaactgtggaaccttttgtaacttttggtgatatggaaaattatttacaaaccgtcaaagaatatgaggaagttgctgtatgacatagtgctggcactgatattatccatcatctctttttggacacttctgtaaatgtgattggattgtttgaaagaagatttaaagtttcaaagttttttgttctgtttttgctttgcatttggagaaaatattgaaagcagggtatgttgtttcattcaccttgaaaaaaccatgagtaaatggggatatagaatctctgaatagctcgctaaaagattcaagcaagggacatgaattttgttccatctatcaataatatccagaagaacaacttttttaaagagtctatagcaaaaagcaaaaaaaaaaaaaaattctaaacacaaagtcaaaataaacctattgtaaaagcatttcgtgatgagcatgaaaaagattgtttaaagatgatccccccagctacccattttccaaaactacacagatcacagctcatttctctaagtggagcagttatcaagaaacccaaacaccaaaattgctactcttcacatttaatcctacaaaaagtactccaatttcaaaatatgtatgtaacctgcgatttcaatgattgttgttcatatacatcatgtattattttggcccattttgggcctaaaaaagaaaactatgccttaaaaatcagaaccttttctccccactatgcttatgtggccatctacagcacttagaataaaaacagatgttaaaatattcagtgaaagttttattggaaaaaggaattgagatatataattgagatttggtgaaattgaaggagaaaatttaagtgagtctttaaaatatattctgaatgaaaactgtattgaggattcatttttgttccttttttttctttttctcttttctcctttttcttctttttaatagtctagttttagtcagtcagtgaggaagaattgggccatgctaacgttatcacaagagaacaatggcagaaatggtattagttatataatatttaaggacaaactatatgttttgctgttttaacgtagtgactcactgaactaaatacataattgaccaacattaagtgtatttccaatacagaagggttgaaaatattacattataaactcttttgaaaaatgtatctaaaattttttaagttctgttttgattccactttttggttgagtttttatgtttttgttttcaggtagattaataaatctggcagctgatttctgcaagattcttgtgttttgaatttctcattgaattggctactcaaacatagaaatcatttgttaatgatgtaatgtcttctctcagcttttatcttcactgctgtttgctgtctcttgatgatgacatgttaatacccaatagattaattgcaacaaacacttatactcaaataactaagtaaaaataatttttcttgttatgtccatgaaaagtgcttcagaataaaaatccacaagactgacagtgcagaacatttttctcaaatcatgggcggatcttggaggtctagtttcccgtagatgctgtaaccaattaccacaacttcagtaatttacacaaatttatcttatagttctggaggcagaagttcaaaagaagccttaagagactaaaaccaagatgtccttaggtctggttccttctggaggctccaggggagattcttccagctttcacttctagagtctgctgacattccttggctcctggctacatcacttcaatctctgcttccatggtcacatactcttctactatagtcaaatttccttcctgcctcttataaggatgcttgtgattacatttaggggatgctcagataatccaggacaatctctccatctcaagatccttaacttaatgacgtgtgccaagtccctttggctagataattattcataggtcccagggattaggacatggatgtaaggggtgagggcagggctgttattcagaacaccgcacggaggaggaagactgtgtagcaaagactctaattgatttactcaggaacagtggagttctgctgagggatctaggatttgaaagtactagagtttgcttttatttaccactgagatattttccccttattctgcataaataattttgaaaactttctatattaaatttcaactattccactaaaatgtctggtaatcacatcaagcctttagattattcaaatccttccccagcccccaggaaaacactaagtcatgaaacagaaaaacagaaggtatgataataatagtaataacagttaaatcagtggtctaatccagattttattttttaatacatttcttttggtgttaatatgggttactatgtgatcttatcatttgctagtgattattacttattaggtaagaacaatgtgtaaaatatgtctattactcaaaagaacaattgcaaaatgagtcaacttatctttatataaccaggaaagaaatatattgccagaagctacagaattttgccagatgatagggatttctaaaatgagccactttgtctatcatgcagccttttcagagcttgtaatgagaaaacattacagaggagaaggtcatttggatgtttgttacttggaatcctagaaaacaaaaactaaaatttaaaaataagaagtgagtaagctattttccatttgcgatttggtatggagaagagaggaaatagaattattaaaaaaatacaaattgggtaaaagtgatggtggaaaaaatataaagaaggcaaatgtacatattaagcaattctactaagaattggaaaaatcaagtttcaaaaagatggtaatagttgggcatgatactagaaaatttcacccagtttattcagagctcaactagtacttttaggacttctttttttatatacatgagactcactttgacatacttaaaaaaaaaacagtttatggaaagtacagtttaagaggagaatttgattagactaagtggatatctttatagaaatattaatgatttcagaattttcagttacaagtgtatataccgtggctattgtttatggattcatatgtaaggtagggtcttttttgcatatagactccagtattagttactttcattctaaaattatatttatgcttctatggggaagaaaatttttaattcacttggttgtattaaaattatacttacggtttgagaaaacatgctatgaaaatcatgattatagcaaattaaatatgctcaaaatttaaatctaaaataaaagcccagaaactgaaaa

SEQ ID NO: 5519 - DNA, 1059 bp, Homo sapiens
cgcgctcacagcggcccgcgggccgggcgtcatgggcggcctcttctggcgctccgcgctgcgggggctgcgctgcggcccgcgggccccgggcccgagcctgctagtgcgccacggctcgggagggccctcctggacccgggagcggaccctggtggcggtgaagcccgatggcgtgcaacggcggctcgttggggacgtgatccagcgctttgagaggcggggcttcacgctggtggggatgaagatgctgcaggcaccagagagcgtccttgccgagcactaccaggacctgcggaggaagcccttctaccctgccctcatccgctacatgagctctgggcctgtggtggccatggtctgggaagggtacaatgtcgtccgcgcctcgagggccatgattggacacaccgactcggctgaggctgccccaggaaccataaggggtgacttcagcgtccacatcagcaggaatgtcatccacgccagcgactccgtggagggggcccagcgggagatccagctgtggttccagagcagtgagctggtgagctgggcagacgggggccagcacagcagcatccacccagcctgaggctcaagctgcccttaccaccccatcccccacgcaggaccaactacctccgtcagcaagaacccaagcccacatccaaacctgcctgtcccaaaccacttacttccctgttcacctctgccccaccccagcccagaggagtttgagccaccaacttcagtgcctttctgtaccccaagccagcacaagattggaccaatcctttttgcaccaaagtgccggacaacctttgtggtgggggggggtcttcacattatcataacctctcctctaaaggggaggcattaaaattcactgtgcccagcacatgggtggtacactaattatgacttcccccagctctgaggtagaaatgacgcctttatgcaagttgtaaggagttgaacagtaaagaggaagttttgcacacccaaaaaaaaaaaaaaaaaaaaaaaaaaaaaaaaaaaaaaaaaaaaaaaaaaaaa

SEQ ID NO: 5520 - DNA, 2694 bp, Homo sapiens
gtcgcttcaatatttcaaaatggatccggttctgtggcgggtgcgagagtgaggctgtgggggacctccaggccgaacctccgcgaagcctcgcggcttctgcgtgccctggccccgggaggataaggatttcccttccctcctacttgcgcgcggagccgagctcttgttgagctatggagtcgccaaccaaggagattgaagaatttgagagcaactctctgaaatacctgcaaccggaacagatcgagaaaatctggcttcggctccgcgggctgaggaaatataagaaaacgtcccagagattacggtctttggtcaaacaattagagagaggggaagcttcagtggtagatcttaagaagaatttggaatatgcagccacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagccccggttcaagagcatcgttcacgcagtgcaggctgggatatttgtggagagaatgtatagacggacatcaaacatggttggactgagctatccaccagctgttattgaggcattaaaggatgtggacaagtggtcctttgacgtcttttccctcaatgaggccagtggggatcatgcactgaaatttattttctatgaactactcacacgttatgatctgatcagccgtttcaagatccccatttctgcacttgtctcatttgtggaggccctggaagtgggatacagcaagcacaaaaatccttaccataacttaatgcacgctgccgatgttacacagacagtgcattacctcctctataagacaggagtggcgaactggctgacggagctggagatctttgctataatcttctcagctgccatccatgactacgagcataccggaaccaccaacaatttccacattcagactcggtctgatccagctattctgtataatgacagatctgtactggagaatcaccatttaagtgcagcttatcgccttctgcaagatgacgaggaaatgaatattttgattaacctctcaaaggatgactggagggagtttcgaaccttggtaattgaaatggtgatggccacagatatgtcttgtcacttccaacaaatcaaagcaatgaagactgctctgcagcagccagaagccattgaaaagccaaaagccttatcccttatgctgcatacagcagatattagccatccagcaaaagcatgggacctccatcatcgctggacaatgtcactcctggaggagttcttcagacagggtgacagagaagcagagctggggctgcctttttctcctctgtgtgaccgaaagtccactatggttgctcagtcacaagtaggtttcattgatttcatcgtggaacccaccttcactgtgcttacggacatgaccgagaagattgtgagtccattaatcgatgaaacctctcaaactggtgggacaggacagaggcgttcgagtttgaatagcatcagctcgtcagatgccaagcgatcaggtgtcaagacctctggttcagagggaagtgccccgatcaacaattctgtcatctccgttgactataagagctttaaagctacttggacggaagtggtgcacatcaatcgggagagatggagggccaaggtacccaaagaggagaaggccaagaaggaagcagaggaaaaggctcgcctggccgcagaggagcagcaaaaggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaattccaaagccgagaagtcatcaggagaacagcaacagaatggtgacttcaaagatggtaaaaataagacagacaagaaggatcactctaacatcggaaatgattcaaagaaaacagatgattcacaagagtaaaaaagacctcatagacaataaaagaggctgccagtgtcttgcatcattctagctgagcttcttcattctccttcttctccttcttccacaaagacccatatctggagaaggtgtacaactttcaaacacaagccccccaccccctgacccttggccttccctcacaccatctccttccaggggatgaatctttgggggttggtttgaggtcttagaactctgggggatattcccctgagcaaaacaaacaacgtgagatttttactcaaacagaaacaaaacatgaaggggcatcctcaaaatcctttgctaatgacctggctttcaaggcatctgtctggcctgatgagaatggacatcctggatatgctgggagaggcctgaaaaaagccacacacacagtaattgccattttatgactgtcaatgccgttactttaaatgttgtcatttttgcactggctactgatgatacagccatgctgacattcatcaccgcaaagatgatgattccagtctctggttcctttcctgagtcaggaacatttgttttctccaatttcctttcagacttaaaattgttcttatgctttttttcccacttctgtaataca

SEQ ID NO: 5521 - DNA, 1634 bp, Homo sapiens
gggtggggaagcttagagaccggtgagggagcagagctggggcgcctgtgtacagggatagagcccggcggcagcagggcgcggcttccctttcccggggcctggggccgcaatcaggtggagtcgagaggccggaggaggggcaggaggaaggggtgcggtcgcgatccggacccggagccagcgcggagcacctgcgcccgcggctgacaccttcgctcgcagtttgttcgcagtttactcgcacaccagtttcccccaccgcgctttggattagtgtgatctcagctcaaggcaaaggtgggatatcatggcatctatctgggttggacaccgaggaacagtaagagattatccagactttagcccatcagtggatgctgaagctattcagaaagcaatcagaggaattggaactgatgagaaaatgctcatcagcattctgactgagaggtcaaatgcacagcggcagctgattgttaaggaatatcaagcagcatatggaaaggagctgaaagatgacttgaagggtgatctctctggccactttgagcatctcatggtggccctagtgactccaccagcagtctttgatgcaaagcagctaaagaaatccatgaagggcgcgggaacaaacgaagatgccttgattgaaatcttaactaccaggacaagcaggcaaatgaaggatatctctcaagcctattatacagtatacaagaagagtcttggagatgacattagttccgaaacatctggtgacttccggaaagctctgttgactttggcagatggcagaagagatgaaagtctgaaagtggatgagcatctggccaaacaagatgcccagattctctataaagctggtgagaacagatggggcacggatgaagacaaattcactgagatcctgtgtttaaggagctttcctcaattaaaactaacatttgatgaatacagaaatatcagccaaaaggacattgtggacagcataaaaggagaattatctgggcattttgaagacttactgttggccatagttaattgtgtgaggaacacgccggcctttttagccgaaagactgcatcgagccttgaagggtattggaactgatgagtttactctgaaccgaataatggtgtccagatcagaaattgaccttttggacattcgaacagagttcaagaagcattatggctattccctatattcagcaattaaatcggatacttctggagactatgaaatcacactcttaaaaatctgtggtggagatgactgaaccaagaagataatctccaaaggtccacgatgggctttcccaacagctccaccttacttcttctcatactatttaagagaacaagcaaatataaacagcaacttgtgttcctaacaggaattttcattgttctataacaacaacaacaaaagcgattattattttagagcatctcatttataatgtagcagctcataaatgaaattgaaaatggtattaaagatctgcaactactatccaacttatatttctgctttcaaagttaagaatctttatagttctactccattaaatataaagcaagataataaaaattgttgcttttgttaaaagtaaaaaaaaaaaaaaaaaa

SEQ ID NO: 5522 - DNA, 2683 bp, Homo sapiens
cagtcggctcggaattggacttgggaggcgcggtgaggagtcaggcttaaaacttgttggaggggagtaaccagcctgctcctctcgctctcctcctcgtctgcgccgcgtttcagagagaaaattcctgttccaagagaaaataaggcaacatcaatgaaggagagaagagccagccagaaattatccagcaaatctatcatggatcctaatcagaacgtgaaatgcaagatagttgtggtgggagacagtcagtgtggaaaaactgcgctgctccatgtcttcgccaaggactgcttccccgagaattacgttcctacagtgtttgagaattacacggccagttttgaaatcgacacacaaagaatagagttgagcctgtgggacacttcgggttctccttactatgacaatgtccgccccctctcttaccctgattcggatgctgtgctgatttgctttgacatcagtagaccagagaccctggacagtgtcctcaaaaagtggaaaggtgaaatccaggaattttgtccaaataccaaaatgctcttggtcggctgcaagtctgatctgcggacagatgttagtacattagtagagctctccaatcacaggcagacgccagtgtcctatgaccagggggcaaatatggccaaacagattggagcagctacttatatcgaatgctcagctttacagtcggaaaatagcgtcagagacatttttcacgttgccaccttggcatgtgtaaataagacaaataaaaacgttaagcggaacaaatcacagagagccacaaagcggatttcacacatgcctagcagaccagaactctcggcagttgctacggacttacgaaaggacaaagcgaagagctgcactgtgatgtgaatctttcattatctttaatgaagacaaaggaatctagtgtaaaaaacaacagcaaacaaaaaggtgaagtctaaatgaagtgcacagccaaagtcatgtataccagaggcttaggaggcgtttgagaggatactcatctttttggaatcctgaccttaggttcggcatgtagaccaagtgatgagaagtgaatacatggaagagtttttaagtgtgacttgaaaaatatgccaaaaaatgagagatacaaatgagctagaggaagatgaggggggatgcgagtacctccaagaagaaaaatcacactctgaatggtgcttgcatttttgggttttttttttttgttataatctattcatggatctccactttgatttaatttttaaatgttttaatctcctttacaaaaagtatacgttaatataccgtcctcaagggggaactggcactgtgaccttagcatttagttttctagaggatgtgatctaatttctttctagctcatcattaaaaaggaaattgtatcaggacccatgggatatatccagaggcaaactttatgaggctttgaaatcttgccttcctgaagatagctgagtaggatggttctaaggaaagcctttgcaatcttgcaagatttgtagaccagcactacaaagatcgcatagatcaaataggaaaaaaaatgtcgatttttattcagtctgatggttctgttcttcattgtgattgtcattaaaaagtggtaaattgctcaatgtaatatttttgtgcgctgtttagaagttgtgtgattttttgccatcgttgataaaaatgcaaagtcaaataaaaggtgtcttggtttgatgtcatagaatgatccaaggagagaaaaaaggtagttactgttttcaccagaaaaggtaatgagtgaaggaaagaatagtagcagaaagcacagtttgtgagtaaagctgtctggaattaagttaccaaaaatacaaagcaaaaggactattattttgggttgaagctccaaaactgacagcatctgataatctgttggtttatttcacttttcattaaatgaacattgatgagagaagatgccacttacccaagctttagagaatccctagtggaagattatatgataaactttcagtcctgacataacactagggcatttctagagtgtcattgctaaaacctcactgaacagatgcagccaaggtctgtgttcagcacttggtctctgttgttacgtaaaataataagcatttaaaatagtttacagatatttttgaccagttccttttagagattctttcagagaagaaaccagatctgacctgtttattgttggcgcttgttgaaaacgagctttctttcccatgatagtgcttcgtttttgaagtgttgaagctgtgctccccttaaatcgtggcaggagagattaaggtaattacaacactcagttctatgtcttacaagcactttgtcttgtctctgcaagaaaattcgattccagtcatttcccataaaatacagacattttaccaacataatatgctttgattgatgcagcattatgctttgggcagtattacaaaatagctggcgagtgctttctgtatttaaatattgtaaaaagaaaataagttataactgttataaagcagaacttttgttgcattttttaaactgttgaagtcactgtgtatgtttgtttggtcaatgtttccgcagtatttattaaaacatactttttttttcttcaaataaaaaagtaaccatgtctttgtctaaa

SEQ ID NO: 5523 - DNA, 836 bp, Homo sapiens
ccggtgagtcgccggcgctgcagagggaggcggcactggtctcgacgtggggcggccagcgatgaagccgcccagttcaatacaaacaagtgagtttgactcatcagatgaagagcctattgaagatgaacagactccaattcatatatcatggctatctttgtcacgagtgaattgttctcagtttctcggtttatgtgctcttccaggttgtaaatttaaagatgttagaagaaatgtccaaaaagatacagaagaactaaagagctgtggtatacaagacatatttgttttctgcaccagaggggaactgtcaaaatatagagtcccaaaccttctggatctctaccagcaatgtggaattatcacccatcatcatccaatcgcagatggagggactcctgacatagccagctgctgtgaaataatggaagagcttacaacctgccttaaaaattaccgaaaaaccttaatacactgctatggaggacttgggagatcttgtcttgtagctgcttgtctcctactatacctgtctgacacaatatcaccagagcaagccatagacagcctgcgagacctaagaggatccggggcaatacagaccatcaagcaatacaattatcttcatgagtttcgggacaaattagctgcacatctatcatcaagagattcacaatcaagatctgtatcaagataaaggaattcaaatagcatatatatgaccatgtctgaaatgtcagttctctagcataatttgtattgaaatgaaaccaccagtgttatcaacttgaatgtaaatgtacatgtgcagatattcctaaagttttattgac

SEQ ID NO: 5524 - DNA, 1753 bp, Homo sapiens
cagccccgcccctacctgtggaagcccagccgcccgctcccgcggataaaaggcgcggagtgtccccgaggtcagcgagtgcgcgctcctcctcgcccgccgctaggtccatcccggcccagccaccatgtccatccacttcagctccccggtattcacctcgcgctcagccgccttctcgggccgcggcgcccaggtgcgcctgagctccgctcgccccggcggccttggcagcagcagcctctacggcctcggcgcctcacggccgcgcgtggccgtgcgctctgcctatgggggcccggtgggcgccggcatccgcgaggtcaccattaaccagagcctgctggccccgctgcggctggacgccgacccctccctccagcgggtgcgccaggaggagagcgagcagatcaagaccctcaacaacaagtttgcctccttcatcgacaaggtgcggtttctggagcagcagaacaagctgctggagaccaagtggacgctgctgcaggagcagaagtcggccaagagcagccgcctcccagacatctttgaggcccagattgctggccttcggggtcagcttgaggcactgcaggtggatgggggccgcctggaggcggagctgcggagcatgcaggatgtggtggaggacttcaagaataagtacgaagatgaaattaaccaccgcacagctgctgagaatgagtttgtggtgctgaagaaggatgtggatgctgcctacatgagcaaggtggagctggaggccaaggtggatgccctgaatgatgagatcaacttcctcaggaccctcaatgagacggagttgacagagctgcagtcccagatctccgacacatctgtggtgctgtccatggacaacagtcgctccctggacctggacggcatcatcgctgaggtcaaggcgcagtatgaggagatggccaaatgcagccgggctgaggctgaagcctggtaccagaccaagtttgagaccctccaggcccaggctgggaagcatggggacgacctccggaatacccggaatgagatttcagagatgaaccgggccatccagaggctgcaggctgagatcgacaacatcaagaaccagcgtgccaagttggaggccgccattgccgaggctgaggagcgtggggagctggcgctcaaggatgctcgtgccaagcaggaggagctggaagccgccctgcagcggggcaagcaggatatggcacggcagctgcgtgagtaccaggaactcatgagcgtgaagctggccctggacatcgagatcgccacctaccgcaagctgctggagggcgaggagagccggttggctggagatggagtgggagccgtgaatatctctgtgatgaattccactggtggcagtagcagtggcggtggcattgggctgaccctcgggggaaccatgggcagcaatgccctgagcttctccagcagtgcgggtcctgggctcctgaaggcttattccatccggaccgcatccgccagtcgcaggagtgcccgcgactgagccgcctcccaccactccactcctccagccaccacccacaatcacaagaagattcccacccctgcctcccatgcctggtcccaagacagtgagacagtctggaaagtgatgtcagaatagcttccaataaagcagcctcattctgaggcctgagtgatccacgtgaaaaaaaaaaaaaaaaaaaaaaaaaaaaaaaaaaaaaaaaaaaaaaaaaaa

SEQ ID NO: 5525 - DNA, 1720 bp, Homo sapiens
agttaggagggccccgccttccccagctgcatataaaggtctctggggttggaggcagccacagcacgctctcagccttcctgagcacctttccttctttcagccaactgctcactcgctcacctccctccttggcaccatgaccacctgcagccgccagttcacctcctccagctccatgaagggctcctgcggcatcggaggcggcatcgggggcggctccagccgcatctcctccgtcctggccggagggtcctgccgtgcccccagcacctacgggggcggcctgtctgtctcctctcgcttctcctctgggggagcctgcgggctggggggcggctatggcggtggcttcagcagcagcagcagctttggtagtggcttcgggggaggatatggtggtggccttggtgctggcttcggtggtggcttgggtgctggctttggtggtggttttgctggtggtgatgggcttctggtgggcagtgagaaggtgaccatgcagaacctcaatgaccgcctggcctcctacctggacaaggtgcgtgctctggaggaggccaacgccgacctggaagtgaagatccgtgactggtaccagaggcagcggcccagtgagatcaaagactacagtccctacttcaagaccatcgaggacctgaggaacaagatcattgcggccaccattgagaatgcgcagcccattttgcagattgacaatgccaggctggcagccgatgacttcaggaccaagtatgagcatgaactggccctgcggcagactgtggaggccgacgtcaatggcctgcgccgggtgttggatgagctgaccctggccaggactgacctggagatgcagatcgaaggcctgaaggaggagctggcctacctgaggaagaaccacgaggaggagatgcttgctctgagaggtcagaccggcggagatgtgaacgtggagatggatgctgcacctggcgtggacctgagccgcatcctgaatgagatgcgtgaccagtacgagcagatggcagagaaaaaccgcagagacgctgagacctggttcctgagcaagaccgaggagctgaacaaagaagtggcctccaacagcgaactggtacagagcagccgcagtgaggtgacggagctccggagggtgctccagggcctggagattgagctgcagtcccagctcagcatgaaagcatccctggagaacagcctggaggagaccaaaggccgctactgcatgcagctgtcccagatccagggactgattggcagtgtggaggagcagctggcccagctacgctgtgagatggagcagcagagccaggagtaccagatcttgctggatgtgaagacgcggctggagcaggagattgccacctaccgccgcctgctggagggcgaggatgcccacctttcctcccagcaagcatctggccaatcctattcttcccgcgaggtcttcacctcctcctcgtcctcttcgagccgtcagacccggcccatcctcaaggagcagagctcatccagcttcagccagggccagagctcctagaactgagctgcctctaccacagcctcctgcccaccagctggcctcacctcctgaaggcccgggtcaggaccctgctctcctggcgcagttcccagctatctcccctgctcctctgctggtggtgggctaataaagctgactttctggttgatgcaaaaa

SEQ ID NO: 5526 - DNA, 8159 bp, Homo sapiens
cgccttttttgaaaaagcattttaccaccaaccaccaccccaatccaacccacaccgaaccttcgcgcaccccctacaccccaacaacaacaacaactgcaaaatagaaaacaaatccccaaacccaggcgaaaagcagccaacaccggcggcggcggcggcctcggcaagcacggccagcgcgctcggactgcaagagggttaaaagtgtagattggatttcacccctggaaatctagcacgccgagtgaacttgaatctttggctatttaaggaggactgggtttgttgtgaagttgcggtgatccagcgcagagccccgtcctgattgatcgcatcgcggggctcagatgactgtaaaatgaatagatgaaattcttgcttctcgaagattttcttgggcatctcccggaaagtgcgttttaaggcgaagtcatgatgtattctcccatctgtctcactcaggatgaatttcacccattcatcgaggcacttcttccacatgtccgtgcaattgcctatacttggttcaacctgcaggctcgaaaacgcaagtactttaaaaagcatgagaagcgaatgtcaaaggatgaagaaagagcagtcaaagatgagcttctcagtgaaaagcctgaaatcaaacagaagtgggcatccaggctccttgccaaactgcgcaaagatattcgccaggagtatcgagaggactttgtgctcaccgtgactggcaagaagcacccgtgctgtgtcttatccaatcccgaccagaagggtaagattaggagaatcgactgcctgcgacaggcagacaaagtctggcgtctggatctagtcatggtgatcctgttcaaaggcatccccttggaaagtaccgatggagagcggctcatgaaatccccacattgcacaaacccagcactttgtgtccagccacatcatatcacagtatcagttaaggagcttgatttgtttttggcatactacgtgcaggagcaagattctggacaatcaggaagtccaagccacaatgatcctgccaagaatcctccaggttaccttgaggatagttttgtaaaatctggagtcttcaatgtatcagaacttgtaagagtatccagaacgcccataacccagggaactggagtcaacttcccaattggagaaatcccaagccaaccatactatcatgacatgaactcgggggtcaatcttcagaggtctctgtcttctccaccaagcagcaaaagacccaaaactatatccatagatgaaaatatggaaccaagtcctacaggagacttttacccctctccaagttcaccagctgctggaagtcgaacatggcacgaaagagatcaagatatgtcttctccgactactatgaagaagcctgaaaagccattgttcagctctgcatctccacaggattcttccccaagactgagcactttcccccagcaccaccatcccggaatacctggagttgcacacagtgtcatctcaactcgaactccacctccaccttcaccgttgccatttccaacacaagctatccttcctccagccccatcgagctacttttctcatccaacaatcagatatcctccccacctgaatcctcaggatactctgaagaactatgtaccttcttatgacccatccagtccacaaaccagccagtcctggtacctgggctagcttggttcctttccaagtgtcaaataggacacccatcttaccggccaatgtccaaaattacggtttgaacataattggagaacctttccttcaagcagaaacaagcaactgagggaaaaagaaacacaacaatagtttaagaaattttttttttaaataaaaaaaaaggaaaagaggaagactggacaaaacaacacaaaggcagaaaggaaagaaactgaagaaagaagataatagaccagcaattgcagcacttacaatcactaattcccttaaggttgaaactgtaatgacataaaaagggtcgatgatatttcactgatggtagatcgcagcccctgcaacgtagcctttgttacatgaagtccgctgggaaatagatgttctgtctctatgacaatatattttaactgactttctagatgccttaatatttgcatgataagctagttttattggtttagtattcttgttgtttacgcatggaatcactattcctggttatctcaccaacgaaggctaggaggcggcgtcagaggtgctgggtgacagagccatgagccagccattttataagcactctgatttctaaaagttaaaaaaaatatatgaaatctctgtagcctttagttatcagtacagatttattaaatttcggcccttaacccagccttttccagtgtgtaacccagtttgaaatcttaaaaaaagaaaaaatgaaaaaaaaaggaaaaaaagaaaaaaggaaaaaaacagtttgaacacaaaggctctatggaagaaatgcctctatgtaggtgaagtgttctctctgcatgcaacagtaaaaattaatataatattttccccacaaaagaaacacttaacagaggcaagtgcaatttataaatttatatctaaaggggaatcatgattataagtccttcagcccttggactctaaattgaggggattaaaaagaatttaaaataattttgaacgaatttattttcccctcagtttttgagggcattaaaaaggcattaaatcaagacaaatcatgtgcttgagaaaaataaaattaatgaaaacacagcacttatgttggtttagctgcagcctccttggaggtagaatttatttatttaaaattactggttgcatcaagaacccatagggtgtacaaaaggttctataaaatctgcattatagagacaaagaggcaggcaaatccatgtcacaagggtaaagcttacagtttacaaactgggaacgccagggtgtaggatataaaaacgcactcttgagaaaacaaatgtaatcagggtgctgaaaacttgcatggtgctttcagacattagccttgttcaacaaatttcttgtattgacagatccatagtgtgcatgggcagacacattttgcctctatgtctcttaaaattttaattaaaaatactctttccagtaatcctaatttgcacgaagatataatgtccacattacgtgccttgccttgaaatctaaaaaacaaaaaacaaaaaaaaaaaaacaaaaaaatacaacaaagtgacatcactacacttgttttgctgcatttattatcattttaaatctttaccatttttatgacaaaatattttgtactccagacgaagaaaaatgtgtgacatcatggattttttagacagttatacctttatctcacatttataaagcatatcatggctgtgtatagttgccgcttaaaaattgtaatcgaccagcaatattttcagtattttggtgtttttttctattaacctttcatgtttttcatcttccaattaatatttgggggggaggggtttcaaatttatacgaattatgcaataccaagttttgcctatgtaggtagtgcttttagctgtattggttattataggtaagtacacagatttaaaaaaaaaataatgtatgcttttttgtttgtttgtttgttttaattgaccaaagtgggtactgctatttttgcagtgtgatgaggtccttttgtgtactgagagatggacaggggattttttttaatatacatatatatatattctggggtgggtgggaggatttttaacactttgcagtgtagctgtgaagcagtgcaccctgagatgggcctgggctgcaaagcgactgttctgcctactgtgacaaacttcaacttacacaggttcccctctctaacttcccacctgggttgcaagctgaactcattactggttttcataacaacacaatagtaagaacaagcaaacacaacaaattctcctggaggcagacttggcttaaaaaggcagacttggcttggtgatagtttttcttgaaagttccagatccacagtggagagtgagcctgtctcatatttggcaaaaatatttgttgaaatgtccacataggggatgttggatgtttaacacttttgagagtttaacacatgaatattctttctcctagaaaacacattagacctgttggagggagtctcccgtattccttttctgccacttttcgtccccatttcatttcattaatgataggatatgatttacctgtgacttactacttcaaatggatggcagtgcacttggatttttttttaatatccagaagattgaacagagggttgctattgttgaatgtatttggactgatagattaaaatcaaagttcaatttttaaggaacaaaaaagtaaatcctgttttcattttatctccccttttaaaactgagaaccagagcagaagggaaatatagaattttaagcaattaatcttcctgtggatgaattaaacccattagatgctgatgggatttttttaaggaatggtaccttaactatatatttgatttcgtttcccctgagggctagaggctgaatggaggctggttttattttgcctttccctcaccgcccagtcccattgagtgtattcattactagaaggaaaatctttcagaattggtgacacatggtaggctgtcttaaggagtcccctggcccccttcccctaggccatggcctaataaaataaactgtcaattgttctcacagcatatcatttaataatgaatactttagaacaatgcttatgggctggagaattgtatttgattagcccattcagtttgatagcccaaatgctgaacagcacagcgggatcctagcagtgcaagttcaaaagtaagtccaatcatttctgtgatactcgccctggtagcaaacagatcatctcagccaagctcttcatgtatctttgacctattaggtgaacaaatgaacctcacaggacacacagtattttttaaaggcagactcgctctcttttttgccagtgagcagttctagctaaccaagttacacactgtgggtattcctgcctgcctcttgaatacaaaggcctagttcaagtgttgctttttttatttcaaatcaattttttcttctttcctttttgagataaaactattaaaagtactactatatatataaaatctcaaatcaacttttcggcctcctcctcgtgtaccaggaagtatattctgacgaagggccccacttttgcaggtcttgcacgcccctcccttacccagaactgcagagcttcaggatggcgaaggtcacccaagggcatgagtagggagtggtgtctccaaccatcagttccgtggcactgttcagcctttgtgtgctgccctgccacccaccactcacagtgcctctgaagcgtgttacccctggagtgacgtgagcatttgaggcttgtctaaggaaaaaaataaaaggcagtgaaggagactgtacataaagacatggcaaaaatcttaattatagcaatatagttatcgggtaatgttcgggtgggcagctccattaaaaaatatgtgaatgaatctgtgaagctgcaagtagcgagaagagcgaaaggtcttcttaatgaaccgcctaccttgtagacagtaatttgtacactgtatagttttgttaagaattttttttaaattaaaattcccatgtttgtaaagctaactttttaacaattataatggaactatatgttgtttccatttttaaagtaaacaagaatattccttgtttagagactggacttgagttaaaactctccagtctcttaagttatgtattaaaaagaaaatctgtccatgttaggagttatttcacagattcctgtgcttgaaaagcataggatactaatcctttaaaaaagtgtaaatggagaaaagttatattttatgaaggttattttgttgtatttagtattggaaaagttggtttccagagcatttcagaatgtcgaagcaccactgtctttttattagtatatacggcctttagcaaaagtttttgtgattgttacgtgatggtatttaaggttaagtttcacagagcattcaggataggcagaaaactaaaacagtgctatgtctcacataacgtgtcctcagggagcagaatcttggatttgtgacttgtagcttcataaggactcaacgaaagagattgcacagggacatcttcagcggtgtgacagcaggacatgttctttacctagattcaaattctatgtactgtgtgaaatgatgaaggctgcagaaagttatcccatattcagtgtacagtattcatttttaatgaaacaactctacaatattgctggcagataggccccaagcatgacattcaatatagtttacatgttcctgtcaaggtcttttgttaacattaaccagctgcatgctttctggactttaagaaattgggtttctatagaaaactttttttttttttttttttttaatgtgcaggctattcaagttcaatagtaaaagctcaaaaatgaatgttctactccatgctgaaggagctgaaagctgccttcttcatattttgcactttctggtagttcccctgttttttctaattccctaaaattgtgtgggtggagtggagccctgcagttggggggtaacatggaccactgattttgccctttgaccctgcacaatgacctttgcatcagccaaactcattgccatgacaactctttgtactgtgtccgtgccacagatctgttggtcacattgttaatagtaaaggggacaagttggagacggtcaatttttacattttttgttgcaattttttcttcaatggttgtaagtagtttttttttttttttaataataaaagggttcactagttaatactctagaaatatctgtgtgttgcaattcaaatgtatgttgagattgtgaaaagcgcttcagtgccactagcttaccggtacactagactaagcccttgatgacttattgcatgatacagtaccaggaacaacaggtggcctaaatacatgaaaagcagtgtaagctagtgacactaaagccagtcttgtattactgtatttttgacagaatggttttgaaaactgtgctacagggactgatgtggcaaatatatctctttatgcagaaggaagtctttttttttcttttttttttttttaagaagtatggctttttatgcatccttcatcgagggcattgaagttgcatggactgataaaagttgatgcaaaacaagaaagaaacaaacaaaaaaaaaaaaccagcaaaatgtttaccaaaaaactcaaacaaatgagcagtgcctgttcaatttcacagtctctgttgagttcagttgtaaatatgtttcaaatgacattttcttgggaaaaaaaatctctacaacattgtagaatgtgaggggtaactacatcccaggcataggtttctcaaagctgcagtagattatgtcttcatcaagctgttaatttgtgcttatatcatatagaacttttagcatcctgggaagagctgcccccacctcaatgatatttctctgagaacaacttttgtaggactgtgtgtttctttagatacatttagtacaactgtaggtgacgagtagtcagttattgcttgctagctacacaccagggttgatccattttaaaacttttggcattttgtcctcatgggccataaatacagaaccttgtattttaattaaatttttttacaaaaggaggcacatgcacaatctccatgtaacaaacctttagcagtaggatgtattatacgacagttacttaatttctagagttcaggcctctgggatcaaccccagactgggccagaatgttagtgaaggttttattgtgcccggttggaggataacgttctttgggtactttttgtgggttgcaaatgaactcaattgccacaagttttaaactggtgtaaatcaagcttgacttaatgtgattgttactgttatatccagcctatactgctagcagctgctcatactgcagtcaattactggaagcggatatatttcctatgcaaaaactgtttaaacaataaaatgagctatgctacaga

SEQ ID NO: 5527 - DNA, 2169 bp, Homo sapiens
gtccccgccgtgcgcccttcgccgctgagctcgcagcctccggcgcccacctccacctccagtgtcccgcctcgggccgtcgccctccagcggctcgcgagcgtgggagacgtacctgggcaggcactgtccagcccaggcccaggcacagccgtgaggggcgaggcacggggacatcctggcggccaccatggtggccacgtgcctgcaggtggtgggcttcgtcacgagcttcgtgggctggatcggggtcatcgtgaccacctccaccaatgactgggtggtgacctgcggctacaccatccccacctgccgcaagctggatgagctgggctccaaggggctgtgggccgactgcgtcatggccacggggctgtaccactgcaagcccctggtggacatcctcatcctgccgggctacgtgcaggcctgccgcgccctgatgattgctgcctcggtcctgggtctgccggccattttactgctgctgactgttcttccctgcatccggatgggccaggagcccggtgtggctaagtacaggcgggcccagctggctggtgttttgctcattctgctggctctctgcgcccttgttgccaccatctggttccctgtgtgcgcccaccgtgagaccaccatcgtgagctttggctactccctgtatgcaggctggattggtgctgtgctgtgcctcgtgggtggctgtgtcatcctctgctgcgctggagatgcccaggcctttggtgaaaaccgtttctactacactgcgggctctagctccccgactcatgcgaagagtgcccacgtataagagggctgcccggctgcccacagaggtgctgtagatgctgggcccagggccctaggtttgctcgtcacagtgtggggaagcccattcctctgccaggctctaaagccaaaggtctagaaaagcatcctgtctggcattttgtagtcttaacttctccccatttcccccatcttttggttgccttaaaagaaatctctagctcagataatgcccagacatttttttcccttggtgttgcccctattagctcttttcttgggcattcttttgctgtttattaaaaatatattatatatattttgtttctttaaatttcaaatgttttgcaaacatcactgagttaggtgggggtggggaagagaaatacaagatacttttttttttttttttttttttttttttttaaatagggcctcactctgttgctcaggctggagtgcggtggtgtgatctcggctcatgtagcctcaacctccccggctcaagtgatcctcctgcctcagcctcccaagtagctgggactacaggcgttcactactacacccagctaatttttaagttttttatagagatgagggctccctatgttgcccaggttggtctcgaactcctggactcaaagtatcctcccgcctcggcctcccaaagtgttgggattataggagtgagccaccacaccaggccaagatgcttttcaaactgatacagatgacaatgggagcctcataaagatggcttttgtttcttcccttcaaggtcatttacttgtacgagacagaaaaagatagcattggggacatgggatgggggagggagggcaatagtggaacgaactttccatgggaaactttcccttttgtaagttgagggccaggggtagggatattttttagtttgtgattttacatttatctgtacatactttttcaagattgatcatttttataaccatggttttcctgaaatcctcaattcatcaatatgaaggaaatgaaccacatagactttatgcaataaataacagtgcaagtgagtataactctaactgatgttccacaaaacatttttgatttcaggtttgtatgatgtagtttttaatcgtacattttcatatgcttcaaactaacacatttttaaagctttcccccacttttctctctatttgtattgttagccatcttgaagtgatgttgtttaacataaattgtactgttgaatttggctttacgggtgtaaacactgatggtatatcagtatctgagaccccaaactctccaaatactgatggtgcattttattcttgaagtgaaatctgtgcaataaaataacagactgtctgcaaaaaaaaaaaaaaa

SEQ ID NO: 5528 - DNA, 3226 bp, Homo sapiens
cgcgagctaagcaggaggcggaggcggaggcggagggcgaggggcggggagcgccgcctggagcgcggcaggtcatattgaacattccagatacctatcattactcgatgctgttgataacagcaagatggctttgaactcagggtcaccaccagctattggaccttactatgaaaaccatggataccaaccggaaaacccctatcccgcacagcccactgtggtccccactgtctacgaggtgcatccggctcagtactacccgtcccccgtgccccagtacgccccgagggtcctgacgcaggcttccaaccccgtcgtctgcacgcagcccaaatccccatccgggacagtgtgcacctcaaagactaagaaagcactgtgcatcaccttgaccctggggaccttcctcgtgggagctgcgctggccgctggcctactctggaagttcatgggcagcaagtgctccaactctgggatagagtgcgactcctcaggtacctgcatcaacccctctaactggtgtgatggcgtgtcacactgccccggcggggaggacgagaatcggtgtgttcgcctctacggaccaaacttcatccttcagatgtactcatctcagaggaagtcctggcaccctgtgtgccaagacgactggaacgagaactacgggcgggcggcctgcagggacatgggctataagaataatttttactctagccaaggaatagtggatgacagcggatccaccagctttatgaaactgaacacaagtgccggcaatgtcgatatctataaaaaactgtaccacagtgatgcctgttcttcaaaagcagtggtttctttacgctgtatagcctgcggggtcaacttgaactcaagccgccagagcaggatcgtgggcggtgagagcgcgctcccgggggcctggccctggcaggtcagcctgcacgtccagaacgtccacgtgtgcggaggctccatcatcacccccgagtggatcgtgacagccgcccactgcgtggaaaaacctcttaacaatccatggcattggacggcatttgcggggattttgagacaatctttcatgttctatggagccggataccaagtagaaaaagtgatttctcatccaaattatgactccaagaccaagaacaatgacattgcgctgatgaagctgcagaagcctctgactttcaacgacctagtgaaaccagtgtgtctgcccaacccaggcatgatgctgcagccagaacagctctgctggatttccgggtggggggccaccgaggagaaagggaagacctcagaagtgctgaacgctgccaaggtgcttctcattgagacacagagatgcaacagcagatatgtctatgacaacctgatcacaccagccatgatctgtgccggcttcctgcaggggaacgtcgattcttgccagggtgacagtggagggcctctggtcacttcgaagaacaatatctggtggctgataggggatacaagctggggttctggctgtgccaaagcttacagaccaggagtgtacgggaatgtgatggtattcacggactggatttatcgacaaatgagggcagacggctaatccacatggtcttcgtccttgacgtcgttttacaagaaaacaatggggctggttttgcttccccgtgcatgatttactcttagagatgattcagaggtcacttcatttttattaaacagtgaacttgtctggctttggcactctctgccattctgtgcaggctgcagtggctcccctgcccagcctgctctccctaaccccttgtccgcaaggggtgatggccggctggttgtgggcactggcggtcaagtgtggaggagaggggtggaggctgccccattgagatcttcctgctgagtcctttccaggggccaattttggatgagcatggagctgtcacctctcagctgctggatgacttgagatgaaaaaggagagacatggaaagggagacagccaggtggcacctgcagcggctgccctctggggccacttggtagtgtccccagcctacctctccacaaggggattttgctgatgggttcttagagccttagcagccctggatggtggccagaaataaagggaccagcccttcatgggtggtgacgtggtagtcacttgtaaggggaacagaaacatttttgttcttatggggtgagaatatagacagtgcccttggtgcgagggaagcaattgaaaaggaacttgccctgagcactcctggtgcaggtctccacctgcacattgggtggggctcctgggagggagactcagccttcctcctcatcctccctgaccctgctcctagcaccctggagagtgcacatgccccttggtcctggcagggcgccaagtctggcaccatgttggcctcttcaggcctgctagtcactggaaattgaggtccatgggggaaatcaaggatgctcagtttaaggtacactgtttccatgttatgtttctacacattgctacctcagtgctcctggaaacttagcttttgatgtctccaagtagtccaccttcatttaactctttgaaactgtatcacctttgccaagtaagagtggtggcctatttcagctgctttgacaaaatgactggctcctgacttaacgttctataaatgaatgtgctgaagcaaagtgcccatggtggcggcgaagaagagaaagatgtgttttgttttggactctctgtggtcccttccaatgctgtgggtttccaaccaggggaagggtcccttttgcattgccaagtgccataaccatgagcactactctaccatggttctgcctcctggccaagcaggctggtttgcaagaatgaaatgaatgattctacagctaggacttaaccttgaaatggaaagtcttgcaatcccatttgcaggatccgtctgtgcacatgcctctgtagagagcagcattcccagggaccttggaaacagttggcactgtaaggtgcttgctccccaagacacatcctaaaaggtgttgtaatggtgaaaacgtcttccttctttattgccccttcttatttatgtgaacaactgtttgtctttttttgtatcttttttaaactgtaaagttcaattgtgaaaatgaatatcatgcaaataaattatgcgatttttttttcaaagcaaaaaaaaaaaaaaaaaaaaaaaaaaaaaaa

SEQ ID NO: 5529 - DNA, 2126 bp, Homo sapiens
gtaaggccgttttcttttcccattcgctcatctgccaggaaaagggacttgccgttggcgcttcggcctcttgttcattgagaaaaaagaggaaatactccgcgtgcgcttgtagaaggggagtcgtctccagctccgaaccccggagtgttcatcagcggggaatctggctccgaattctctttttttctcccgccgattgctcggaagttggtctaaagcagaggttggaaagaaaggaaaaaagtttgcatcgagactggatttatttgcacatcgcagaaagaagagaatccaagggagaggggttggtgcaaagccgcgatcacggagttcagatgtgttctaagcctgctggagtgaccacacttccaagacctgatggaggccagagctcagagtggcaacgggtcgcagcccttgctgcagacgccccgtgacggtggcagacagcgtggggagcccgaccccagagacgccctcacccagcaggtacatgtcttgtctctggatcagatcagagccatccgaaacaccaatgagtacacagaggggcctactgtcgtcccaagacctgggctcaagcctgctcctcgcccctccactcagcacaaacacgagagactccacggtctgcctgagcaccgccagcctcctaggctccagcactcgcaggtccattcttctgcacgagcccctctgtccagatccataagcacggtcagctcagggtcgcggagcagtacgaggacaagtaccagcagcagctcctctgaacagagactgctaggatcatccttctcctccgggcctgttgctgatggcataatccgggtgcaacccaaatctgagctcaagccaggtgagcttaagccactgagcaaggaagatttgggcctgcacgcctacaggtgtgaggactgtggcaagtgcaaatgtaaggagtgcacctacccaaggcctctgccatcagactggatctgcgacaagcagtgcctttgctcggcccagaacgtgattgactatgggacttgtgtatgctgtgtgaaaggtctcttctatcactgttctaatgatgatgaggacaactgtgctgacaacccatgttcttgcagccagtctcactgttgtacacgatggtcagccatgggtgtcatgtccctctttttgccttgtttatggtgttaccttccagccaagggttgccttaaattgtgccaggggtgttatgaccgggttaacaggcctggttgccgctgtaaaaactcaaacacagtttgctgcaaagttcccactgtcccccctaggaactttgaaaaaccaacatagcatcattaatcaggaatattacagtaatgaggattttttctttctttttttaatacacatatgcaaccaactaaacagttataatcttggcactgttaatagaaaggtgggatagtctttgctgtttgcggtgaaatgctttttgtccatgtgccgttttaactgatatgcttgttagaactcagctaatggagctcaaagtatgagatacagaacttggtgacccatgtattgcataagctaaagcaacacagacactcctaggcaaagtttttgtttgtgaatagtacttgcaaaacttgtaaattagcagatgacttttttccattgttttctccagagagaatgtgctatatttttgtatatacaataatatttgcaactgtgaaaaacaagttgtgccatactacatggcacagacacaaaatattatactaatatgttgtacattcggaagaatgtgaatcaatcagtatgtttttagattgtattttgccttacagaaagcctttattgtaagactctgatttccctttggacttcatgtatattgtacagttacagtaaaattcaacctttattttctaattttttcaacatattgtttagtgtaaagaatatttatttgaagttttattattttataaaaaagaatatttattttaagaggcatcttacaaattttgccccttttatgaggatgtgatagttgctgcaaatgaggggttacagatgcatatgtccaatataaaatagaaaatatattaacgtttgaaattaaaaaaaaaaaaaaaaaa

SEQ ID NO: 5530 - DNA, 1934 bp, Homo sapiens
agaaccccgcggggtctgagcagcccagcgtgcccattccagcgcccgcgtccccgcagcatgccgcgcccccgcctgctggccgcgctgtgcggcgcgctgctctgcgcccccagcctcctcgtcgccctggatatctgttccaaaaacccctgccacaacggtggtttatgcgaggagatttcccaagaagtgcgaggagatgtcttcccctcgtacacctgcacgtgccttaagggctacgcgggcaaccactgtgagacgaaatgtgtcgagccactgggcatggagaatgggaacattgccaactcacagatcgccgcctcatctgtgcgtgtgaccttcttgggtttgcagcattgggtcccggagctggcccgcctgaaccgcgcaggcatggtcaatgcctggacacccagcagcaatgacgataacccctggatccaggtgaacctgctgcggaggatgtgggtaacaggtgtggtgacgcagggtgccagccgcttggccagtcatgagtacctgaaggccttcaaggtggcctacagccttaatggacacgaattcgatttcatccatgatgttaataaaaaacacaaggagtttgtgggtaactggaacaaaaacgcggtgcatgtcaacctgtttgagacccctgtggaggctcagtacgtgagattgtaccccacgagctgccacacggcctgcactctgcgctttgagctactgggctgtgagctgaacggatgcgccaatcccctgggcctgaagaataacagcatccctgacaagcagatcacggcctccagcagctacaagacctggggcttgcatctcttcagctggaacccctcctatgcacggctggacaagcagggcaacttcaacgcctgggttgcggggagctacggtaacgatcagtggctgcaggtggacctgggctcctcgaaggaggtgacaggcatcatcacccagggggcccgtaactttggctctgtccagtttgtggcatcctacaaggttgcctacagtaatgacagtgcgaactggactgagtaccaggaccccaggactggcagcagtaagatcttccctggcaactgggacaaccactcccacaagaagaacttgtttgagacgcccatcctggctcgctatgtgcgcatcctgcctgtagcctggcacaaccgcatcgccctgcgcctggagctgctgggctgttagtggccacctgccacccccaggtcttcctgctttccatgggcccgctgcctcttggcttctcagcccctttaaatcaccatagggctggggactggggaaggggagggtgttcagaggcagcaccaccacacagtcacccctccctccctctttcccaccctccacctctcacgggccctgccccagcccctaagccccgtcccctaacccccagtcctcactgtcctgttttcttaggcactgagggatctgagtaggtctgggatggacaggaaagggcaaagtagggcgtgtggtttccctgcccctgtccggaccgccgatcccaggtgcgtgtgtctctgtctctcctagcccctctctcacacatcacattcccatggtggcctcaagaaaggcccggaagccccaggctggagataacagcctcttgcccgtcggccctgcgtcggccctggggtaccatgtgccacaactgctgtggccccctgtccccaagacacttccccttgtctccctggttgcctctcttgccccttgtcctgaagcccagcgacacagaagggggtggggcgggtctatggggagaaagggagcgaggtcagaggagccggcatgggttggcagggtgggcgtttggggccctcatgctggcttttcaccccagaggacacaggcagcttccaaaatatatttatcttcttcacggg

SEQ ID NO: 5531 - DNA, 510 bp, Homo sapiens
tgaggctgccttataaagcaccaagaggctgccagtgggacattttctcggccctgccagcccccaggaggaaggtgggtctgaatctagcaccatgacggaactagagacagccatgggcatgatcatagacgtcttttcccgatattcgggcagcgagggcagcacgcagaccctgaccaagggggagctcaaggtgctgatggagaaggagctaccaggcttcctgcagagtggaaaagacaaggatgccgtggataaattgctcaaggacctggacgccaatggagatgcccaggtggacttcagtgagttcatcgtgttcgtggctgcaatcacgtctgcctgtcacaagtactttgagaaggcaggactcaaatgatgccctggagatgtcacagattcctggcagagccatggtcccaggcttcccaaaagtgtttgttggcaattattcccctaggctgagcctgctcatgtacctctgattaataaatgcttatgaaatga

SEQ ID NO: 5532 - DNA, 5608 bp, Homo sapiens
aagacggattctcagacaaggcttgcaaatgccccgcagccatcatttaactgcacccgcagaatagttacggtttgtcacccgaccctcccggatcgcctaatttgtccctagtgagaccccgaggctctgcccgcgcctggcttcttcgtagctggatgcatatcgtgctccgggcagcgcgggcgcagggcacgcgttcgcgcacaccctagcacacatgaacacgcgcaagagctgaaccaagcacggtttccatttcaaaaagggagacagcctctaccgcgattgtagaagagactgtggtgtgaattagggaccgggaggcgtcgaacggaggaacggttcatcttagagactaattttctggagtttctgcccctgctctgcgtcagccctcacgtcacttcgccagcagtagcagaggcggcggcggcggctcccggaattgggttggagcaggagcctcgctggctgcttcgctcgcgctctacgcgctcagtccccggcggtagcaggagcctggacccaggcgccgccggcgggcgtgaggcgccggagcccggcctcgaggtgcataccggacccccattcgcatctaacaaggaatctgcgccccagagagtcccgggagcgccgccggtcggtgcccggcgcgccgggccatgcagcgacggccgccgcggagctccgagcagcggtagcgcccccctgtaaagcggttcgctatgccggggccactgtgaaccctgccgcctgccggaacactcttcgctccggaccagctcagcctctgataagctggactcggcacgcccgcaacaagcaccgaggagttaagagagccgcaagcgcagggaaggcctccccgcacgggtgggggaaagcggccggtgcagcgcggggacaggcactcgggctggcactggctgctagggatgtcgtcctggataaggtggcatggacccgccatggcgcggctctggggcttctgctggctggttgtgggcttctggagggccgctttcgcctgtcccacgtcctgcaaatgcagtgcctctcggatctggtgcagcgacccttctcctggcatcgtggcatttccgagattggagcctaacagtgtagatcctgagaacatcaccgaaattttcatcgcaaaccagaaaaggttagaaatcatcaacgaagatgatgttgaagcttatgtgggactgagaaatctgacaattgtggattctggattaaaatttgtggctcataaagcatttctgaaaaacagcaacctgcagcacatcaattttacccgaaacaaactgacgagtttgtctaggaaacatttccgtcaccttgacttgtctgaactgatcctggtgggcaatccatttacatgctcctgtgacattatgtggatcaagactctccaagaggctaaatccagtccagacactcaggatttgtactgcctgaatgaaagcagcaagaatattcccctggcaaacctgcagatacccaattgtggtttgccatctgcaaatctggccgcacctaacctcactgtggaggaaggaaagtctatcacattatcctgtagtgtggcaggtgatccggttcctaatatgtattgggatgttggtaacctggtttccaaacatatgaatgaaacaagccacacacagggctccttaaggataactaacatttcatccgatgacagtgggaagcagatctcttgtgtggcggaaaatcttgtaggagaagatcaagattctgtcaacctcactgtgcattttgcaccaactatcacatttctcgaatctccaacctcagaccaccactggtgcattccattcactgtgaaaggcaaccccaaaccagcgcttcagtggttctataacggggcaatattgaatgagtccaaatacatctgtactaaaatacatgttaccaatcacacggagtaccacggctgcctccagctggataatcccactcacatgaacaatggggactacactctaatagccaagaatgagtatgggaaggatgagaaacagatttctgctcacttcatgggctggcctggaattgacgatggtgcaaacccaaattatcctgatgtaatttatgaagattatggaactgcagcgaatgacatcggggacaccacgaacagaagtaatgaaatcccttccacagacgtcactgataaaaccggtcgggaacatctctcggtctatgctgtggtggtgattgcgtctgtggtgggattttgccttttggtaatgctgtttctgcttaagttggcaagacactccaagtttggcatgaaagatttctcatggtttggatttgggaaagtaaaatcaagacaaggtgttggcccagcctccgttatcagcaatgatgatgactctgccagcccactccatcacatctccaatgggagtaacactccatcttcttcggaaggtggcccagatgctgtcattattggaatgaccaagatccctgtcattgaaaatccccagtactttggcatcaccaacagtcagctcaagccagacacatttgttcagcacatcaagcgacataacattgttctgaaaagggagctaggcgaaggagcctttggaaaagtgttcctagctgaatgctataacctctgtcctgagcaggacaagatcttggtggcagtgaagaccctgaaggatgccagtgacaatgcacgcaaggacttccaccgtgaggccgagctcctgaccaacctccagcatgagcacatcgtcaagttctatggcgtctgcgtggagggcgaccccctcatcatggtctttgagtacatgaagcatggggacctcaacaagttcctcagggcacacggccctgatgccgtgctgatggctgagggcaacccgcccacggaactgacgcagtcgcagatgctgcatatagcccagcagatcgccgcgggcatggtctacctggcgtcccagcacttcgtgcaccgcgatttggccaccaggaactgcctggtcggggagaacttgctggtgaaaatcggggactttgggatgtcccgggacgtgtacagcactgactactacagggtcggtggccacacaatgctgcccattcgctggatgcctccagagagcatcatgtacaggaaattcacgacggaaagcgacgtctggagcctgggggtcgtgttgtgggagattttcacctatggcaaacagccctggtaccagctgtcaaacaatgaggtgatagagtgtatcactcagggccgagtcctgcagcgaccccgcacgtgcccccaggaggtgtatgagctgatgctggggtgctggcagcgagagccccacatgaggaagaacatcaagggcatccataccctccttcagaacttggccaaggcatctccggtctacctggacattctaggctagggcccttttccccagaccgatccttcccaacgtactcctcagacgggctgagaggatgaacatcttttaactgccgctggaggccaccaagctgctctccttcactctgacagtattaacatcaaagactccgagaagctctcgagggaagcagtgtgtacttcttcatccatagacacagtattgacttctttttggcattatctctttctctctttccatctcccttggttgttcctttttctttttttaaattttctttttcttttttttttcgtcttccctgcttcacgattcttaccctttcttttgaatcaatctggcttctgcattactattaactctgcatagacaaaggccttaacaaacgtaatttgttatatcagcagacactccagtttgcccaccacaactaacaatgccttgttgtattcctgcctttgatgtggatgaaaaaaagggaaaacaaatatttcacttaaactttgtcacttctgctgtacagatatcgagagtttctatggattcacttctatttatttattattattactgttcttattgtttttggatggcttaagcctgtgtataaaaaagaaaacttgtgttcaatctgtgaagcctttatctatgggagattaaaaccagagagaaagaagatttattatgaaccgcaatatgggaggaacaaagacaaccactgggatcagctggtgtcagtccctacttaggaaatactcagcaactgttagctgggaagaatgtattcggcaccttcccctgaggacctttctgaggagtaaaaagactactggcctctgtgccatggatgattcttttcccatcaccagaaatgatagcgtgcagtagagagcaaagatggcttccgtgagacacaagatggcgcatagtgtgctcggacacagttttgtcttcgtaggttgtgatgatagcactggtttgtttctcaagcgctatccacagaacctttgtcaacttcagttgaaaagaggtggattcatgtccagagctcatttcggggtcaggtgggaaagccaagaacttggaaaagataagacaagctataaattcggaggcaagtttcttttacaatgaacttttcagatctcacttccctccgacccctaacttccatgcccacccgtccttttaactgtgcaagcaaaattgtgcatggtcttcgtcgattaataccttgtgtgcagacactactgctccagacgtcgtttccctgataggtagagcagatccataaaaaggtatgacttatacaattaggggaagctaatggagtttattagctgagtatcaatgtctctgcgttgtacggtggtgatgggttttaatgaatatggaccctgaagcctggaaatcctcatccacgtcgaacccacaggactgtgggaagggcagaatcaatccctaagggaaaggaaacctcaccctgagggcatcacatgcactcatgttcagtgtacacaggtcaagtcccttgctctgggctctagttgggagagtggtttcattccaagtgtactccattgtcagtatgctgtttttgtttccttcactccattcaaaaagtcaaaatacaaaatttggcacagcatgccaacgggaggctgtgcccagaccaagcactggaagtgtgcttctaggcatagtcattggttttgcaaaaagagggctcaaatttaaatagaaatttacagctatttgaatggtcagatataccaagaaagaaaaatatttctgttcctcaagaaaacttgctaccctctgtgaggggaattttgctaaacttgacatctttataacatgagccagattgaaagggagtgattttcattcatcttaggtcatgttatttcatatttgtttctgaaggtgcgatagctctgttttaggttttgcttgcgcctgttaattactggaacaccttatttttcattaaaggctttgaaagccaattctcaaaaattcaaaagtgcaaattaacagaacaaaaggaaatccagtagcaactgcagtcaagcgagggagttgacaagataaaccttacgtccattcaagttatatgctggcctatgagagatgagagttgggtcgtttgttctctttgttgatgattt

SEQ ID NO: 5533 - DNA, 6405 bp, Homo sapiens
ggtttttgagcccattactgttggagctacagggagagaaacagaggaggagactgcaagagatcattggaggccgtgggcacgctctttactccatgtgtgggacattcattgcggaataacatcggaggagaagtttcccagagctatggggacttcccatccggcgttcctggtcttaggctgtcttctcacagggctgagcctaatcctctgccagctttcattaccctctatccttccaaatgaaaatgaaaaggttgtgcagctgaattcatccttttctctgagatgctttggggagagtgaagtgagctggcagtaccccatgtctgaagaagagagctccgatgtggaaatcagaaatgaagaaaacaacagcggcctttttgtgacggtcttggaagtgagcagtgcctcggcggcccacacagggttgtacacttgctattacaaccacactcagacagaagagaatgagcttgaaggcaggcacatttacatctatgtgccagacccagatgtagcctttgtacctctaggaatgacggattatttagtcatcgtggaggatgatgattctgccattataccttgtcgcacaactgatcccgagactcctgtaaccttacacaacagtgagggggtggtacctgcctcctacgacagcagacagggctttaatgggaccttcactgtagggccctatatctgtgaggccaccgtcaaaggaaagaagttccagaccatcccatttaatgtttatgctttaaaagcaacatcagagctggatctagaaatggaagctcttaaaaccgtgtataagtcaggggaaacgattgtggtcacctgtgctgtttttaacaatgaggtggttgaccttcaatggacttaccctggagaagtgaaaggcaaaggcatcacaatgctggaagaaatcaaagtcccatccatcaaattggtgtacactttgacggtccccgaggccacggtgaaagacagtggagattacgaatgtgctgcccgccaggctaccagggaggtcaaagaaatgaagaaagtcactatttctgtccatgagaaaggtttcattgaaatcaaacccaccttcagccagttggaagctgtcaacctgcatgaagtcaaacattttgttgtagaggtgcgggcctacccacctcccaggatatcctggctgaaaaacaatctgactctgattgaaaatctcactgagatcaccactgatgtggaaaagattcaggaaataaggtatcgaagcaaattaaagctgatccgtgctaaggaagaagacagtggccattatactattgtagctcaaaatgaagatgctgtgaagagctatacttttgaactgttaactcaagttccttcatccattctggacttggtcgatgatcaccatggctcaactgggggacagacggtgaggtgcacagctgaaggcacgccgcttcctgatattgagtggatgatatgcaaagatattaagaaatgtaataatgaaacttcctggactattttggccaacaatgtctcaaacatcatcacggagatccactcccgagacaggagtaccgtggagggccgtgtgactttcgccaaagtggaggagaccatcgccgtgcgatgcctggctaagaatctccttggagctgagaaccgagagctgaagctggtggctcccaccctgcgttctgaactcacggtggctgctgcagtcctggtgctgttggtgattgtgatcatctcacttattgtcctggttgtcatttggaaacagaaaccgaggtatgaaattcgctggagggtcattgaatcaatcagcccagatggacatgaatatatttatgtggacccgatgcagctgccttatgactcaagatgggagtttccaagagatggactagtgcttggtcgggtcttggggtctggagcgtttgggaaggtggttgaaggaacagcctatggattaagccggtcccaacctgtcatgaaagttgcagtgaagatgctaaaacccacggccagatccagtgaaaaacaagctctcatgtctgaactgaagataatgactcacctggggccacatttgaacattgtaaacttgctgggagcctgcaccaagtcaggccccatttacatcatcacagagtattgcttctatggagatttggtcaactatttgcataagaatagggatagcttcctgagccaccacccagagaagccaaagaaagagctggatatctttggattgaaccctgctgatgaaagcacacggagctatgttattttatcttttgaaaacaatggtgactacatggacatgaagcaggctgatactacacagtatgtccccatgctagaaaggaaagaggtttctaaatattccgacatccagagatcactctatgatcgtccagcctcatataagaagaaatctatgttagactcagaagtcaaaaacctcctttcagatgataactcagaaggccttactttattggatttgttgagcttcacctatcaagttgcccgaggaatggagtttttggcttcaaaaaattgtgtccaccgtgatctggctgctcgcaacgtcctcctggcacaaggaaaaattgtgaagatctgtgactttggcctggccagagacatcatgcatgattcgaactatgtgtcgaaaggcagtacctttctgcccgtgaagtggatggctcctgagagcatctttgacaacctctacaccacactgagtgatgtctggtcttatggcattctgctctgggagatcttttcccttggtggcaccccttaccccggcatgatggtggattctactttctacaataagatcaagagtgggtaccggatggccaagcctgaccacgctaccagtgaagtctacgagatcatggtgaaatgctggaacagtgagccggagaagagaccctccttttaccacctgagtgagattgtggagaatctgctgcctggacaatataaaaagagttatgaaaaaattcacctggacttcctgaagagtgaccatcctgctgtggcacgcatgcgtgtggactcagacaatgcatacattggtgtcacctacaaaaacgaggaagacaagctgaaggactgggagggtggtctggatgagcagagactgagcgctgacagtggctacatcattcctctgcctgacattgaccctgtccctgaggaggaggacctgggcaagaggaacagacacagctcgcagacctctgaagagagtgccattgagacgggttccagcagttccaccttcatcaagagagaggacgagaccattgaagacatcgacatgatggacgacatcggcatagactcttcagacctggtggaagacagcttcctgtaactggcggattcgaggggttccttccacttctggggccacctctggatcccgttcagaaaaccactttattgcaatgcggaggttgagaggaggacttggttgatgtttaaagagaagttcccagccaagggcctcggggagcgttctaaatatgaatgaatgggatattttgaaatgaactttgtcagtgttgcctcttgcaatgcctcagtagcatctcagtggtgtgtgaagtttggagatagatggataagggaataataggccacagaaggtgaactttgtgcttcaaggacattggtgagagtccaacagacacaatttatactgcgacagaacttcagcattgtaattatgtaaataactctaaccaaggctgtgtttagattgtattaactatcttctttggacttctgaagagaccactcaatccatccatgtacttccctcttgaaacctgatgtcagctgctgttgaactttttaaagaagtgcatgaaaaaccatttttgaaccttaaaaggtactggtactatagcattttgctatcttttttagtgttaaagagataaagaataataattaaccaaccttgtttaatagatttgggtcatttagaagcctgacaactcattttcatattgtaatctatgtttataatactactactgttatcagtaatgctaaatgtgtaataatgtaacatgatttccctccagagaaagcacaatttaaaacaatccttactaagtaggtgatgagtttgacagtttttgacatttatattaaataacatgtttctctataaagtatggtaatagctttagtgaattaaatttagttgagcatagagaacaaagtaaaagtagtgttgtccaggaagtcagaatttttaactgtactgaataggttccccaatccatcgtattaaaaaacaattaactgccctctgaaataatgggattagaaacaaacaaaactcttaagtcctaaaagttctcaatgtagaggcataaacctgtgctgaacataacttctcatgtatattacccaatggaaaatataatgatcagcaaaaagactggatttgcagaagttttttttttttttttcttcatgcctgatgaaagctttggcgaccccaatatatgtattttttgaatctatgaacctgaaaagggtcagaaggatgcccagacatcagcctccttctttcaccccttaccccaaagagaaagagtttgaaactcgagaccataaagatattctttagtggaggctggatgtgcattagcctggatcctcagttctcaaatgtgtgtggcagccaggatgactagatcctgggtttccatccttgagattctgaagtatgaagtctgagggaaaccagagtctgtatttttctaaactccctggctgttctgatcggccagttttcggaaacactgacttaggtttcaggaagttgccatgggaaacaaataatttgaactttggaacagggttggaattcaaccacgcaggaagcctactatttaaatccttggcttcaggttagtgacatttaatgccatctagctagcaattgcgaccttaatttaactttccagtcttagctgaggctgagaaagctaaagtttggttttgacaggttttccaaaagtaaagatgctacttcccactgtatgggggagattgaactttccccgtctcccgtcttctgcctcccactccataccccgccaaggaaaggcatgtacaaaaattatgcaattcagtgttccaagtctctgtgtaaccagctcagtgttttggtggaaaaaacattttaagttttactgataatttgaggttagatgggaggatgaattgtcacatctatccacactgtcaaacaggttggtgtgggttcattggcattctttgcaatactgcttaattgctgataccatatgaatgaaacatgggctgtgattactgcaatcactgtgctatcggcagatgatgctttggaagatgcagaagcaataataaagtacttgactacctactggtgtaatctcaatgcaagccccaactttcttatccaactttttcatagtaagtgcgaagactgagccagattggccaattaaaaacgaaaacctgactaggttctgtagagccaattagacttgaaatacgtttgtgtttctagaatcacagctcaagcattctgtttatcgctcactctcccttgtacagccttattttgttggtgctttgcattttgatattgctgtgagccttgcatgacatcatgaggccggatgaaacttctcagtccagcagtttccagtcctaacaaatgctcccacctgaatttgtatatgactgcatttgtgtgtgtgtgtgtgttttcagcaaattccagatttgtttccttttggcctcctgcaaagtctccagaagaaaatttgccaatctttcctactttctatttttatgatgacaatcaaagccggcctgagaaacactatttgtgactttttaaacgattagtgatgtccttaaaatgtggtctgccaatctgtacaaaatggtcctatttttgtgaagagggacataagataaaatgatgttatacatcaatatgtatatatgtatttctatatagacttggagaatactgccaaaacatttatgacaagctgtatcactgccttcgtttatatttttttaactgtgataatccccacaggcacattaactgttgcacttttgaatgtccaaaatttatattttagaaataataaaaagaaagatacttacatgttcccaaaacaatggtgtggtgaatgtgtgagaaaaactaacttgatagggtctaccaatacaaaatgtattacgaatgcccctgttcatgtttttgttttaaaacgtgtaaatgaagatctttatatttcaataaatgatatataatttaaagttaaaaaaaaaaaaaaa

SEQ ID NO: 5534 - DNA, 1135 bp, Homo sapiens
gggcagagggaataagaggctgcctctgcccaccagtcctgccgcccaggacccgcagcagagacgacgcctgcagcaaggagaccaggaaggggtgagacaaggaagaggatgtctgagctggagaaggccatggtggccctcatcgacgttttccaccaatattctggaagggagggagacaagcacaagctgaagaaatccgaactgaaggagctcatcaacaatgagctttcccatttcttagaggaaatcaaagagcaggaggttgtggacaaagtcatggaaacactggacaatgatggagacggcgaatgtgacttccaggaattcatggcctttgttgccatggttactactgcctgccacgagttctttgaacatgagtgagattagaaagcagccaaacctttcctgtaacagagacggtcatgcaagaaagcagacagcaagggcttgcagcctagtaggagctgagctttccagccgtgttgtagctaattaggaagcttgatttgctttgtgattgaaaaattgaaaacctctttccaaaggctgttttaacggcctgcatcattctttctgctatattaggcctgtgtgtaagctgactggccccagggactcttgttaacagtaacttaggagtcaggtctcagtgataaagcgtgcaccgtgcagcccgccatggccgtgtagaccctaacccggagggaaccctgactacagaaattaccccggggcacccttaaaacttccactacctttaaaaaacaaagccttatccagcattatttgaaaacactgctgttctttaaatgcgttcctcatccatgcagataacagctggttggccggtgtggccctgcaagggcgtggtggcttcggcctgcttcccgggatgcgcctgatcaccaggtgaacgctcagcgctggcagcgctcctggaaaaagcaactccatcagaactcgcaatccgagccagctctgggggctccagcgtggcctccgtgacccatgcgattcaagtcgcggctgcaggatccttgcctccaacgtgcctccagcacatgcggcttccgagggcactaccgggggctctgagccaccgcgagggcctgcgttcaataaaaag

SEQ ID NO: 5535 - DNA, 1645 bp, Homo sapiens
agtcaagatggaggagtacgcgcgagagccttgcccatggcgaattgtggatgactgtggtggggcctttacgatgggtaccattggtggtggtatctttcaagcaatcaaaggttttcgcaattctccagtgggagtaaaccacagactacgagggagtttgacagctattaaaaccagggctccacagttaggaggtagctttgcagtttggggagggctgttttccatgattgactgtagtatggttcaagtcagaggaaaggaagatccctggaactccatcacaagtggtgccttaacgggagccatactggcagcaagaaatggaccagtggccatggttgggtcagccgcaatgggtggcattctcctagctttaattgaaggagctggtatcttgttgacaagatttgcctctgcacagtttcccaatggtcctcagtttgcagaagacccctcccagttgccttcaactcagttaccttcctcaccttttggagactatcgacaatatcagtaggacttctttcctaggatttctttaacagaacgagttgtggttcgagaaggatttcagaagatcaagttacagtctgtttttaaaaccataggtgggacagctatggccaataggctataaagagacatttagcacttttttctatttaaaggaacaagcggggaagggtgctaaaagataatacgtttatttattcacacttgaattgcatttgtgatcaaaataaatgtttaaatcgctaaaggaaaatacagtaagtgcttgaaagatgaaggaccaaaaggccaaaaaacagtgaaatatgatcatcatctcttgcggacttctctgcctggttttgtgtgttctgttattcaaacaataaaaagctggtggaacttactctttcttttaagataagttgtagacttcgatgtttcatgctcatgtacttcaaataatgcatgttttatagttagtccctcatcacttgaagtgacttctgagaattatgcagagtcaacatggatcatttcacagtgagatgctttatggattgaaggatatggtaaaatgtttatagtttactttgaaagtaaaatatactatgtcttggttttgaggatattggatacaaaactctcttcctttagggctactgagtcttgattcctgatcatcagaaatttcaccagaaacaacttgcttccaatatacccaattctatatgaagaattcatggagagtgtactggcactggaagagtttagtgtttcttgtatgcttgaaaataaagtatgtactgttttgaatgtgttccaagtcctctgcataaacgatgtattttggggtctggttgggcctggaaaatggatgagcacttcagaacaggtcattttcctgatattggaagtgacatgtggccctataggaggcatgatgttagttaattacacatttgcctacatctgtgggaaatggagaacaaagccatgtgggtactgtaaacacacgtttatcttttggcccaatgccatacatatggtaggcatttaattactgattgtgtttggataatttgggaattttcgactgtggtaaaatatacataaaataatacttattaaaaaaaaaaaaaaaaaa

SEQ ID NO: 5536 - DNA, 3632 bp, Homo sapiens
actcactgcccgggccgcccggacagggagcttcgctggcgcgcttggccggcgacaggacaggttcgggacgtccatctgtccatccgtccggagagaaattacagatccgcagccccgggatggggccggccccgctgccgctgctgctgggcctcttcctccccgcgctctggcgtagagctatcactgaggcaagggaagaagccaagccttacccgctattcccgggaccttttccagggagcctgcaaactgaccacacaccgctgttatcccttcctcacgccagtgggtaccagcctgccttgatgttttcaccaacccagcctggaagaccacatacaggaaacgtagccattccccaggtgacctctgtcgaatcaaagcccctaccgcctcttgccttcaaacacacagttggacacataatactttctgaacataaaggtgtcaaatttaattgctcaatcagtgtacctaatatataccaggacaccacaatttcttggtggaaagatgggaaggaattgcttggggcacatcatgcaattacacagttttatccagatgatgaagttacagcaataatcgcttccttcagcataaccagtgtgcagcgttcagacaatgggtcgtatatctgtaagatgaaaataaacaatgaagagatcgtgtctgatcccatctacatcgaagtacaaggacttcctcactttactaagcagcctgagagcatgaatgtcaccagaaacacagccttcaacctcacctgtcaggctgtgggcccgcctgagcccgtcaacattttctgggttcaaaacagtagccgtgttaacgaacagcctgaaaaatccccctccgtgctaactgttccaggcctgacggagatggcggtcttcagttgtgaggcccacaatgacaaagggctgaccgtgtccaagggagtgcagatcaacatcaaagcaattccctccccaccaactgaagtcagcatccgtaacagcactgcacacagcattctgatctcctgggttcctggttttgatggatactccccgttcaggaattgcagcattcaggtcaaggaagctgatccgctgagtaatggctcagtcatgatttttaacacctctgccttaccacatctgtaccaaatcaagcagctgcaagccctggctaattacagcattggtgtttcctgcatgaatgaaataggctggtctgcagtgagcccttggattctagccagcacgactgaaggagccccatcagtagcacctttaaatgtcactgtgtttctgaatgaatctagtgataatgtggacatcagatggatgaagcctccgactaagcagcaggatggagaactggtgggctaccggatatcccacgtgtggcagagtgcagggatttccaaagagctcttggaggaagttggccagaatggcagccgagctcggatctctgttcaagtccacaatgctacgtgcacagtgaggattgcagccgtcaccagagggggagttgggcccttcagtgatccagtgaaaatatttatccctgcacacggttgggtagattatgccccctcttcaactccggcgcctggcaacgcagatcctgtgctcatcatctttggctgcttttgtggatttattttgattgggttgattttatacatctccttggccatcagaaaaagagtccaggagacaaagtttgggaatgcattcacagaggaggattctgaattagtggtgaattatatagcaaagaaatccttctgtcggcgagccattgaacttaccttacatagcttgggagtcagtgaggaactacaaaataaactagaagatgttgtgattgacaggaatcttctaattcttggaaaaattctgggtgaaggagagtttgggtctgtaatggaaggaaatcttaagcaggaagatgggacctctctgaaagtggcagtgaagaccatgaagttggacaactcttcacagcgggagatcgaggagtttctcagtgaggcagcgtgcatgaaagacttcagccacccaaatgtcattcgacttctaggtgtgtgtatagaaatgagctctcaaggcatcccaaagcccatggtaattttacccttcatgaaatacggggacctgcatacttacttactttattcccgattggagacaggaccaaagcatattcctctgcagacactattgaagttcatggtggatattgccctgggaatggagtatctgagcaacaggaattttcttcatcgagatttagctgctcgaaactgcatgttgcgagatgacatgactgtctgtgttgcggacttcggcctctctaagaagatttacagtggcgattattaccgccaaggccgcattgctaagatgcctgttaaatggatcgccatagaaagtcttgcagaccgagtctacacaagtaaaagtgatgtgtgggcatttggcgtgaccatgtgggaaatagctacgcggggaatgactccctatcctggggtccagaaccatgagatgtatgactatcttctccatggccacaggttgaagcagcccgaagactgcctggatgaactgtatgaaataatgtactcttgctggagaaccgatcccttagaccgccccaccttttcagtattgaggctgcagctagaaaaactcttagaaagtttgcctgacgttcggaaccaagcagacgttatttacgtcaatacacagttgctggagagctctgagggcctggcccagggctccacccttgctccactggacttgaacatcgaccctgactctataattgcctcctgcactccccgcgctgccatcagtgtggtcacagcagaagttcatgacagcaaacctcatgaaggacggtacatcctgaatgggggcagtgaggaatgggaagatctgacttctgccccctctgctgcagtcacagctgaaaagaacagtgttttaccgggggagagacttgttaggaatggggtctcctggtcccattcgagcatgctgcccttgggaagctcattgcccgatgaacttttgtttgctgacgactcctcagaaggctcagaagtcctgatgtgaggagaggtgcggggagacattccaaaaatcaagccaattcttctgctgtaggagaatccaattgtacctgatgtttttggtatttgtcttccttaccaagtgaactccatggccccaaagcaccagatgaatgttgttaagtaagctgtcattaaaaatacataatatatatttatttaaagagaaaaaatatgtgtatatcatggaaaaagacaaggatattttaataaaacattacttatttcatttcacttatcttgcatatcttaaaattaagcttcagctgctccttgatattaacatttgtacagagttgaagttgttttttcaagttcttttctttttcatgactattaaatgtaaaaatatttgtaaaatgaaatgccatatttgacttggcttctggtcttgatgtatttgataagaatgattcattcaatgtttaaagttgtataactgattaattttctgatatggcttcctaataaaatatgaataaggaagaaaaaa

SEQ ID NO: 5537 - DNA, 2061 bp, Homo sapiens
tgttccgcgatcttctcaggctctcctagcagcatccatcgccgccaccctatcttcactggcttcaccttctccttctctcttcgttgctgagcgacaagcttcctagcgctatgactgtcgtctccgtcccgcagcgggagccgctcgtcctgggtggccgccttgcgccgcttggcttttcctcccgaggttactttggggccctcccgatggtgaccacggctccgcctcctttaccccggatcccggacccccgggcactgcccccgaccctcttcctccctcatttcctagggggagatggcccgtgtctgaccccccagcctcgcgctccagcagctctgcccaaccgcagcctcgccgtggcgggaggcactcctcgggcagcgccgaagaagcggcgaaagaagaaggtgcgggccagccccgcagggcagctgcccagccgcttccaccagtaccagcagcaccggccgagtctggagggcggccggagccccgcgaccggcccgagcggagcgcaggaggtcccgggcccggccgccgccttggccccgagtcctgcagccgcagccggcacggagggagccagccccgaccttgccccgctgcggcccgcggctcccggccaaacccccctcaggaaagaggttttaaaatcaaagatgggaaaatcggagaaaattgcccttccccatggccagcttgttcatggtatacacttgtatgagcaaccaaagataaacagacagaaaagcaaatataacttgccactaaccaagatcacctctgcaaaaagaaatgaaaacaacttttggcaggattctgtttcatctgacagaattcagaagcaggaaaaaaagccttttaaaaataccgagaacattaaaaattcgcatttgaagaaatcagcatttctaactgaagtgagccaaaaggaaaattatgctggggcaaagtttagtgatccaccttctcctagtgttcttccaaagcctcctagtcactggatgggaagcactgttgaaaattccaaccaaaacagggagctgatggcagtacacttaaaaaccctcctcaaagttcaaacttagatttcagatttcagtatgtgtgtaaaacataatttttcccatatccctggactcttgagaaaattggtacagaaatggaaatttgccttgttgcaacatacaattgcaaaagatgagtttaaaaaattacatacaaacagcttgtattatattttatattttgtaaatactgtataccatgtattatgtgtatattgttcatacttgagaggtatattatagttttgttatgaaagtatgtattttgccctgcccacattgcaggtgttttgtatatatacaatggataaattttaagtgtgtgctaaggcacatggaagaccgattttatttgcacaaggtactgagatttttttcaagaaacagctgtcaaatctcaaggtgaagatctaaatgtgaacagtttactaatgcactactgaagtttaaatctgtggcacaatcaatgtaagcatggggtttgtttctctaaattgatttgtaatctgaaattactgaacaactcctattcccatttttgctaaactcaatttctggttttggtatatatccattccagcttaatgcctctaattttaatgccaacaaaattggttgtaatcaaattttaaaataataataatttggcccccccttttaaaatagtcttgactctttgtgtgtgactgtttctcatgtttgaatgtgtgactaggagatgattttgtgtggttggatttttttgacttctactttactggctgagtgtgagccgccatgcctggccataatctacattttcttaccaggagcagcattgaggtttttgagcatagtacttgactactctagaggctgagacgggagcatctcttgagcctgagaagtggagattgcaattgagctaggatcaggccactgcactccagcctgggtaacagacgctgtctcaaaaaaaaggccaagagaaagtaagggagacaga

SEQ ID NO: 5538 - DNA, 2018 bp, Homo sapiens
gtgctgcggcgagctccgtccaaaagaaaatggggtttggtgtaaatctgggggtgtaatgttatcatatatcactctacctcgtaaaaccgacactgaaagctgccggacaacaaatcacaggtcaaaattatgagttcttcgtattatgtgaacgcgctttttagcaaatatacggcgggggcttctctgttccaaaatgccgagccgacttcttgctcctttgctcccaactcacagagaagcggctacggggcgggcgccggcgccttcgcctcgaccgttccgggcttatacaatgtcaacagccccctttatcagagcccctttgcgtccggctacggcctgggcgccgacgcctacggcaacctgccctgcgcctcctacgaccaaaacatccccgggctctgcagtgacctcgccaaaggcgcctgcgacaagacggacgagggcgcgctgcatggcgcggctgaggccaatttccgcatctacccctggatgcggtcttcaggacctgacaggaagcggggccgccagacctacacgcgctaccagacgctggagctggagaaggagttccacttcaaccgctacctgacgcggcgccgccgcattgaaatcgcccacgcgctctgcctcaccgagcgccagattaagatctggttccagaaccgccgcatgaagtggaagaaagagcataaggacgaaggtccgactgccgccgcagctcccgagggcgccgtgccctctgccgccgccactgctgccgcggacaaggccgacgaggaggacgatgatgaagaagaggaagacgaggaggaatgaggggccgatccggggccctctctgcaccggacagtcggaaaagcgtctttaagagactcactggttttacttacaaaaatgggaaaaataaaagaaaatgtaaaaaacaaaaacaaaaacaaaaaagcaacccagtccccaacctgcactctacccacccccatcacctactccagctcccaacttttgtggactgagcggccgcagagactgggtcgccttggattccctctgcctccgaggaccccaaaagacacccccaaccccaggccagccggccctgctctggcgcgtccaaaatactacctagcacaggcctctgctcgaggcacccccaaactacctatgtatccagccccagagggcctccattcccaggaagtccctatgtatcccaacactggcagacacccagcaccaccctcccagacccgcaagaaagtgaatctcactactacctactcccctaaaactacctattttgtgctggctggcttgcctgctacctagtgccgactgctcccaggcaagtcccctgctgcttacagcccgcagcttttggggtccctgaggctgccctgagaatgtgctgaggtccaggatcagggtattggcatctatttaaatcgaaaaataatatatttattccaaaaagcatcctaagtgcttgcaccctagaatcaatccctccttctctggcttggcacccacagctcaggcccatcaacccccacttctggaggggaatgttcctgagctggctgcagatctgtgggttagcttctgcttagcaggactgtggagatgcttccagcttcgctgtcctttcctctggctcctgtatcttactgttcagctgtgttaaatatgtacgccctgatgtttcctataatagcagatactgtatatttgaacaagatttttttttatcatttctatagtcttggagttcatttgtaaggcagtgtcttgacttggaaaggatgtgttaatggggtgactttgtagcatggtatgttgtcttgagttaactgtagtgggtggggaggtccaatgccctccgcaatgcccttcatctcctgtgttgtcctgtaccctgctcagctccatcctggggttcagggaaggcacacttcccagcccagctgtgttttatgtaaccgaaaataaagatgcgtggtgacaaagaaaaa

SEQ ID NO: 5539 - DNA, 4749 bp, Homo sapiens
acagagcgtgttgttagagctgtgctgagcgggtgtttgggttgttggctgctttcttccccctttctcacacacttgtatattattttgaggtggtgttcgcagagtttgaaaggagagagaattaaaaaaaaaagccgcaagcgtttcactcttttatttttataatccccttcaatttggggttaaaaaaaagacaagaaaacaggaaggaagagaaataaggaaatgagatgtggtaaaagaagctaaaaggtgccttttaaaagatcgttgctgtgaagtgaaaaaaatctccagagaaaccaaaaagcaccgccgagacctcttccgaaccaaaggagtttgtgtttgcttttagggaagaagaaagatcattcattcggaggaataacaaccaattaaaagacaaataaaaaaagtttggagtgggacgcagagcgagcgagaggagctgccggcgggcggtggggcgcggagcccgcactttcccggccgggtgagcggcggccgcggcgccgggctcggcgggtgcgcctcggcggagcgaacgtcggagcgttgccttgggagacgcgcgccggacaatgcccgcggcgggccagtgacgcccgcggggaatgcggagcggcccggcagccggcacccagccgccgccgcgcgttcctgccgcccgtgtcacgcgagacccggcgggggccgggaccgcccgagccgcccctcagaccgagccggccgcctccgctgccgcggccgcctcctcttcggggtcattaaagccaatgagccgcgcgcctctgccgagcgcagccaactaaatcggcttggatgattcgcgacctgagcaagatgtacccgcagaccagacacccggcaccgcatcagcctgctcaaccctttaaatttacaatttccgaatcctgtgatcggattaaggaagagtttcagtttttacaggctcaataccacagtctgaagctggaatgtgagaaactcgccagtgagaagacagagatgcagcggcattatgtcatgtattatgaaatgtcctatgggttgaatatagaaatgcacaagcaggcagagattgtcaagaggctgaatgctatctgtgcacaagtcattcctttcctgtcccaagagcaccagcaacaagtggtgcaggctgtggaacgggccaagcaggtgaccatggcagaactgaacgccatcattgggcaacaactccaggcccagcatttatcacatggacatggtctccccgtacctctgactccacacccttcagggctccagccccctgccattccacccatcggtagcagtgccgggcttctggccctctccagtgctctaggaggtcagtcccatcttccaattaaagatgagaagaagcaccatgacaatgatcaccaaagagacagagactccatcaagagctcttcagtatccccatcagccagtttccgaggtgctgagaagcacagaaactccgcagactactcctcagagagcaaaaagcagaaaactgaagaaaaggaaattgcagctcgttatgacagcgatggtgagaaaagtgatgacaacttggtggttgacgtttccaatgaggatccatcttcccctcgagggagcccagcacattcccccagagagaatggcctagacaagacacgcctgctcaagaaagatgccccgattagtccagcctctattgcatcttccagcagtactccctcctccaaatccaaagaacttagccttaatgaaaaatctactactcccgtctcaaagtccaatacccctactccacgaactgatgcgcccaccccaggcagtaactctactcccggattgaggcctgtacctggaaaaccaccaggagttgaccctttggcctcaagcctaaggaccccaatggcagtaccttgtccatatccaactccatttgggattgtgccccatgctggaatgaacggagagctgaccagccccggagcggcctacgctgggctccacaacatctcccctcagatgagcgcagctgctgccgccgccgctgctgctgctgcctatgggagatcaccagtggtgggatttgatccacaccatcacatgcgtgtgccagcaatacctccaaacctgacaggcattccaggaggaaaaccagcatactccttccatgttagcgcagatggtcagatgcagcctgtcccttttccacccgacgccctcatcggacctggaatcccccggcatgctcgccagatcaacaccctcaaccacggggaggtggtgtgcgcggtgaccatcagcaaccccacgagacacgtgtacacgggtgggaagggctgcgtcaaggtctgggacatcagccacccaggcaataagagtcctgtctcccagctcgactgtctgaacagggataactacatccgttcctgcagattgctccctgatggtcgcaccctaattgttggaggggaagccagtactttgtccatttgggacctggcggctccaaccccacgcatcaaggcagagctgacatcctcggcccccgcctgctatgccctggccatcagccccgattccaaggtctgcttctcatgctgcagcgacggcaacatcgctgtgtgggatctgcacaaccagaccttggtgaggcaattccagggccacacagatggagccagctgtattgacatttctaatgatggcaccaagctctggacaggtggtttggacaacacggtcaggtcctgggacctgcgcgaggggcggcagctgcagcagcacgacttcacctcccagatcttttctctgggctactgcccaactggagagtggcttgcagtggggatggagaacagcaatgtggaagttttgcatgtcaccaagccagacaaataccaactacatcttcatgagagctgtgtgctgtcgctcaagtttgcccattgtggcaaatggtttgtaagcactggaaaggacaaccttctgaatgcctggagaacaccttatggggccagtatattccagtccaaagaatcctcatcggtgcttagctgtgacatctccgtggacgacaaatacattgtcactggctctggggataagaaggccacagtttatgaagttatttattaaagacaaatcttcatgcagactggacttctcctcctggtagcactttgctctgtcatcctttttgttcacccccatccccgcatctaaaaccaaggatttcagatactcattgcagttgtggagtttaatcccctttcttaacctcacttcccacttgctattgaattgtgaatagtcattaaaaacctgtgataccaaatcttcagctgtctacttggaagaacatggaataagcatacttaacagtgaaaagaatctttaattatgtattatatctgtaatatatttattttgtttaaagaaggctttctaacaatgactgactaaataaagctgtctgctcctgcattgataatgaaggtgcgttgtatttgatacccctccccccctttttttggcaaaggaggggaaaggaaggtttaaaataattgatttaaaatgtcactaagtgtagactgatgactgtatagagatgtgaaatgtataattacacatggaagcaatatgttgctgtgttgttattaggttttttttgtttttgttttctacatcttttaaagacttttggaaatttggctgaacaattagaacacaacaggccaactcatactcatttggatctatttagacaacgttaaccaatatatctatagctttagattatattcgataaaagtaattggactttttttctttttttgactcgttgacaagtgtctttgtaatatgtttttagttccctttttttgttgtattataggcagatgaacaaattaaatttggcctcaaagagagaacttactcccttctggatatttttgccacatttctttgcaaaaggagatatatatatctttagtcagttttgttgttatgagaaattatgggttattttgtggcatgctctttgggagctgcacagttatggggaggactcccactgctgtgcaagttaagtcttttacaaaacaaggacagcagaggagggtttgcagagacctccctctgaaaaacacaaagaatggactctctcctgggatgaggacttgctttctttacctccggttctttccatgtcttagttggatgtccctgaaatggacacaggctgtgccattgtgccagaaacattgtgttatcttttatgttgttgttgttgctgttaaactataatatgtgacttctttttttattattttttgtttgaatgctttaaaaatcttttaagtctgtggatctgctgatgtacagtgcctttgctgctatggatcaaaatcaaaagaaccgtgtagatatactttattgtataagtagaaaattacttaatttcatactagaaatggatggatgctgcaagttgaaatggactgtccattgacgttcctaatgtggtagcagaaaaaaaaaaatggtgtcttaagtgcttagtgtttgatgtcattaacagtttcgtaaaactctacagtgtagaaagattttgatactaaactgtgcgttgtacatagttctaatgcattgtattgaccaccagtacttctataatggtagattgtttgtgaattcagacttttaagcattaaacataaataacttctagaa

SEQ ID NO: 5540 - DNA, 12436 bp, Homo sapiens
gtattgatgtcaagctgaaccatcgtaggaagttgaaagccttagaaagaggacttggtaaagtttttggattatcttgaaactctggcaagatggccaagtatggagaacatgaagccagtcctgacaatgggcagaacgaattcagtgatatcattaagtccagatctgatgaacacaatgacgtacagaagaaaacctttaccaaatggataaatgctcgattttcaaagagtgggaaaccacccatcaatgatatgttcacagacctcaaagatggaaggaagctattggatcttctagaaggcctcacaggaacatcactgccaaaggaacgtggttccacaagggtacatgccttaaataacgtcaacagagtgctgcaggttttacatcagaacaatgtggaattagtgaatatagggggaactgacattgtggatggaaatcacaaactgactttggggttactttggagcatcattttgcactggcaggtgaaagatgtcatgaaggatgtcatgtcggacctgcagcagacgaacagtgagaagatcctgctcagctgggtgcgtcagaccaccaggccctacagccaagtcaacgtcctcaacttcaccaccagctggacagatggactcgcctttaatgctgtcctccaccgacataaacctgatctcttcagctgggataaagttgtcaaaatgtcaccaattgagagacttgaacatgccttcagcaaggctcaaacttatttgggaattgaaaagctgttagatcctgaagatgttgccgttcagcttcctgacaagaaatccataattatgtatttaacatctttgtttgaggtgctacctcagcaagtcaccatagacgccatccgtgaggtagagacactcccaaggaaatataaaaaagaatgtgaagaagaggcaattaatatacagagtacagcgcctgaggaggagcatgagagtccccgagctgaaactcccagcactgtcactgaggttgacatggatctggacagctatcagattgcgttggaggaagtgctgacctggttgctttctgctgaggacactttccaggagcaggatgatatttctgatgatgttgaagaagtcaaagaccagtttgcaacccatgaagcttttatgatggaactgactgcacaccagagcagtgtgggcagcgtcctgcaggcaggcaaccaactgataacacaaggaactctgtcagacgaagaagaatttgagattcaggaacagatgaccctgctgaatgctagatgggaggctcttagggtggagagtatggacagacagtcccggctgcacgatgtgctgatggaactgcagaagaagcaactgcagcagctctccgcctggttaacactcacagaggagcgcattcagaagatggaaacttgccccctggatgatgatgtaaaatctctacaaaagctgctagaagaacataaaagtttgcaaagtgatcttgaggctgaacaggtgaaagtaaattcactaactcacatggtggtcattgttgatgaaaacagtggtgagagtgctacagctatcctagaagaccagttacagaaacttggtgagcgctggacagcagtatgccgttggactgaagaacgctggaataggttacaagaaatcaatatattgtggcaggaattattggaagaacagtgcttgttgaaagcttggttaaccgaaaaagaagaggctttaaataaagtccagacaagcaacttcaaagaccaaaaggaactaagtgtcagtgttcgacgtctggctattttgaaggaagacatggaaatgaagcgtcaaacattggatcagctgagtgagattggccaggatgtgggacaattacttgataattccaaggcatctaagaagatcaacagtgactcagaggaactgactcaaagatgggattctttggttcagagactagaagattcctccaaccaggtgactcaggctgtagcaaagctggggatgtctcagattcctcagaaggaccttttggagactgttcgtgtaagagaacaagcaattacaaaaaaatctaagcaggaactgcctcctcctcctcccccaaagaagagacagatccatgtggatattgaagctaagaaaaagtttgatgctataagtgcagagctgttgaactggattttgaaatggaaaactgccattcagaccacagagataaaagagtatatgaagatgcaagacacttccgaaatgaaaaagaagttgaaggcattagaaaaagaacagagagaaagaatccccagagcagatgaattaaaccaaactggacaaatccttgtggagcaaatgggaaaagaaggccttcctactgaagaaataaaaaatgttctggagaaggtttcatcagaatggaagaatgtatctcaacatttggaagatctagaaagaaagattcagctacaggaagatataaatgcttatttcaagcagcttgatgagcttgaaaaggtcatcaagacaaaggaggagtgggtaaaacacacttccatttctgaatcttcccggcagtccttgccaagcttgaaggattcctgtcagcgggaattgacaaatcttcttggccttcaccccaaaattgaaatggctcgtgcaagctgctcggccctgatgtctcagccttctgccccagattttgtccagcggggcttcgatagctttctgggccgctaccaagctgtacaagaggctgtagaggatcgtcaacaacatctagagaatgaactgaagggccaacctggacatgcatatctggaaacattgaaaacactgaaagatgtgctaaatgattcagaaaataaggcccaggtgtctctgaatgtccttaatgatcttgccaaggtggagaaggccctgcaagaaaaaaagacccttgatgaaatccttgagaatcagaaacctgcattacataaacttgcagaagaaacaaaggctctggagaaaaatgttcatcctgatgtagaaaaattatataagcaagaatttgatgatgtgcaaggaaagtggaacaagctaaaggtcttggtttccaaagatctacatttgcttgaggaaattgctctcacactcagagcttttgaggccgattcaacagtcattgagaagtggatggatggcgtgaaagacttcttaatgaaacagcaggctgcccaaggagacgacgcaggtctacagaggcagttagaccagtgctctgcatttgttaatgaaatagaaacaattgaatcatctctgaaaaacatgaaggaaatagagactaatcttcgaagtggtccagttgctggaataaaaacttgggtgcagacaagactaggtgactaccaaactcaactggagaaacttagcaaggagatcgctactcaaaaaagtaggttgtctgaaagtcaagaaaaagctgcgaacctgaagaaagacttggcagagatgcaggaatggatgacccaggccgaggaagaatatttggagcgggattttgagtacaagtcaccagaagagcttgagagtgctgtggaagagatgaagagggcaaaagaggatgtgttgcagaaggaggtgagagtgaagattctcaaggacaacatcaagttattagctgccaaggtgccctctggtggccaggagttgacgtctgagctgaatgttgtgctggagaattaccaacttctttgtaatagaattcgaggaaagtgccacacgctagaggaggtctggtcttgttggattgaactgcttcactatttggatcttgaaactacctggttaaacactttggaagagcggatgaagagcacagaggtcctgcctgagaagacggatgctgtcaacgaagccctggagtctctggaatctgttctgcgccacccggcagataatcgcacccagattcgagagcttggccagactctgattgatggggggatcctggatgatataatcagtgagaaactggaggctttcaacagccgatatgaagatctaagtcacctggcagagagcaagcagatttctttggaaaagcaactccaggtgctgcgggaaactgaccagatgcttcaagtcttgcaagagagcttgggggagctggacaaacagctcaccacatacctgactgacaggatagatgctttccaagttccacaggaagctcagaaaatccaagcagagatctcagcccatgagctaaccctagaggagttgagaagaaatatgcgttctcagcccctgacctccccagagagtaggactgccagaggaggaagtcagatggatgtgctacagaggaaactccgagaggtgtccacaaagttccagcttttccagaagccagctaacttcgagcagcgcatgctggactgcaagcgtgtgctggatggcgtgaaagcagaacttcacgttctggatgtgaaggacgtagaccctgacgtcatacagacgcacctggacaagtgtatgaaactgtataaaactttgagtgaagtcaaacttgaagtggaaactgtgattaaaacaggaagacatattgtccagaaacagcaaacggacaacccaaaagggatggatgagcagctgacttccctgaaggttctttacaatgacctgggcgcacaggtgacagaaggaaaacaggatctggaaagagcatcacagttggcccggaaaatgaagaaagaggctgcttctctctctgaatggctttctgctactgaaactgaattggtacagaagtccacttcagaaggtctgcttggtgacttggatacagaaatttcctgggctaaaaatgttctgaaggatctggaaaagagaaaagctgatttaaataccatcacagagagtagtgctgccctgcaaaacttgattgagggcagtgagcctattttagaagagaggctctgcgtccttaacgctgggtggagccgagttcgtacctggactgaagattggtgcaataccttgatgaaccatcagaaccagctagaaatatttgatgggaacgtggctcacataagtacctggctttatcaagctgaagctctattggatgaaattgaaaagaaaccaacaagtaaacaggaagaaattgtgaagcgtttagtatctgagctggatgatgccaacctccaggttgaaaatgtccgcgatcaagcccttattttgatgaatgcccgtggaagctcaagcagggagcttgtagaaccaaagttagctgagctgaataggaactttgaaaaggtgtctcaacatatcaaaagtgccaaattgctaattgctcaggaaccattataccaatgtttggtcaccactgaaacatttgaaactggtgtgcctttctctgacttggaaaaattagaaaatgacatagaaaatatgttaaaatttgtggaaaaacacttggaatccagtgatgaagatgaaaagatggatgaggagagtgcccagattgaggaagttctacaaagaggagaagaaatgttacatcaacctatggaagataataaaaaagaaaagatccgtttgcaattattacttttgcatactagatacaacaaaattaaggcaatccctattcaacagaggaaaatgggtcaacttgcttctggaattagatcatcacttcttcctacagattatctggttgaaattaacaaaattttactttgcatggatgatgttgaattatcgcttaatgttccagagctcaacactgctatttacgaagacttctcttttcaggaagactctctgaagaatatcaaagaccaactggacaaacttggagagcagattgcagtcattcatgaaaaacagccagatgtcatccttgaagcctctggacctgaagccattcagatcagagatacacttactcagctgaatgcaaaatgggacagaattaatagaatgtacagtgatcggaaaggttgttttgacagggcaatggaagaatggagacagttccattgtgaccttaatgacctcacacagtggataacagaggctgaagaattactggttgatacctgtgctccaggtggcagcctggacttagagaaagccaggatacatcagcaggaacttgaggtgggcatcagcagccaccagcccagttttgcagcactaaaccgaactggggatgggattgtgcagaaactctcccaggcagatggaagcttcttgaaagaaaaactggcaggtttaaaccaacgctgggatgcaattgttgcagaagtgaaggataggcagccaaggctaaaaggagaaagtaagcaggtgatgaagtacaggcatcagctagatgagattatctgttggttaacaaaggctgagcatgctatgcaaaagagatcaaccaccgaattgggagaaaacctgcaagaattaagagacttaactcaagaaatggaagtacatgctgaaaaactcaaatggctgaatagaactgaattggagatgctttcagataaaagtctgagtttacctgaaagggataaaatttcagaaagcttaaggactgtaaatatgacatggaataagatttgcagagaggtgcctaccaccctgaaggaatgcatccaggagcccagttctgtttcacagacaaggattgctgctcatcctaatgtccaaaaggtggtgctagtatcatctgcgtcagatattcctgttcagtctcatcgtacttcggaaatttcaattcctgctgatcttgataaaactataacagaactagccgactggctggtattaatcgaccagatgctgaagtccaacattgtcactgttggggatgtagaagagatcaataagaccgtttcccgaatgaaaattacaaaggctgacttagaacagcgccatcctcagctggattatgtttttacattggcacagaatttgaaaaataaagcttccagttcagatatgagaacagcaattacagaaaaattggaaagggtcaagaaccagtgggatggcacccagcatggcgttgagctaagacagcagcagcttgaggacatgattattgacagtcttcagtgggatgaccatagggaggagactgaagaactgatgagaaaatatgaggctcgactctatattcttcagcaagcccgacgggatccactcaccaaacaaatttctgataaccaaatactgcttcaagaactgggtcctggagatggtatcgtcatggcgttcgataacgtcctgcagaaactcctggaggaatatgggagtgatgacacaaggaatgtgaaagaaaccacagagtacttaaaaacatcatggatcaatctcaaacaaagtattgctgacagacagaacgccttggaggctgagtggaggacggtgcaggcctctcgcagagatctggaaaacttcctgaagtggatccaagaagcagagaccacagtgaatgtgcttgtggatgcctctcatcgggagaatgctcttcaggatagtatcttggccagggaactcaaacagcagatgcaggacatccaggcagaaattgatgcccacaatgacatatttaaaagcattgacggaaacaggcagaagatggtaaaagctttgggaaattctgaagaggctactatgcttcaacatcgactggatgatatgaaccaaagatggaatgacttaaaagcaaaatctgctagcatcagggcccatttggaggccagcgctgagaagtggaacaggttgctgatgtccttagaagaactgatcaaatggctgaatatgaaagatgaagagcttaagaaacaaatgcctattggaggagatgttccagccttacagctccagtatgaccattgtaaggccctgagacgggagttaaaggagaaagaatattctgtcctgaatgctgtcgaccaggcccgagttttcttggctgatcagccaattgaggcccctgaagagccaagaagaaacctacaatcaaaaacagaattaactcctgaggagagagcccaaaagattgccaaagccatgcgcaaacagtcttctgaagtcaaagaaaaatgggaaagtctaaatgctgtaactagcaattggcaaaagcaagtggacaaggcattggagaaactcagagacctgcagggagctatggatgacctggacgctgacatgaaggaggcagagtccgtgcggaatggctggaagcccgtgggagacttactcattgactcgctgcaggatcacattgaaaaaatcatggcatttagagaagaaattgcaccaatcaactttaaagttaaaacggtgaatgatttatccagtcagctgtctccacttgacctgcatccctctctaaagatgtctcgccagctagatgaccttaatatgcgatggaaacttttacaggtttctgtggatgatcgccttaaacagcttcaggaagcccacagagattttggaccatcctctcagcattttctctctacgtcagtccagctgccgtggcaaagatccatttcacataataaagtgccctattacatcaaccatcaaacacagaccacctgttgggaccatcctaaaatgaccgaactctttcaatcccttgctgacctgaataatgtacgtttttctgcctaccgtacagcaatcaaaatccgaagactacaaaaagcactatgtttggatctcttagagttgagtacaacaaatgaaattttcaaacagcacaagttgaaccaaaatgaccagctcctcagtgttccagatgtcatcaactgtctgacaacaacttatgatggacttgagcaaatgcataaggacctggtcaacgttccactctgtgttgatatgtgtctcaattggttgctcaatgtctatgacacgggtcgaactggaaaaattagagtgcagagtctgaagattggattaatgtctctctccaaaggtctcttggaagaaaaatacagatatctctttaaggaagttgcagggccaacagaaatgtgtgaccagaggcagctgggcctgttacttcatgatgccatccagatcccccggcagctaggtgaagtagcagcttttggaggcagtaatattgagcctagtgttcgcagctgcttccaacagaataacaataaaccagaaataagtgtgaaagagtttatagattggatgcatttggaaccacagtccatggtttggctcccagttttacatcgagtggcagcagcggagactgcaaaacatcaggccaaatgcaacatctgtaaagaatgtccaattgtcgggttcaggtatagaagccttaagcattttaactatgatgtctgccagagttgtttcttttcgggtcgaacagcaaaaggtcacaaattacattacccaatggtggaatattgtatacctacaacatctggggaagatgtacgagacttcacaaaggtacttaagaacaagttcaggtcgaagaagtactttgccaaacaccctcgacttggttacctgcctgtccagacagttcttgaaggtgacaacttagagactcctatcacactcatcagtatgtggccagagcactatgacccctcacaatctcctcaactgtttcatgatgacacccattcaagaatagaacaatatgccacacgactggcccagatggaaaggactaatgggtcttttctcactgatagcagctccaccacaggaagtgtggaagacgagcacgccctcatccagcagtattgccaaacactcggaggagagtccccagtgagccagccgcagagcccagctcagatcctgaagtcagtagagagggaagaacgtggagaactggagaggatcattgctgacctggaggaagaacaaagaaatctacaggtggagtatgagcagctgaaggaccagcacctccgaagggggctccctgtcggttcaccgccagagtcgattatatctccccatcacacgtctgaggattcagaacttatagcagaagcaaaactcctcaggcagcacaaaggtcggctggaggctaggatgcagattttagaagatcacaataaacagctggagtctcagctccaccgcctccgacagctgctggagcagcctgaatctgattcccgaatcaatggtgtttccccatgggcttctcctcagcattctgcactgagctactcgcttgatccagatgcctccggcccacagttccaccaggcagcgggagaggacctgctggccccaccgcacgacaccagcacggatctcacggaggtcatggagcagattcacagcacgtttccatcttgctgcccaaatgttcccagcaggccacaggcaatgtgaagtattcatccggccaaccaatgtttcctgacgtacagtgttgcccttttcagcaaatgccaattccaagttccattaaatcagaagctccatggctccttggcccacgatgttgagtgctgactgtgtgttctactgaaagagtaaaacactgactatccaaagagaaatggatattttgtttttataataaccatatattattgttttcttcttccctttctatgcaagtgtaaattaatgaacagagaggtatttggaaatggtaatacatttgtcacggatttgtataatgtatacagcattgggaaagtgggtgggggctttctaatatgataccgtctttttaataactatgacaaagcttacataagaattagaagaccactttacatttttacattccttctgctgttcatattaaccttgcacaattacttcattttttctttgactcttttaccacaatgttttggttatttataatttatcagccatatgtttatcagccatataaccaactagatcccaaatagatccatgtatttgtttccgtgatttggccacattaataaattcataaatttcaatcaaatatcttatatatacacacatatggtttaagctacagccctgtgtatgccgtttaactttatttgacgttgcccacttacttctttgctgaccacttggataaccgtaataaaaatcctataagcctaaatggcatttcttttgggatatttttcctgcattttattccctttttatataagtaggaattaattatttattttatgtcttaatctatttgataaagaagactacattataataatctcaaagatcatattaccaaaggttgcccacttgagcatattttcattttgacacagaaacaaaatttagtacaacctttcctagttcccatgtcttgattttcatcattacatgcacagcagacctttacctattgtgataccagaacacatcattgtctttggttcccttcaaagagaattttattgttgttttgtattttcaagtccttaatagttcttgaaactcctagttgttttcttgttgaaagcagacacacatttagtgcacggcttattttacctttcgggtgaaagatcagatgtttttatacccttcacttgatcaatatatttggaaagaatgtttatcaaaagtctatgtcactgcttctacagaagaatgaaattaatgcttaggtgatggtacctccacctacatctttttgagtgcattcaattatgtattttggtttagcttctgatttaacatttaattgattcagtttaaacatgttacttaattagcaaatgtagaggaaccaaaaaaaggtgaaaataatatgttttgattcaaacctaaagacataaaaacataaagacattttaactttgggttctctttagctgggatctggccagaaggaggcttaaagttagaaattgctattattttagaataggttgggtgggttggggggcaagggtgtctatttgcagcagagatattttgaaaagaagaaaattgttttatataaaaaggaaagccatgaccacctttctacctcagatccatcttcatccattgcattggaaactgctttatgctgctgcagtctgcaaagtctagagcttttatcaggccatgtcatacccaagaaagcacctatttaaagaaaaaacaattccctgagctctcaactccaagttgtagatttggtgtcttccttgttcttactttaaaaagtcatgtgttaattttttttctgcctgtatttgtatgcaaaatgtcctctatctgctattaaagaaaagctacgtaaaacactacattgtaaccttctaagtaataataaataaaaagaaatatattgcagtaacaatgggaagtaagtatgtagttcttttgaaatatgtggtaaagaactaatcacagactatcatctaatctggttacatattgtatttttcatcctgaataaaagtaattttaacacaaaaaaa

SEQ ID NO: 5541 - DNA, 2026 bp, Homo sapiens
ccaggccgggaggcgacgcgcccagccgtctaaacgggaacagccctggctgagggagctgcagcgcagcagagtatctgacggcgccaggttgcgtaggtgcggcacgaggagttttcccggcagcgaggaggtcctgagcagcatggcccggaggagcgccttccctgccgccgcgctctggctctggagcatcctcctgtgcctgctggcactgcgggcggaggccgggccgccgcaggaggagagcctgtacctatggatcgatgctcaccaggcaagagtactcataggatttgaagaagatatcctgattgtttcagaggggaaaatggcaccttttacacatgatttcagaaaagcacaacagagaatgccagctattcctgtcaatatccattccatgaattttacctggcaagctgcagggcaggcagaatacttctatgaattcctgtccttgcgctccctggataaaggcatcatggcagatccaaccgtcaatgtccctctgctgggaacagtgcctcacaaggcatcagttgttcaagttggtttcccatgtcttggaaaacaggatggggtggcagcatttgaagtggatgtgattgttatgaattctgaaggcaacaccattctccaaacacctcaaaatgctatcttctttaaaacatgtcaacaagctgagtgcccaggcgggtgccgaaatggaggcttttgtaatgaaagacgcatctgcgagtgtcctgatgggttccacggacctcactgtgagaaagccctttgtaccccacgatgtatgaatggtggactttgtgtgactcctggtttctgcatctgcccacctggattctatggagtgaactgtgacaaagcaaactgctcaaccacctgctttaatggagggacctgtttctaccctggaaaatgtatttgccctccaggactagagggagagcagtgtgaaatcagcaaatgcccacaaccctgtcgaaatggaggtaaatgcattggtaaaagcaaatgtaagtgttccaaaggttaccagggagacctctgttcaaagcctgtctgcgagcctggctgtggtgcacatggaacctgccatgaacccaacaaatgccaatgtcaagaaggttggcatggaagacactgcaataaaaggtacgaagccagcctcatacatgccctgaggccagcaggcgcccagctcaggcagcacacgccttcacttaaaaaggccgaggagcggcgggatccacctgaatccaattacatctggtgaactccgacatctgaaacgttttaagttacaccaagttcatagcctttgttaacctttcatgtgttgaatgttcaaataatgttcattacacttaagaatactggcctgaattttattagcttcattataaatcactgagctgatatttactcttccttttaagttttctaagtacgtctgtagcatgatggtatagattttcttgtttcagtgctttgggacagattttatattatgtcaattgatcaggttaaaattttcagtgtgtagttggcagatattttcaaaattacaatgcatttatggtgtctgggggcaggggaacatcagaaaggttaaattgggcaaaaatgcgtaagtcacaagaatttggatggtgcagttaatgttgaagttacagcatttcagattttattgtcagatatttagatgtttgttacatttttaaaaattgctcttaatttttaaactctcaatacaatatattttgaccttaccattattccagagattcagtattaaaaaaaaaaaaattacactgtggtagtggcatttaaacaatataatatattctaaacacaatgaaatagggaatataatgtatgaactttttgcattggcttgaagcaatataatatattgtaaacaaaacacagctcttacctaataaacattttatactgtttgtatgtataaaataaaggtgctgctttagttttctgaaaaaaaaaaaaaaaaaaa

SEQ ID NO: 5542 - DNA, 4520 bp, Homo sapiens
taggaacaggggagagtgcacctgctaccagtcaagctcagccagactgcaagaggaggcgaggcggagccagccgagggagtgaaccatggacaagttgaaatgcccgagtttcttcaagtgcagggagaaggagaaagtgtcggcttcatcagagaatttccatgttggtgaaaatgatgagaatcaggaccgtggtaactggtccaaaaaatcggattatcttctatctatgattggatacgcagtgggattaggaaatgtgtggagatttccatatctgacctacagcaatggtggaggcgccttcttgataccttatgcaattatgttagcattggctggtttacctttgttctttctggagtgttcactgggacaatttgctagcttaggtccagtttcagtttggaggattcttccattgtttcaaggtgtgggaattacaatggtcctgatctccatttttgtgacaatctattacaatgtcataattgcctatagtctttactacatgtttgcttcttttcaaagtgaactaccatggaaaaattgttcttcgtggtcagataaaaactgtagcagatcaccaatagtaactcactgtaatgtgagtacagtgaataaaggaatacaagagatcatccaaatgaataaaagctgggtagacatcaacaattttacctgcatcaacggcagtgaaatttatcagccagggcagcttcccagtgaacaatattggaataaagtggcgctccaacggtcaagtggaatgaatgagactggagtaattgtttggtatttagcactttgtcttcttctggcttggctcatagttggagcagcactatttaaaggaatcaaatcgtctggcaaggtggtatattttacagctcttttcccctatgtggtcctactcatcctgttagtacgaggtgcaactctggagggtgcttcaaaaggcatttcatactatattggagcccagtcaaattttacaaaacttaaggaagctgaggtatggaaagatgctgccactcagatattttactccctttcagtggcttggggtggcttagttgctctatcatcttacaataagttcaaaaacaactgcttctctgatgccattgtggtttgtttgacaaactgtctcactagcgtgtttgctggatttgctattttttctatattgggacacatggcccatatatctggaaaggaagtttctcaagttgtaaaatcaggttttgatttggcattcattgcctatccagaggctctagcccaactcccaggtggtccattttggtccatattattttttttcatgcttttaactttgggtctcgattctcagtttgcttcgattgaaacgatcacaacaacaattcaagatttatttcccaaagtgatgaagaaaatgagggttcccataactttgggctgctgcttggttttgtttctccttggtctcgtctgtgtgactcaggctggaatttactgggttcatctgattgaccacttctgtgctggatggggcattttaattgcagctatactggagctagttggaatcatctggatttatggagggaacagattcattgaggatacagaaatgatgattggagcaaagaggtggatattctggctatggtggagagcttgctggtttgtaattacgcctatccttttgattgcaatatttatctggtcattggtgcaatttcatagacctaattatggcgcaattccataccctgactggggagttgctttaggctggtgtatgattgttttctgcattatttggataccaattatggctatcataaaaataattcaggctaaaggaaacatctttcaacgccttataagttgctgcagaccagcttctaactggggtccatacctggaacaacatcgtggggaaagatataaagacatggtagatcctaaaaaagaggctgaccatgaaatacctactgttagtggcagcagaaaaccggaatgagatctcattgaaaaaaatatatgattgtataatgtgattttttttagaatagggggaaccttatttatttgtgtgttaactgaataggaaaatgtacatactatgttcatgatagtgtgatttttttcacatttaagcaggaatgcaatataaaaatgtgaatctcttaattctcagccatgtgcttattatatttctttttagattgtctatctgtataacacacacacacacacctaagagtctctatttcacaattatatttttgtaaatagtatatgcatttttaatacattggaggctttattttgaactaatttcttagagaatagttatattttctattacacaagtttaaaaatattattaacttgtattttcttaatatacaatctatcttttccacaaatatgagtgggaaataaatcagcacatttgaaagaaagtgttaaaactgaaggcctcacttaattagaaacgtgataaatatatggacaaatggactatacatactataagaggactgtagtttaatactttttacccaaatatgtttaaaaacatcgtgcatttgttacagctcatgttttctatatgaacttagtcattaatgttctttataaaaagtgaaataagatggaaaaattaggatcctacagccagtacgtgataaatctagaaaattgagttttgagtacctcttttcccatatacaatcttccttccttaggtaatttggaagaaaactatgacccatttaatttctattgtgtttcaccaaattcagtgttgttcattatacctctctgaaatataggtttaatttcaaatagaatatggacttaaatgttaatgagaaactggctttaatcaattctagcattttattactgtaatacagggctgatagagtgattttgtcttatatgagtcagttactacttacaggtgataacttgcatactattggaagataaagttgtcaaacttgtcaagaatgagaaaagccaaattagaaaatcctatgtcctagtttccttaccaaggataattaaatatatcactaagagctttatatattgattatatattgttgacaactggtttaagcatcatagcctatgatgataaacactgcctatatatgtaaatagcttttcatcaattcttaaatttcttaacctaggcttcagggagcatatgaaaccaaaattatatggaacattttctgtgtgtacatgtacatgcatttttctagggagagagtccgtaggtttatcagaatatcaaggaaaactgtgacccaaagaagtttaagaatcacatacagtgctgctggctttttgtgcttggcaaatgagtgacaatagaagaaataatttttcttacacattttaaaacgttttctcttccttgtgattgaagatgaaaggagtaagaaattaaggcatttgtttaatttatactggtaacttatttaggggggaggggacatgaaggtaggtaaataggtaggcctctaattgaaccacctctctaagttatgtacgtatatataagctgaaattgtgtttgacattctgagggttttctttttctttttcctttttttttttttttggtggggggctgggggtcagagtcttgttctgttgcctgggctggagtgcagtggcatgatctcagctcactgcaacctctgccttctggattcaagtgattctcctgcctcagcctcttgagtagctgggactacaggtgcccgccaccacaccagctaatttttgtatttttagtagaggcgaagtttccccatgttggccaggctggtcttgaactcccgacctcaagtgatctgtctacctcggcctcctaaagtgctgagattacaggtgtgagccaccgtgcccggcccattctaagggttttctttgaagacaggtcaaatgctgttagtaagtttcaggagattgttaattcctcagttataccagattttataaaatatttgagaatagatggctaacaagaggttagaaatacttttccttaattttaatccacagtatgttacatgcattctaccactacattttggtgctatttaaggtgtgcaattttctataggtgacttttgcaattcagggaagatttgggcatattaaatgaaagaatatctaattgggggaggtgtgaagggaaagaaattcttttcaaaagctgaccacaaagagtagttaaaagtttttgtcactatcttcacaagtgtgtaaagcacagatttcaacagagtgcttggcatattgtagggtgctcaatggtggtttttattattattactcagattccacagtggcaagaaacatcattctacataatggaaaacatttacatcaaatcccacttactttaatgcgaacttggagataatttatggtattgtattgtaaaccattaatgaaaactttttcacagttgagtgaaattaaaatcactatatctc

SEQ ID NO: 5543 - DNA, 3685 bp, Homo sapiens
agtggactcacgcaggcgcaggagactacacttcccaggaactccgggccgcgttgttcgctggtacctccttctgacttccggtattgctgcggtctgtagggccaatcgggagcctggaattgctttcccggcgctctgattggtgcattcgactaggctgcctgggttcaaaatttcaacgatactgaatgagtcccgcggcgggttggctcgcgcttcgttgtcagatctgaggcgaggctaggtgagccgtgggaagaaaagagggagcagctagggcgcgggtctccctcctcccggagtttggaacggctgaagttcaccttccagcccctagcgccgttcgcgccgctaggcctggcttctgaggcggttgcggtgctcggtcgccgcctaggcggggcagggtgcgagcaggggcttcgggccacgcttctcttggcgacaggattttgctgtgaagtccgtccgggaaacggaggaaaaaaagagttgcgggaggctgtcggctaataacggttcttgatacatatttgccagacttcaagatttcagaaaaggggtgaaagagaagattgcaactttgagtcagacctgtaggcctgatagactgattaaaccacagaaggtgacctgctgagaaaagtggtacaaatactgggaaaaacctgctcttctgcgttaagtgggagacaatgtcacaagttaaaagctcttattcctatgatgccccctcggatttcatcaatttttcatccttggatgatgaaggagatactcaaaacatagattcatggtttgaggagaaggccaatttggagaataagttactggggaagaatggaactggagggctttttcagggcaaaactcctttgagaaaggctaatcttcagcaagctattgtcacacctttgaaaccagttgacaacacttactacaaagaggcagaaaaagaaaatcttgtggaacaatccattccgtcaaatgcttgttcttccctggaagttgaggcagccatatcaagaaaaactccagcccagcctcagagaagatctcttaggctttctgctcagaaggatttggaacagaaagaaaagcatcatgtaaaaatgaaagccaagagatgtgccactcctgtaatcatcgatgaaattctaccctctaagaaaatgaaagtttctaacaacaaaaagaagccagaggaagaaggcagtgctcatcaagatactgctgaaaagaatgcatcttccccagagaaagccaagggtagacatactgtgccttgtatgccacctgcaaagcagaagtttctaaaaagtactgaggagcaagagctggagaagagtatgaaaatgcagcaagaggtggtggagatgcggaaaaagaatgaagaattcaagaaacttgctctggctggaatagggcaacctgtgaagaaatcagtgagccaggtcaccaaatcagttgacttccacttccgcacagatgagcgaatcaaacaacatcctaagaaccaggaggaatataaggaagtgaactttacatctgaactacgaaagcatccttcatctcctgcccgagtgactaagggatgtaccattgttaagcctttcaacctgtcccaaggaaagaaaagaacatttgatgaaacagtttctacatatgtgccccttgcacagcaagttgaagacttccataaacgaacccctaacagatatcatttgaggagcaagaaggatgatattaacctgttaccctccaaatcttctgtgaccaagatttgcagagacccacagactcctgtactgcaaaccaaacaccgtgcacgggctgtgacctgcaaaagtacagcagagctggaggctgaggagctcgagaaattgcaacaatacaaattcaaagcacgtgaacttgatcccagaatacttgaaggtgggcccatcttgcccaagaaaccacctgtgaaaccacccaccgagcctattggctttgatttggaaattgagaaaagaatccaggagcgagaatcaaagaagaaaacagaggatgaacactttgaatttcattccagaccttgccctactaagattttggaagatgttgtgggtgttcctgaaaagaaggtacttccaatcaccgtccccaagtcaccagcctttgcattgaagaacagaattcgaatgcccaccaaagaagatgaggaagaggacgaaccggtagtgataaaagctcaacctgtgccacattatggggtgccttttaagccccaaatcccagaggcaagaactgtggaaatatgccctttctcgtttgattctcgagacaaagaacgtcagttacagaaggagaagaaaataaaagaactgcagaaaggggaggtgcccaagttcaaggcacttcccttgcctcattttgacaccattaacctgccagagaagaaggtaaagaatgtgacccagattgaacctttctgcttggagactgacagaagaggtgctctgaaggcacagacttggaagcaccagctggaagaagaactgagacagcagaaagaagcagcttgtttcaaggctcgtccaaacaccgtcatctctcaggagccctttgttcccaagaaagagaagaaatcagttgctgagggcctttctggttctctagttcaggaaccttttcagctggctactgagaagagagccaaagagcggcaggagctggagaagagaatggctgaggtagaagcccagaaagcccagcagttggaggaggccagactacaggaggaagagcagaaaaaagaggagctggccaggctacggagagaactggtgcataaggcaaatccaatacgcaagtaccagggtctggagataaagtcaagtgaccagcctctgactgtgcctgtatctcccaaattctccactcgattccactgctaaactcagctgtgagctgcggataccgcccggcaatgggacctgctcttaacctcaaacctaggaccgtcttgctttgtcattgggcatggagagaacccatttctccagacttttacctacccgtgcctgagaaagcatacttgacaactgtggactccagttttgttgagaattgttttcttacattactaaggctaataatgagatgtaactcatgaatgtctcgattagactccatgtagttacttcctttaaaccatcagccggccttttatatgggtcttcactctgactagaatttagtctctgtgtcagcacagtgtaatctctattgctattgccccttacgactctcaccctctccccactttttttaaaaattttaaccagaaaataaagatagttaaatcctaagatagagattaagtcatggtttaaatgaggaacaatcagtaaatcagattctgtcctcttctctgcataccgtgaatttatagttaaggatccctttgctgtgagggtagaaaacctcaccaactgcaccagtgaggaagaagactgcgtggattcatggggagcctcacagcagccacgcagcaggctctgggtggggctgccgttaaggcacgttctttccttactggtgctgataacaacagggaaccgtgcagtgtgcattttaagacctggcctggaataaatacgttttgtctttccctcaaaaaaaaaaaaaaaaaaaaaaa

SEQ ID NO: 5544 - DNA, 3967 bp, Homo sapiens
agttgtcgggtcttattggccgctgattagaccagccggggtccactagccctgggctgcagggaggctgctgcgtccagtgaacacttcagcacctgtagcacagaagggccaaggagctgcagtcctcgaccagcaggaggtttgctcctcagcccactcgctgcatccagatcagctcacccctctcccttccctgcccaccaggactctgatagcccctggcagccacagcccattttgccaagatgtctagagtagccaaatatcgccggcaggtgagtgaagaccccgacatcgacagcctgctggagaccctgtctcccgaggagatggaggagctggagaaggagctggacgtggtggacccagacgggagtgttcccgtggggctgcggcagagaaaccagacggagaaacagtccacgggtgtgtacaaccgggaggccatgctcaacttctgtgaaaaggagaccaagaaacttatgcagagggagatgtccatggatgaaagcaagcaagtggagaccaagacagatgccaagaatggagaggaaaggggcagagatgccagcaaaaaagccctgggccccagacgggactcagatctggggaaggagccaaagaggggtggtttaaagaaaagcttctctagagacagagatgaagctggtggcaagagtggcgagaagcccaaggaggagaagatcatccggggcattgacaagggccgggtcagggctgcagtggataagaaggaggcagggaaggatgggagaggagaggagagggcagtggccaccaagaaggaagaggagaagaaagggagtgacaggaacacaggcttgagcagggacaaggataaaaagagagaggagatgaaggaggtggccaagaaagaggatgatgagaaggtaaaaggggagcgtaggaacacagacaccagaaaagagggtgagaagatgaaaagagcaggtgggaacacagacatgaaaaaggaggatgagaaggtaaaaagaggaactgggaacacagacaccaaaaaggacgatgaaaaagtcaagaagaatgaacccttacatgaaaaggaagccaaggatgacagcaagaccaaaacacccgagaaacagacgcccagtggccccaccaagccctctgaaggaccggccaaggtggaggaggaggcagctcccagcatatttgatgagcctctggagagagtgaagaacaatgaccccgagatgactgaggtgaacgtcaacaactcagactgcatcacaaatgagatcttggtccggtttactgaggctctggagttcaacactgtggttaagctgttcgccttggccaacacgcgagccgatgaccacgtggcctttgccattgccatcatgctcaaggccaacaagaccatcaccagcctcaacctggactccaaccacatcacaggcaaaggcatcctggccatcttccgggccctcctccagaacaacacgctgaccgagctccgcttccacaaccagcgacacatctgtggaggcaagacggagatggagatcgccaagctgctgaaggagaatactaccctgctcaagctgggctaccattttgagctggccgggccccgaatgactgtcaccaatctgctcagccgcaacatggacaagcagagacaaaagcggctgcaggagcaaaggcaggcacaggaagccaagggagagaagaaggatctgctggaggtacccaaggccggggccgtggctaagggctccccaaaaccttcacctcaaccatctccaaagccctctccaaagaactcacccaaaaaagggggtgctccagctgccccaccaccccctccccctcccttggctccaccccttatcatggagaacctgaagaattcactctcaccagctacccagaggaagatgggagacaaagtcctccctgcccaggagaagaactcccgtgaccagctattggctgccatccgctccagcaacctcaagcagctcaagaaggtggaagtgcccaaactgcttcagtaggaccaggctgccaggcaccatctgccaatgccatgactgctcaggcctcacctcccagggctacacagaccctgcccaccccatccctggctgacctgctgtggatgtccctattctgccatgggagagtccaggcctgggtcacgctcaaggaaggatgccttatctcttctcactttccttttcttgtctctgaggctctccaaattttgctttagtacatggagctcaggtttctggacaagaagagtccttttagcacatcactgagaagatggcactgtccagggcccatgtagctggcaagctgcaaaaggcctgtgatccaggaaagatgtcccacagggaccacatccaccccagccccactgccctccagggccaggattcaggcctctgaggagcccacggggcaaagctgctgggccagtggcactctgtgtgggaaaatggcagaaagatggagaggcatgggggcccaaaggggagcgtggggaggggctgaggataccccaaagtccaggctaattagaggatgtggcaggggcagtggcctggatgcacagtgcctgatgggagtaggctccagacaggaggagtgggacagacagcagctggacttgaaggtttgatgccaaagcagacattttcctcacacccacctgctgctgtatgaatagctgtgtatctgtttttccataagattttgataatatatacaaacctttagctgtgaatggctgtgccccacctgttgtcctgaactgtgagtcctgatcctaaccctgggctccctggaggactctagaagctcaggttccctgccacactatttgagttggccaagaaataaattcacatcctcagaaagtgcagcatggaggaaaatctgaactctaagcagaagactctccactgacctggttgtccaggtctagaaggccaggcctctactaggtctgctcctgaaccagtcctgctgcctggagtcagtagccagagttgttctcaggggtgctggggcagagtggagcccagggtgctgggatggctatattaggcatgttcagggatgctcattccatgactctgcctaaccatgggctcagggccaggtcctcacagcagtcacaggcccaggaaggcggcaggcagagaagtggagtgactatttggagaatagcacccatatctgtgtgccctagggctcagaggggcctcatcttccccagccctccccacctgctcaccaattccacttcctgccccaactgcaggaatgctgacaatgctgccatgcccaccatcgggtgtaggtgaaaggcatctttctgaatttcattctcttgaaggtgctgccaccccttggcactgtggaactgccaccttgggtctgtgtcacttgtaggtttctctgcctccaggttgcctcaacagcaggaggcacagcagtttcaccatctttgaggtgagggtggggtgccccagctaggaagcaagatcgctgtgctaggtctgaccaaaaccagagggcagtctagtcctgggggtaaagccctcagatcccagggtacactcttctccattccctccacccacttgcctgtcaccccagtcacctaagcaatcactgggcccagaggagaggagacagacacacactggctcctggacctaaagggtatgagctggagctaaggccagctagagcttccactgtcagccctcactgtcagtcccactgcacccccctgtgcctgctgggcactgggcactagctagatgctttaggttgcttcagctgatccttcaactctgtgaggtggataccaatattctattttgcagatagaatttggcccagagaggttaactaatatatccatgatcacacagctaataaaagtcagagctca

SEQ ID NO: 5545 - DNA, 5723 bp, Homo sapiens
cggcgaacagacgttctttctcctccatgcagttacacaaaaggagggctacggaaactaaaagtttcggggcctctggctcggtgtgtggagaaaagagaaaacctggagacgggatatgaagatcaatgatgcagactgatggttttgatgaagctgggcatttataactagattcattaaggaatacaaagaaaatacttaaagggatcaataatggtgtcttctggttgcagaatgcgaagtctgtggtttatcattgtaatcagcttcttaccaaatacagaaggtttcagcagagcagctttaccatttgggctggtgaggcgagaattatcctgtgaaggttattctatagatctgcgatgcccgggcagtgatgtcatcatgattgagagcgctaactatggtcggacggatgacaagatttgtgatgctgacccatttcagatggagaatacagactgctacctccccgatgccttcaaaattatgactcaaaggtgcaacaatcgaacacagtgtatagtagttactgggtcagatgtgtttcctgatccatgtcctggaacatacaaataccttgaagtccaatatgaatgtgtcccttacatttttgtgtgtcctgggaccttgaaagcaattgtggactcaccatgtatatatgaagctgaacaaaaggcgggtgcttggtgcaaggaccctcttcaggctgcagataaaatttatttcatgccctggactccctatcgtaccgatactttaatagaatatgcttctttagaagatttccaaaatagtcgccaaacaacaacatataaacttccaaatcgagtagatggtactggatttgtggtgtatgatggtgctgtcttctttaacaaagaaagaacgaggaatattgtgaaatttgacttgaggactagaattaagagtggcgaggccataattaactatgccaactaccatgatacctcaccatacagatggggaggaaagactgatatcgacctagcagttgatgaaaatggtttatgggtcatttacgccactgaacagaacaatggaatgatagttattagccagctgaatccatacactcttcgatttgaagcaacgtgggagactgtatacgacaaacgtgccgcatcaaatgcttttatgatatgcggagtcctctatgtggttaggtcagtttatcaagacaatgaaagtgaaacaggcaagaactcaattgattacatttataatacccgattaaaccgaggagaatatgtagatgttcccttccccaaccagtatcagtatattgctgcagtggattacaatccaagagataaccaactttacgtgtggaacaataacttcattttacgatattctctggagtttggtccacctgatcctgcccaagtgcctaccacagctgtgacaataacttcttcagctgagctgttcaaaaccataatatcaaccacaagcactacttcacagaaaggccccatgagcacaactgtagctggatcacaggaaggaagcaaagggacaaaaccacctccagcagtttctacaaccaaaattccacctataacaaatatttttcccctgccagagagattctgtgaagcattagactccaaggggataaagtggcctcagacacaaaggggaatgatggttgaacgaccatgccctaagggaacaagaggaactgcctcatatctctgcatgatttccactggaacatggaaccctaagggccccgatcttagcaactgtacctcacactgggtgaatcagctggctcagaagatcagaagcggagaaaatgctgctagtcttgccaatgaactggctaaacataccaaagggccagtgtttgctggggatgtaagttcttcagtgagattgatggagcagttggtggacatccttgatgcacagctgcaggaactgaaacctagtgaaaaagattcagctggacggagttataacaaggcaattgttgacacagtggacaaccttctgagacctgaagctttggaatcatggaaacatatgaattcttctgaacaagcacatactgcaacaatgttactcgatacattggaagaaggagcttttgtcctagctgacaatcttttagaaccaacaagggtctcaatgcccacagaaaatattgtcctggaagttgccgtactcagtacagaaggacagatccaagactttaaatttcctctgggcatcaaaggagcaggcagctcaatccaactgtccgcaaataccgtcaaacagaacagcaggaatgggcttgcaaagttggtgttcatcatttaccggagcctgggacagttccttagtacagaaaatgcaaccattaaactgggtgctgattttattggtcgtaatagcaccattgcagtgaactctcacgtcatttcagtttcaatcaataaagagtccagccgagtatacctgactgatcctgtgctttttaccctgccacacattgatcctgacaattatttcaatgcaaactgctccttctggaactactcagagagaactatgatgggatattggtctacccagggctgcaagctggttgacactaataaaactcgaacaacgtgtgcatgcagccacctaaccaattttgcaattctcatggcccacagggaaattgcatataaagatggcgttcatgaattacttcttacagtcatcacctgggtgggaattgtcatttcccttgtttgcctggctatctgcatcttcaccttctgctttttccgtggcctacagagtgaccgaaatactattcacaagaacctttgtatcaaccttttcattgctgaatttattttcctaataggcattgataagacaaaatatgcgattgcatgcccaatatttgcaggacttctacactttttctttttggcagcttttgcttggatgtgcctagaaggtgtgcagctctacctaatgttagttgaagtttttgaaagtgaatattcaaggaaaaaatattactatgttgctggttacttgtttcctgccacagtggttggagtttcagctgctattgactataagagctatggaacagaaaaagcttgctggcttcatgttgataactactttatatggagcttcattggacctgttaccttcattattctgctaaatattatcttcttggtgatcacattgtgcaaaatggtgaagcattcaaacactttgaaaccagattctagcaggttggaaaacattaagtcttgggtgcttggcgctttcgctcttctgtgtcttcttggcctcacctggtcctttgggttgctttttattaatgaggagactattgtgatggcatatctcttcactatatttaatgctttccagggagtgttcattttcatctttcactgtgctctccaaaagaaagtacgaaaagaatatggcaagtgcttcagacactcatactgctgtggaggcctcccaactgagagtccccacagttcagtgaaggcatcaaccaccagaaccagtgctcgctattcctctggcacacagagtcgtataagaagaatgtggaatgatactgtgagaaaacaatcagaatcttcttttatctcaggtgacatcaatagcacttcaacacttaatcaaggacattcactgaacaatgccagggatacaagtgccatggatactctaccgctaaatggtaattttaacaacagctactcgctgcacaagggtgactataatgacagcgtgcaagttgtggactgtggactaagtctgaatgatactgcttttgagaaaatgatcatttcagaattagtgcacaacaacttacggggcagcagcaagactcacaacctcgagctcacgctaccagtcaaacctgtgattggaggtagcagcagtgaagatgatgctattgtggcagatgcttcatctttaatgcacagcgacaacccagggctggagctccatcacaaagaactcgaggcaccacttattcctcagcggactcactcccttctgtaccaaccccagaagaaagtgaagtccgagggaactgacagctatgtctcccaactgacagcagaggctgaagatcacctacagtcccccaacagagactctctttatacaagcatgcccaatcttagagactctccctatccggagagcagccctgacatggaagaagacctctctccctccaggaggagtgagaatgaggacatttactataaaagcatgccaaatcttggagctggccatcagcttcagatgtgctaccagatcagcaggggcaatagtgatggttatataatccccattaacaaagaagggtgtattccagaaggagatgttagagaaggacaaatgcagctggttacaagtctttaatcatacagctaaggaattccaagggccacatgcgagtattaataaataaagacaccattggcctgacgcagctccctcaaactctgcttgaagagatgactcttgacctgtggttctctggtgtaaaaaagatgactgaaccttgcagttctgtgaatttttataaaacatacaaaaactttgtatatacacagagtatactaaagtgaattatttgttacaaagaaaagagatgccagccaggtattttaagattctgctgctgtttagagaaattgtgaaacaagcaaaacaaaactttccagccattttactgcagcagtctgtgaactaaatttgtaaatatggctgcaccatttttgtaggcctgcattgtattatatacaagacgtaggctttaaaatcctgtgggacaaatttactgtaccttactattcctgacaagacttggaaaagcaggagagatattctgcatcagtttgcagttcactgcaaatcttttacattaaggcaaagattgaaaacatgcttaaccactagcaatcaagccacaggccttatttcatatgtttcctcaactgtacaatgaactattctcatgaaaaatggctaaagaaattatattttgttctattgctagggtaaaataaatacatttgtgtccaactgaaatataattgtcattaaaataattttaaagagtgaagaaaatattgtgaaaagctcttggttgcacatgttatgaaatgttttttcttacactttgtcatggtaagttctactcattttcacttcttttccactgtatacagtgttctgctttgacaaagttagtctttattacttacatttaaatttcttattgccaaaagaacgtgttttatggggagaaacaaactctttgaagccagttatgtcatgccttgcacaaaagtgatgaaatctagaaaagattgtgtgtcacccctgtttattcttgaacagagggcaaagagggcactgggcacttctcacaaactttctagtgaacaaaaggtgcctattcttttttaaaaaaataaaataaaacataaatattactcttccatattccttctgcctatatttagtaattaatttattttatgataaagttctaatgaaatgtaaattgtttcagcaaaattctgcttttttttcatccctttgtgtaaacctgttaataatgagcccatcactaatatccagtgtaaagtttaacacggtttgacagtaaataaatgtgaattttttcaagtaaaaaaaaaaaaaaaaaa

SEQ ID NO: 5546 - DNA, 4562 bp, Homo sapiens
tcactcgctccggggacccgcaacaagtggccgccgcgccctccccggggaagccgcgggcgcgcaggggcagccgaaggaggcggtcgagccgcggagcccaggggcctgcccggctcagcgcccaccggaggggatcggggcgggcggatggggacccggcggcggcggcgcggtgagcctctgggcggccccggggcgcgggctgtgcgcggcgctgcgcccgccggcccccagcgcggattgtaagtgctgcagctgtgcccggccccgcctggagccaccgggggtgccaggaggggacgcagcaccccctcccactggagtgcggggacctctccaggccggaggtcggccccggagcttgggggggatgtgcagctaacggtcccgtcgggcgggctttcctcgggccgagcgcgcaggacgtgcgccgcagctatggagtgtcccgggagacggcgggcatgacggctacaggatgggcgcgaacaatggcaaacagtacggcagtgagggcaaaggcagctcgagcatctcatctgacgtgagttcaagtacagatcacacgcccactaaagcccagaagaatgtggctaccagcgaagactccgacctgagcatgcgcacactgagcacgcccagcccagccctgatatgtccaccgaatctcccaggatttcagaatggaaggggctcgtccacctcctcgtcctccatcaccggggagacggtggccatggtgcactccccgcccccgacccgcctcacacacccgctcatccggctcgcctccagaccccagaaggagcaggccagcatagaccggctcccggaccactccatggtgcagatcttctccttcctgcccaccaaccagctgtgccgctgcgcgcgagtgtgccgccgctggtacaacctggcctgggacccgcggctctggaggactatccgcctgacgggcgagaccatcaacgtggaccgcgccctcaaggtgctgacccgcagactctgccaggacacccccaacgtgtgtctcatgctggaaaccgtaactgtcagtggctgcaggcggctcacagaccgagggctgtacaccatcgcccagtgctgccccgaactgaggcgactggaagtctcaggctgttacaatatctccaacgaggccgtctttgatgtggtgtccctctgccctaatctggagcacctggatgtgtcaggatgctccaaagtgacctgcatcagcttgacccgggaggcctccattaaactgtcacccttgcatggcaaacagatttccatccgctacctggacatgacggactgcttcgtgctggaggacgaaggcctgcacaccatcgcggcgcactgcacgcagctcacccacctctacctgcgccgctgcgtccgcctgaccgacgaaggcctgcgctacctggtgatctactgcgcctccatcaaggagctgagcgtcagcgactgccgcttcgtcagcgacttcggcctgcgggagatcgccaagctggagtcccgcctgcggtacctgagcatcgcgcactgcggccgggtcaccgacgtgggcatccgctacgtggccaagtactgcagcaagctgcgctacctcaacgcgaggggctgcgagggcatcacggaccacggtgtggagtacctcgccaagaactgcaccaaactcaaatccctggatatcggcaaatgccctttggtatccgacacgggcctggagtgcctggccctgaactgcttcaacctcaagcggctcagcctcaagtcctgcgagagcatcaccggccagggcttgcagatcgtggccgccaactgctttgacctccagacgctgaatgtccaggactgcgaggtctccgtggaggccctgcgctttgtcaaacgccactgcaagcgctgcgtcatcgagcacaccaacccggctttcttctgaagggacagagttcatccggcgttgtattcacacaaacctgaacaaagcaaatttttttaaaagcagcgtatgtaagcaccgacacccactcaaaacagctctttcttccgggaaggttattaggaatctggcctttatttttcctcatttctcatgggcaacagaggccaaagaaacgaagcaagacaaacagcaaacaggcattttggtcaggtcatttgtaggcagtttctcttctcacaaaagatgtacttaagcaggctgatcgctgttccttgagcaaggcgcttactctcctccgctcaggcccccaaggccgccctttccctcgcacacaggccccacccccacagttccacgccccccccccaaggccacaccctccctccctagagcagcagcgaggatccatcatcagaatcacagtgctctccagacctcctctctaaactgcttcattgacctaagtcactctcttcaatcccacacccatggacattcttgtcaactcaataccatagcactttgcataggcaaaatacttttcaggcctttttaaaaaattcattacagcaaacagctggggaaggacatgcagtcctcccccagctctgtcaatgactatgaccttggccaaagcacttcactgctctgggctgcagcttccagcactgaatcagaggccacacagcccaaagattagcttcatgtccattatagcattgagggagcagagatacccatacacagaagcaccttggcatagagcacccaggcatcgacctcttccaggagaactgattctgtggatggatgtgatttcaggagattgtgcagtgccagcatcagtgcataaagggtcctgtatgtcctttggctgcaaatcacccacttccctgtgtttcagtgggagaatttcctctcccacctcctcacatcctcttttgccaggctggatgctgtcgtctctgtacacaaatactttctgcattcccccctccacaccatcctagcgaggcaccagcacacctaatcacagcaaagcccagatccccccatcagttgcttttactcagtgttttcaaataggagtaaaggcccttgcaatttttaattaacaagcaaggcccaagggaacacatgtcctcaaaagtttttctgatccctcgccttgcacacctggcatgcatcaggcacatctgtcctacagctggcagagacagatgcctcggttctttgtcattcagattgcatttgacctcttctcatctatttatttctttatacatccagacttcatcacatgaagcctattggggttaagtttgtaagtgtttaattgtgcaaattgccaccctgtgtacctcctccatgtctgtctgcgtgttttccaccaaagaatgcaaagcagacttccaggtgtttaaattctgttcactcaacaatgccagatgaatggaagagggaacacactgagatgacttagactctggtccaccaaccagacccttggaaaggaatactaaaatcattacaaggtatggattttaaatggatgaaacttcaaattatcttatttggatagaagtctatattctagcctcatttgcatgaagtcagatagccagaagaaattccattgctggttttcacgaaattcacttgtcttttgctaataaacacatggccctttcccagattattctctagccaagccccacctttgttacgttgaaatccctcatttattttcttctcaaaatgcccattatccaaatgcagaacctctgcatctccaagccagttatgctgaatttgtcaaacttagacacccttgacaactgcactcctactgtaggctcctgtgcatactgtcgtcttctgtgggggatggagaggttagtgtgatgaggtggtgtctgcccaggaggtttctttcaaacatcatggcctcccatccaatcaacatcatcaaattacatgtgtaatcaaggctctgtgccatgggggaaatgaatcatttagctaggccaggatctagtgaaagccacagagtttaaaaccatgaaagaagttgaaggcagcattcctcagctctgtgacttgtgaccctatttgaagtttcaggatttgggtgtcacaaaggattgtccctaatccttggccctggggtcttccgagtgagctggtttaatactctgagaatgagcagggagatccagagaatgaatccctgaccgcatcacctaaactgtcttccaaacatgagacaaagctgactgttcacactgattgcccagcacataccgtcttgccagtttcttcttttctcccagtctcctgttcatccattctgttctcccttggggtgggaatctatgatggaggttactggggaaacagctcagcagatttttggagaccaaaccaaaggtctcactaggaaatttatctgttttaaaacattgcttccttcctggctctgctaaattgaatgctcattgtttgttgttgttgttttttaattctaatgttcaaatcactgcgtgctgtatgaatctagaaagccttaatttactaccaagaaataaagcaatatgttcgt

SEQ ID NO: 5547 - DNA, 4447 bp, Homo sapiens
aattggttggcgtctccgggacggatttgaaacttggcggttaaagctccggctgggacagggcggcgggaggcccagggagaacggggaagggacatttagtttgagacggtgctgagataggatcatgaaggaagaggtgaagggaattcctgtaagagtggcgctgcgttgtcgccctctggtccccaaagagattagcgagggctgccagatgtgcctttccttcgtgcccggagagcctcaggtggtggttggtacagataaatccttcacctacgattttgtatttgatccctctactgaacaggaagaagtcttcaatacagcagtagcgccactcataaaaggtgtatttaaaggatataatgcaacggtcctggcctatgggcagactggctctggaaaaacctattcaatgggaggtgcatatactgcagagcaagagaatgaaccaacagttggggttattcctagggtaatacaactgctcttcaaagaaattgataaaaagagtgactttgaatttactctgaaagtgtcttacttagagatttacaatgaagaaattttggatcttctatgcccatctcgtgagaaagctcaaataaatatacgagaggatcctaaggaaggcataaagattgtgggactcactgagaagactgttttggttgccttggatactgtttcctgtttggaacagggcaacaactctaggactgtggcctccacggctatgaactcccagtcgtcccgatctcatgccatctttacaatctccttagagcaaagaaagaaaagtgacaagaatagcagctttcgctccaagctgcatcttgtagacctcgctggatcagaaagacagaagaaaaccaaggctgaaggggatcgtctaaaagagggtattaatattaaccgaggcctcctatgcttgggaaatgtaatcagtgctcttggagatgacaaaaagggtggctttgtgccctacagagattccaagttgactcgactgcttcaagattctctaggaggtaatagccatactcttatgatagcctgtgtgagtcctgctgactccaatctagaggaaacattaaatacccttcgctatgctgacagagcaagaaaaatcaagaacaaacctattgttaatattgatccccagacagctgaacttaatcatctaaagcaacaggtacaacagctacaagtcttgttgctacaggcccatggaggtaccctgcctggatctataactgtggaaccatcagagaatctacaatccctgatggagaagaatcagtccctggtagaggagaatgaaaaattaagtcgtggtctgagcgaggcagctggtcagacagcccagatgttggagaggatcattttgacagagcaagcgaatgaaaaaatgaacgccaagctagaagagctcaggcagcatgcggcctgcaaactggatcttcaaaagctagtggagactttggaagaccaggaattgaaagaaaatgtagagataatttgtaacctgcagcaattgattacccagttatcggatgaaactgttgcttgcatggctgcagccattgatactgcggtggagcaagaagcccaagtagaaaccagtccagagacgagcaggtcttctgacgcttttaccactcagcatgctctccgtcaagcgcagatgtctaaggagctggttgagttgaataaagcgcttgcactgaaagaggccctggctaggaagatgactcagaatgacagccaactgcagcccattcagtaccaataccaggataacataaaagagctagaattagaagtcatcaatctgcaaaaggaaaaggaagaattggttcttgaacttcagacagcaaagaaggatgccaaccaagccaagttgagtgagcgccgccgcaaacgtctccaggagctggagggtcaaattgctgatctgaagaagaaactgaatgagcagtccaaacttctgaaactaaaggaatccacagagcgtactgtctccaaactgaaccaggagatacggatgatgaaaaaccagcgggtacagttaatgcgtcaaatgaaagaagatgctgagaagtttagacagtggaagcagaaaaaagacaaagaagtaatacagttaaaagaacgagaccgtaagaggcaatatgagctgctgaaacttgaaagaaacttccagaaacaatccaatgtgctcagacgtaaaacggaggaggcagcagctgccaacaagcgtctcaaggatgctctccagaaacaacgggaggttgcagataagcggaaagagactcagagccgtggaatggaaggcactgcagctcgagtgaagaattggcttggaaacgaaattgaggttatggtcagtactgaggaagccaaacgccatctgaatgacctccttgaagatagaaagatcctggctcaagatgtggctcaactcaaagaaaaaaaggaatctggggagaatccacctcctaaactccggaggcgtacattctcccttactgaagtgcgtggtcaagtttcggagtcagaagattctattacaaagcagattgaaagcctagagactgaaatggaattcaggagtgctcagattgctgacctacagcagaagctgctggatgcagaaagtgaagacagaccaaaacaacgctgggagaatattgccaccattctggaagccaagtgtgccctgaaatatttgattggagagctggtctcctccaaaatacaggtcagcaaacttgaaagcagcctgaaacagagcaagaccagctgtgctgacatgcagaagatgctgtttgaggaacgaaatcattttgccgagatagagacagagttacaagctgagctggtcagaatggagcaacagcaccaagagaaggtgctgtaccttctcagccagctgcagcaaagccaaatggcagagaagcagttagaggaatcagtcagtgaaaaggaacagcagctgctgagcacactgaagtgtcaggatgaagaacttgagaaaatgcgagaagtgtgtgagcaaaatcagcagcttctccgagagaatgaaatcatcaagcagaaactgaccctcctccaggtagccagcagacagaaacatcttcctaaggatacccttctatctccagactcttcttttgaatatgtcccacctaagccaaaaccttctcgtgttaaagaaaagttcctggagcaaagcatggacatcgaggatctaaaatattgttcagagcattctgtgaatgagcatgaggatggtgatggtgatgatgatgagggggatgacgaggaatggaagccaacaaaattagttaaggtgtccaggaagaacatccaagggtgttcctgcaagggctggtgtggaaacaagcagtgtgggtgcaggaagcaaaagtcagactgtggtgtggactgttgctgtgaccccacaaagtgtcggaaccgccagcaaggcaaggatagcttgggcactgttgaacggacccaggattccgaaggctccttcaaactggaggatcctaccgaggtgaccccaggattgagcttctttaatcccgtctgtgccacccccaatagcaagatcctgaaagagatgtgcgatgtggagcaggtgctgtcaaagaagactcccccagctccctccccttttgacctcccagagttgaaacatgtagcaacagaataccaagaaaacaaggctccagggaagaaaaagaaacgggctctggccagcaacaccagcttcttctctggctgctcccctatcgaagaagaggcccactgaagttggagtcatcatctctacccccagtctggcttgggagatgctttcaggttgcagccagaaggggttttttaaatgacttctctggatttcaggtttcttgctgttgaaaaaaggaacaaagcgttactgaaaagaaggtaacctttgttggatgtgggccttagcctccaggtccagactactactctatgttctccagaagggtgctaagtcacctactgaagagagaaccaactgactttcctattgactcatcaggaaccagtcctcagtctggtcaagttgtttcttatttgtgagcagttcaggctatctcctgatggggatgaggccaaggctttcttatcttttggttgtctctgcttaatggaggagcctggcctaggatggaggcctggcttagatctttcattccacctcaggaatgaggttgtgatctttcctgtcctgaccctctctgaattatgtttcaatagtactcttgattgtctgccatgttgttgaagcaaatgaattatttttaaatgttaagtaagtaaataaaccttagcccgtctactgtttgggaagatccttctgtgctagagggagaaataaaatttcaacctgtgttcctca

SEQ ID NO: 5548 - DNA, 3002 bp, Homo sapiens
gccagtcaccttcagtttctggagctggccgtcaacatgtcctttcctaaggcgcccttgaaacgattcaatgacccttctggttgtgcaccatctccaggtgcttatgatgttaaaactttagaagtattgaaaggaccagtatcctttcagaaatcacaaagatttaaacaacaaaaagaatctaaacaaaatcttaatgttgacaaagatactaccttgcctgcttcagctagaaaagttaagtcttcggaatcaaaggaatctcaaaagaatgataaagatttgaagatattagagaaagagattcgtgttcttctacaggaacgtggtgcccaggacagccggatccaggatctggaaactgagttggaaaagatggaagcaaggctaaatgctgcactaagggaaaaaacatctctctctgcaaataatgctacactggaaaaacaacttattgaattgaccaggactaatgaactactaaaatctaagttttctgaaaatggtaaccagaagaatttgagaattctaagcttggagttgatgaaacttagaaacaaaagagaaacaaagatgaggggtatgatggctaagcaagaaggcatggagatgaagctgcaggtcacccaaaggagtctcgaagagtctcaagggaaaatagcccaactggagggaaaacttgtttcaatagagaaagaaaagattgatgaaaaatctgaaacagaaaaactcttggaatacatcgaagaaattagttgtgcttcagatcaagtggaaaaatacaagctagatattgcccagttagaagaaaatttgaaagagaagaatgatgaaattttaagccttaagcagtctcttgaggagaatattgttatattatctaaacaagtagaagatctaaatgtgaaatgtcagctgcttgaaaaagaaaaagaagaccatgtcaacaggaatagagaacacaacgaaaatctaaatgcagagatgcaaaacttaaaacagaagtttattcttgaacaacaggaacgtgaaaagcttcaacaaaaagaattacaaattgattcacttctgcaacaagagaaagaattatcttcgagtcttcatcagaagctctgttcttttcaagaggaaatggttaaagagaagaatctgtttgaggaagaattaaagcaaacactggatgagcttgataaattacagcaaaaggaggaacaagctgaaaggctggtcaagcaattggaagaggaagcaaaatctagagctgaagaattaaaactcctagaagaaaagctgaaagggaaggaggctgaactggagaaaagtagtgctgctcatacccaggccaccctgcttttgcaggaaaagtatgacagtatggtgcaaagccttgaagatgttactgctcaatttgaaagctataaagcgttaacagccagtgagatagaagatcttaagctggagaactcatcattacaggaaaaagcggccaaggctgggaaaaatgcagaggatgttcagcatcagattttggcaactgagagctcaaatcaagaatatgtaaggatgcttctagatctgcagaccaagtcagcactaaaggaaacagaaattaaagaaatcacagtttcttttcttcaaaaaataactgatttgcagaaccaactcaagcaacaggaggaagactttagaaaacagctggaagatgaagaaggaagaaaagctgaaaaagaaaatacaacagcagaattaactgaagaaattaacaagtggcgtctcctctatgaagaactatataataaaacaaaaccttttcagctacaactagatgcttttgaagtagaaaaacaggcattgttgaatgaacatggtgcagctcaggaacagctaaataaaataagagattcatatgctaaattattgggtcatcagaatttgaaacaaaaaatcaagcatgttgtgaagttgaaagatgaaaatagccaactcaaatcggaagtatcaaaactccgctgtcagcttgctaaaaaaaaacaaagtgagacaaaacttcaagaggaattgaataaagttctaggtatcaaacactttgatccttcaaaggcttttcatcatgaaagtaaagaaaattttgccctgaagaccccattaaaagaaggcaatacaaactgttaccgagctcctatggagtgtcaagaatcatggaagtaaacatctgagaaacctgttgaagattatttcattcgtcttgttgttattgatgttgctgttattatatttgacatgggtattttataatgttgtatttaattttaactgccaatccttaaatatgtgaaaggaacattttttaccaaagtgtcttttgacattttattttttcttgcaaatacctcctccctaatgctcacctttatcacctcattctgaaccctttcgctggctttccagcttagaatgcatctcatcaacttaaaagtcagtatcatattattatcctcctgttctgaaaccttagtttcaagagtctaaaccccagattcttcagcttgatcctggaggtcttttctagtctgagcttctttagctaggctaaaacaccttggcttgttattgcctctactttgattctgataatgctcacttggtcctacctattatccttctacttgtccagttcaaataagaaataaggacaagcctaacttcatagaaacctctctatttttaatcagttgtttaataatttacaggttcttaggctccatcctgtttgtatgaaattataatctgtggattggcctttaagcctgcattcttaacaaactcttcagttaattcttagatacactaaaaatctgagaaactctacatgtaactatttcttcagagtttgtcatatactgcttgtcatctgcatgtctactcagcatttgattaacatttgtgtaatatgaaataaaattacacagtaagtcatttaaccaaaaaaaaaaaaaaaa

SEQ ID NO: 5549 - DNA, 2755 bp, Homo sapiens
ggcggagagggagcctggtgggcgggcggggcgcgtcttgcgggctccctcgggtaccggcgctgccgcaccccgccgcgctcccgcacccgcggcccgcccaccgcgccgctcccgcatctgcacccgcagcccggcggcctcccggcgggagcgagcagatccagtccggcccgcagcgcaactcggtccagtcggggcggcggctgcgggcgcagagcggagatgcagcggcttggggccaccctgctgtgcctgctgctggcggcggcggtccccacggcccccgcgcccgctccgacggcgacctcggctccagtcaagcccggcccggctctcagctacccgcaggaggaggccaccctcaatgagatgttccgcgaggttgaggaactgatggaggacacgcagcacaaattgcgcagcgcggtggaagagatggaggcagaagaagctgctgctaaagcatcatcagaagtgaacctggcaaacttacctcccagctatcacaatgagaccaacacagacacgaaggttggaaataataccatccatgtgcaccgagaaattcacaagataaccaacaaccagactggacaaatggtcttttcagagacagttatcacatctgtgggagacgaagaaggcagaaggagccacgagtgcatcatcgacgaggactgtgggcccagcatgtactgccagtttgccagcttccagtacacctgccagccatgccggggccagaggatgctctgcacccgggacagtgagtgctgtggagaccagctgtgtgtctggggtcactgcaccaaaatggccaccaggggcagcaatgggaccatctgtgacaaccagagggactgccagccggggctgtgctgtgccttccagagaggcctgctgttccctgtgtgcacacccctgcccgtggagggcgagctttgccatgaccccgccagccggcttctggacctcatcacctgggagctagagcctgatggagccttggaccgatgcccttgtgccagtggcctcctctgccagccccacagccacagcctggtgtatgtgtgcaagccgaccttcgtggggagccgtgaccaagatggggagatcctgctgcccagagaggtccccgatgagtatgaagttggcagcttcatggaggaggtgcgccaggagctggaggacctggagaggagcctgactgaagagatggcgctgagggagcctgcggctgccgccgctgcactgctgggaggggaagagatttagatctggaccaggctgtgggtagatgtgcaatagaaatagctaatttatttccccaggtgtgtgctttaggcgtgggctgaccaggcttcttcctacatcttcttcccagtaagtttcccctctggcttgacagcatgaggtgttgtgcatttgttcagctcccccaggctgttctccaggcttcacagtctggtgcttgggagagtcaggcagggttaaactgcaggagcagtttgccacccctgtccagattattggctgctttgcctctaccagttggcagacagccgtttgttctacatggctttgataattgtttgaggggaggagatggaaacaatgtggagtctccctctgattggttttggggaaatgtggagaagagtgccctgctttgcaaacatcaacctggcaaaaatgcaacaaatgaattttccacgcagttctttccatgggcataggtaagctgtgccttcagctgttgcagatgaaatgttctgttcaccctgcattacatgtgtttattcatccagcagtgttgctcagctcctacctctgtgccagggcagcattttcatatccaagatcaattccctctctcagcacagcctggggagggggtcattgttctcctcgtccatcagggatctcagaggctcagagactgcaagctgcttgcccaagtcacacagctagtgaagaccagagcagtttcatctggttgtgactctaagctcagtgctctctccactaccccacaccagccttggtgccaccaaaagtgctccccaaaaggaaggagaatgggatttttcttttgaggcatgcacatctggaattaaggtcaaactaattctcacatccctctaaaagtaaactactgttaggaacagcagtgttctcacagtgtggggcagccgtccttctaatgaagacaatgatattgacactgtccctctttggcagttgcattagtaactttgaaaggtatatgactgagcgtagcatacaggttaacctgcagaaacagtacttaggtaattgtagggcgaggattataaatgaaatttgcaaaatcacttagcagcaactgaagacaattatcaaccacgtggagaaaatcaaaccgagcagggctgtgtgaaacatggttgtaatatgcgactgcgaacactgaactctacgccactccacaaatgatgttttcaggtgtcatggactgttgccaccatgtattcatccagagttcttaaagtttaaagttgcacatgattgtataagcatgctttctttgagttttaaattatgtataaacataagttgcatttagaaatcaagcataaatcacttcaactgctcttctgtagttcttggatttcttttcccttttgactttgaataaatgtaaaatcctttcagccagaaaaagtaaaatagaaacaacctgtattaaaaatcttccatagaaaaaaaaaaa

SEQ ID NO: 5550 - DNA, 3237 bp, Homo sapiens
gcgaagtgaagggtggcccaggtggggccaggctgactgaatgtatctcctagctatggactaaataatacatggggggaaataaacaagtattcatgagggtgaaaatgtgacccagcaggaaaattacaactattttcaattgacgttgaataggatgagtcatggaatttaagtgatttactgaagattatactactggtagatagaagagctaaagaaagatggatactatgatgctgaatgtgcggaatctgtttgagcagcttgtgcgccgggtggagattctcagtgaaggaaatgaagtccaatttatccagttggcgaaggactttgaggatttccgtaaaaagtggcagaggactgaccatgagctggggaaatacaaggatcttttgatgaaagcagagactgagcgaagtgctctggatgttaagctgaagcatgcacgtaatcaggtggatgtagagatcaaacggagacagagagctgaggctgactgcgaaaagctggaacgacagattcagctgattcgagagatgctcatgtgtgacacatctggcagcattcaactaagcgaggagcaaaaatcagctctggcttttctcaacagaggccaaccatccagcagcaatgctgggaacaaaagactatcaaccattgatgaatctggttccattttatcagatatcagctttgacaagactgatgaatcactggattgggactcttctttggtgaagactttcaaactgaagaagagagaaaagaggcgctctactagccgacagtttgttgatggtccccctggacctgtaaagaaaactcgttccattggctctgcagtagaccaggggaatgaatccatagttgcaaaaactacagtgactgttcccaatgatggcgggcccatcgaagctgtgtccactattgagactgtgccatattggaccaggagccgaaggaaaacaggtactttacaaccttggaacagtgactccaccctgaacagcaggcagctggagccaagaactgagacagacagtgtgggcacgccacagagtaatggagggatgcgcctgcatgactttgtttctaagacggttattaaacctgaatcctgtgttccatgtggaaagcggataaaatttggcaaattatctctgaagtgtcgagactgtcgtgtggtctctcatccagaatgtcgggaccgctgtccccttccctgcattcctaccctgataggaacacctgtcaagattggagagggaatgctggcagactttgtgtcccagacttctccaatgatcccctccattgttgtgcattgtgtaaatgagattgagcaaagaggtctgactgagacaggcctgtataggatctctggctgtgaccgcacagtaaaagagctgaaagagaaattcctcagagtgaaaactgtacccctcctcagcaaagtggatgatatccatgctatctgtagccttctaaaagactttcttcgaaacctcaaagaacctcttctgacctttcgccttaacagagcctttatggaagcagcagaaatcacagatgaagacaacagcatagctgccatgtaccaagctgttggtgaactgccccaggccaacagggacacattagctttcctcatgattcacttgcagagagtggctcagagtccacatactaaaatggatgttgccaatctggctaaagtctttggccctacaatagtggcccatgctgtgcccaatccagacccagtgacaatgttacaggacatcaagcgtcaacccaaggtggttgagcgcctgctttccttgcctctggagtattggagtcagttcatgatggtggagcaagagaacattgaccccctacatgtcattgaaaactcaaatgccttttcaacaccacagacaccagatattaaagtgagtttactgggacctgtgaccactcctgaacatcagcttctcaagactccttcatctagttccctgtcacagagagtccgttccaccctcaccaagaacactcctagatttgggagcaaaagcaagtctgccactaacctaggacgacaaggcaacttttttgcttctccaatgctcaagtgaagtcacatctgcctgttacttcccagcattgactgactataagaaaggacacatctgtactctgctctgcagcctcctgtactcattactacttttagcattctccaggcttttactcaagtttaattgtgcatgagggttttattaaaactatatatatctccccttccttctcctcaagtcacataatatcagcactttgtgctggtcattgttgggagcttttagatgagacatctttccaggggtagaagggttagtatggaattggttgtgattctttttggggaagggggttattgttcctttggcttaaagccaaatgctgctcatagaatgatctttctctagtttcatttagaactgatttccgtgagacaatgacagaaaccctacctatctgataagattagcttgtctcagggtgggaagtgggagggcagggcaaagaaaggattagaccagaggatttaggatgcctccttctaagaaccagaagttctcattccccattatgaactgagctataatatggagctttcataaaaatgggatgcattgaggacagaactagtgatgggagtatgcgtagctttgatttggatgattaggtctttaatagtgttgagtggcacaaccttgtaaatgtgaaagtacaactcgtatttatctctgatgtgccgctggctgaactttgggttcatttggggtcaaagccagtttttcttttaaaattgaattcattctgatgcttggcccccatacccccaaccttgtccagtggagcccaacttctaaaggtcaatatatcatcctttggcatcccaactaacaataaagagtaggctataagggaagattgtcaatattttgtggtaagaaaagctacagtcattttttctttgcactttggatgctgaaatttttcccatggaacatagccacatctagatagatgtgagctttttcttctgttaaaattattcttaatgtctgtaaaaacgattttcttctgtagaatgtttgacttcgtattgacccttatctgtaaaacacctatttgggataatatttggaaaaaaagtaaatagctttttcaaaatgaaaaaaaaaa

SEQ ID NO: 5551 - DNA, 8145 bp, Homo sapiens
acttggttcatgaagccttcgcctagaagtgaagctgctgaacaaaccttgagaagaatcatctcctgcttcaatctgctgctggataggaactaatcagagagagagaggcggaagacggagaaggagggagtcgaaggctttcccgatcacaaatctcacctccactacaactctctttatacttttcttgcagaaataataatagaaataaggaggtggtggggtttccaaaaatcttaaccttcaaccatctggggaaaaggcaaaaatcccatctaccgcaactctcagttcgagagtaaaggtttcccaacagtgatgtcacaagattgaccacattgatcacaatatggagtctggagaacggttaccatcctcagcagcctcctctactacaccaacttcatcttcgacaccttctgtggcttcagtagtttcaaaaggtggcctttccactggagttgcttcacttagctctacaatcaacccatgtggacatttattcagaacagctggggatcaaccgtttaacctgtccacagtgtcgagtgccttcccaatggtcagccacccagtctttggtctacattcagccagctcagggcattcagaatttggtggtttggggacacttggtacacccacagccttagccgcacatccccaactagcatcttttccaggtgcagaatggtggcgaacaactgatgctcatactcgtacaggagcaaccttctttccaccattactgggaattccaccactatttgctcccccagcccagaatcatgattcttcttcattccattcaaggacttcgggaaaaagtaatcgaaatggtcccgaaaaaggtgtaaatgggtcaataaatggaagtaatacatcatctgtaattggtatcaacacatctgtactatccactactgcttcaagttccatgggacaaactaaaagtacaagctcaggtggaggaaatcgaaaatgtaatcaggaacaaagcaaaaaccagcctttggatgctagagttgacaaaatcaaagataagaaaccaaggaagaaagcaatggaaagttctagcaacagtgatagtgattcaggcacatcatcagacacctcaagtgaaggcattagtagcagtgattcagatgatctagaagaagatgaagaagaagaagatcaaagtattgaagaaagtgaagatgatgattctgattcagagagtgaagcacaacataaaagtaacaaccaggtgctattacatggtatttcagacccaaaagcagatggacagaaagcaactgaaaaagcccaggaaaaaagaatacaccagccattacctcttgcgtctgaatcccagactcactcattccaatcccagcagaagcagcctcaggttttgtcacagcagcttccatttattttccaaagctctcaggcaaaggaggaatctgtgaacaaacacaccagtgtaatacagtctacgggattggtgtccaatgtgaaacctttatctttggtaaatcaagccaaaaaggaaacttacatgaaactcatagttccttctcctgatgttcttaaagcagggaataaaaatacctctgaagaatctagtttattgaccagtgaattgagatccaaacgggaacaatataaacaggcattcccatcacagttaaagaaacaagagtcatcgaagagcctgaagaaggttattgcagctttgtcaaatccaaaagcaacctctagttcaccagcacatccaaaacaaacattagaaaacaaccacccaaatccattcttgacaaatgcacttttaggtaatcaccaaccaaatggagttattcaaagtgtcattcaagaagctcctctagcacttactaccaaaactaaaatgcagagcaagattaatgaaaacattgctgctgcaagtagcacccctttttcctcacctgtaaatctgagtacaagtgggagaagaacccctggcaatcagacacctgtaatgccctctgcctctcccatcctgcatagtcaagggaaggaaaaagcagttagcaataatgtaaacccagtaaaaacacagcatcactcccatcctgcaaaatctttagtggaacaattcagaggaacagattcagacattcccagtagtaaagattctgaagattcaaatgaggatgaagaggaagatgatgaagaagaagatgaggaagatgatgaagatgatgaatctgatgacagccaatcagaatcagatagtaattcagaatcagatacagaaggatcagaagaagaagatgatgatgataaagaccaagatgaatcagatagtgatactgaaggagagaaaacttcaatgaaactgaataaaacaacttcctctgtcaaaagcccttccatgagtctcacaggtcactcaacacctcgtaacctccacatagcaaaagccccaggctctgctcctgctgccttatgttctgaatcccagtcacctgcttttcttggtacatcttcttccacacttacttcaagcccacactctggcacttccaaaagaagaagagtaacagatgaacgtgaactgcgtattccattggaatatggctggcagagagagacaagaataagaaactttggagggcgccttcaaggagaagtagcatattatgctccatgtggaaagaaacttaggcagtaccctgaagtaataaagtatctcagcagaaatggaataatggatatctcaagggacaatttcagcttcagtgcaaaaataagagtgggtgacttctatgaagccagagatggaccgcagggaatgcagtggtgtcttttgaaagaagaggatgtcattcctcgtatcagggcaatggaaggtcgtagaggaagaccaccaaatccagatagacaacgagcaagagaggaatccaggatgagacgtcggaaaggtcgacctccaaatgttggcaatgctgaattcctagataacgcagatgcaaagttgctaagaaaactgcaagctcaagaaatagccaggcaagcagcacaaataaagcttttgagaaaacttcaaaagcaggaacaggctcgggttgctaaagaagccaaaaaacaacaagcaataatggctgctgaggagaagcggaagcaaaaagaacagataaagattatgaaacagcaggaaaaaattaagagaatacagcaaatcagaatggaaaaagaacttcgagctcagcaaattctagaggctaaaaagaaaaagaaggaagaagcggcaaatgccaaattattggaggccgagaaacgaataaaggaaaaagaaatgagaagacaacaagctgttcttctgaaacatcaggaacgagagcgaaggcgacaacacatgatgcttatgaaagctatggaagctcgtaaaaaagcagaagaaaaagagcggttgaaacaagaaaaacgtgatgagaaaagattaaataaagagcgtaaactagagcagcgaagattagaattagaaatggcaaaggaactaaagaagcctaatgaagacatgtgcttagcagaccaaaagcctttgccagagttgcctcgtattccaggacttgttctctctggaagtacattttcagactgtctcatggtggtgcagttcttacgaaactttggtaaagttttgggctttgatgtgaatattgatgttccaaacctgagtgttcttcaagagggattgctaaatataggggacagcatgggtgaagtacaagacttgcttgtgaggctcctctcagctgctgtatgtgatccaggtctaataacaggatacaaggctaaaacagctcttggagaacatttgctgaatgttggtgtgaatcgagacaatgtttccgagattttacagatatttatggaagcccactgtggacaaactgagcttactgaaagtctgaagaccaaagcttttcaggctcacactccagcacagaaagcttcagtcctggctttcctgatcaatgaactggcatgcagcaagagtgtggtcagtgaaatcgacaagaacattgattatatgtcaaacttgaggagagataaatgggtggtagaaggtaaactccgcaagctcagaatcattcatgctaagaaaacaggcaaaagagacacttcaggtggcattgatctgggagaagagcagcatcccttgggcacacccactccaggacgcaagcgaagaaggaagggaggagacagtgattatgacgatgatgatgacgatgacagtgatgaccaaggggatgaagatgatgaggatgaagaagataaagaagacaaaaaaggaaaaaagactgatatctgtgaagatgaggatgaaggtgaccaagcagcaagtgttgaagagctggaaaaacagattgaaaaactgagtaaacaacagagtcagtacagaaggaagctctttgatgcgtctcactcattgcgttcagtgatgtttggccaagatcgttacagacgccggtactggattcttccccaatgtggggggatttttgtagaaggcatggagagtggtgaaggactagaagaaattgcaaaagaaagagaaaaactgaaaaaggcagaaagtgtccagatcaaagaagaaatgtttgagacttctggggacagtttaaattgttcaaatacagatcactgtgaacaaaaggaagatcttaaagaaaaagataacacaaatctattccttcagaaacctggctctttttccaaattaagcaagcttttggaagtagctaagatgcctcctgagtcagaggttatgacccccaaaccaaatgctggtgcaaatgggtgcacgttgtcttatcagaacagtggaaaacattcactgggcagcgttcagtcaacagcaacgcaaagcaatgtggaaaaggcagactctaataatctgtttaatactggttcaagtggtccagggaagttctacagtcctctccccaatgaccagttactaaaaacgctgactgaaaagaatagacaatggtttagtcttttgccacgaacaccctgtgatgacacttcacttactcatgccgatatgtcaactgcttctttggtgactcctcagtctcagccaccatctaagtcaccttcacctaccccagctcctcttggatcttctgctcagaatcctgttggcttaaatccatttgctttatcacctcttcaggtgaaaggtggagtatctatgatgggacttcagttttgtggatggcccactggtgtggttacttctaatattccatttacatcatctgtacctagtctaggatcggggttagggttatcagaaggaaatggtaattcattcttgacttccaatgttgcttcaagtaaaagtgaatctccagtaccacagaatgaaaaggccacttcagctcaacctgcagctgttgaagtagcaaaaccagtagattttcctagtccaaaacctattccagaagaaatgcagtttggttggtggagaattattgacccagaggacctaaaagctttgctcaaagtgctgcatctcagaggaataagagaaaaggcattacaaaaacaaattcagaaacatttggattatattactcaagcctgcctcaagaataaggatgttgctattattgaactgaatgaaaatgaagaaaaccaagtaactcgagatattgtggagaactggtcagtagaagaacaagcaatggaaatggatttgagtgtccttcaacaggtagaagatctagaaaggagagttgcatcagcaagtttgcaagtgaagggttggatgtgtccagagcctgcatcagaaagggaggacttggtatattttgaacataaatcatttactaaattgtgcaaggagcatgatggagaatttactggcgaagacgaaagcagtgcacatgcactagaacggaagagtgacaaccccctagatatagctgtaaccaggctggctgatttggagcggaacattgaaagaagaattgaagaggatattgctccagggctcagggtatggagaagggcattatcagaagctcgcagtgctgcacaggtagctctgtgcattcagcaattacagaaatcaatagcatgggaaaaatcaattatgaaagtttactgccaaatctgtcgaaagggagataatgaagaactgcttcttctttgtgatggctgtgacaaaggctgtcatacctactgccatagacccaagattacaacaatcccagatggagactggttttgtccagcttgcattgctaaggcaagtggtcaaactctaaaaatcaaaaaacttcatgtcaaaggaaaaaagactaatgagtcaaagaaaggcaagaaggtaactttaacaggagatactgaagatgaagactctgcatctacaagtagttcactaaaaagaggaaacaaagacctcaagaaaagaaaaatggaggaaaacacttctattaacttgtcaaaacaagaaagttttacttcagttaagaaacctaaaagagatgactccaaggacctagctctttgcagtatgattctgactgaaatggaaactcatgaggatgcatggccttttctacttcctgtaaacttgaaacttgttcctggttataagaaagttattaagaagcctatggatttttccacaattagagagaaactaagtagtggacagtatccaaaccttgaaacctttgctctagatgtcaggcttgtttttgacaactgtgaaacatttaatgaagatgattctgatataggcagagctggccacaatatgaggaagtattttgaaaaaaagtggacagatactttcaaagtgagctgaagttataataatctctttatttttttccttctaaacaaggacaaatgagaccagcaatgtgaactgtatttacataaacgtgcaaggcacatacataatgactttctttttccttaagtataaaaaaaaagtatcagaagaatgataccatttttaaaggcttcattcctacaacaaccaaggccctcggttattggtttgtgtgatttatcagctaatttaggtagaacagggaagcacacccaaagaattttcaaaggaaagggtgttatagtgcaatagcaattaaaatatatcaaatcgcactgaatactcaacaccagagctctaatgtgggaaatggttctcctttccctctcaataaatatctatttttcatttttttactttgtagtttattttttagtgaatgtatttaattttatgaattatttatgattaaaccacatccagaatcttcgttttctgtgaaaaggaagaactagaaaattgctttaaatcttgaaaatacaaggaatgttttaaaatataaaacaaagccaagttaaactgtttacactgatgtgctataaaagcaccaaaaagaaactttactgtagagttacaagtacatttatatatatatgttgctgcatcacttgtgtagttaaattgtatttcaaaacagtgaaaaaattgacatgtatatactgttcattcttgtttatattaagtcttgttttaaatatgtattatgtgtatatattgtttgcagacattattgttcatgccttagaggattgtagcattttattttcgtctgaaggtaatgatagctatacagtctgtacagtaattatcctctaccaacactgtggcgtctccttaatcttggtagtgcctgcctttgaaacagggtgtaggggatattagttttccatttttctattttgttatataattttaagccaccagggcctaaattaaagtataatcatttgtatccatgtggaataaaattgtgacaatttcctacgcacacagtattttttcatagaaacatttccctcccatttgccttgcctcagaaataaatttaaaagacgtttgtaaccactgtgttttatctactgtgtgttgtggtggcctgttggaggcaaatagatcagattttttttgtacctacgtaagagtacttgaagttttatttaaaataaaatgttgtggaaaaggtagcattctttttttaggagtgttatttttcactatgtgtggcacggatacaataaaagacttttacaaactaa

SEQ ID NO: 5552 - DNA, 2559 bp, Homo sapiens
gcgcctgcctccaacctgcgggcgggaggtgggtggctgcggggcaattgaaaaagagccggcgaggagttccccgaaacttgttggaactccgggctcgcgcggaggccaggagctgagcggcggcggctgccggacgatgggagcgtgagcaggacggtgataacctctccccgatcgggttgcgagggcgccgggcagaggccaggacgcgagccgccagcggtgggacccatcgacgacttcccggggcgacaggagcagccccgagagccagggcgagcgcccgttccaggtggccggaccgcccgccgcgtccgcgccgcgctccctgcaggcaacgggagacgcccccgcgcagcgcgagcgcctcagcgcggccgctcgctctccccctcgagggacaaacttttcccaaacccgatccgagcccttggaccaaactcgcctgcgccgagagccgtccgcgtagagcgctccgtctccggcgagatgtccgagcgcaaagaaggcagaggcaaagggaagggcaagaagaaggagcgaggctccggcaagaagccggagtccgcggcgggcagccagagcccagccttgcctccccgattgaaagagatgaaaagccaggaatcggctgcaggttccaaactagtccttcggtgtgaaaccagttctgaatactcctctctcagattcaagtggttcaagaatgggaatgaattgaatcgaaaaaacaaaccacaaaatatcaagatacaaaaaaagccagggaagtcagaacttcgcattaacaaagcatcactggctgattctggagagtatatgtgcaaagtgatcagcaaattaggaaatgacagtgcctctgccaatatcaccatcgtggaatcaaacgagatcatcactggtatgccagcctcaactgaaggagcatatgtgtcttcagagtctcccattagaatatcagtatccacagaaggagcaaatacttcttcatctacatctacatccaccactgggacaagccatcttgtaaaatgtgcggagaaggagaaaactttctgtgtgaatggaggggagtgcttcatggtgaaagacctttcaaacccctcgagatacttgtgcaagtgcccaaatgagtttactggtgatcgctgccaaaactacgtaatggccagcttctacaaggcggaggagctgtaccagaagagagtgctgaccataaccggcatctgcatcgccctccttgtggtcggcatcatgtgtgtggtggcctactgcaaaaccaagaaacagcggaaaaagctgcatgaccgtcttcggcagagccttcggtctgaacgaaacaatatgatgaacattgccaatgggcctcaccatcctaacccaccccccgagaatgtccagctggtgaatcaatacgtatctaaaaacgtcatctccagtgagcatattgttgagagagaagcagagacatccttttccaccagtcactatacttccacagcccatcactccactactgtcacccagactcctagccacagctggagcaacggacacactgaaagcatcctttccgaaagccactctgtaatcgtgatgtcatccgtagaaaacagtaggcacagcagcccaactgggggcccaagaggacgtcttaatggcacaggaggccctcgtgaatgtaacagcttcctcaggcatgccagagaaacccctgattcctaccgagactctcctcatagtgaaaggtatgtgtcagccatgaccaccccggctcgtatgtcacctgtagatttccacacgccaagctcccccaaatcgcccccttcggaaatgtctccacccgtgtccagcatgacggtgtccatgccttccatggcggtcagccccttcatggaagaagagagacctctacttctcgtgacaccaccaaggctgcgggagaagaagtttgaccatcaccctcagcagttcagctccttccaccacaaccccgcgcatgacagtaacagcctccctgctagccccttgaggatagtggaggatgaggagtatgaaacgacccaagagtacgagccagcccaagagcctgttaagaaactcgccaatagccggcgggccaaaagaaccaagcccaatggccacattgctaacagattggaagtggacagcaacacaagctcccagagcagtaactcagagagtgaaacagaagatgaaagagtaggtgaagatacgcctttcctgggcatacagaaccccctggcagccagtcttgaggcaacacctgccttccgcctggctgacagcaggactaacccagcaggccgcttctcgacacaggaagaaatccaggccaggctgtctagtgtaattgctaaccaagaccctattgctgtataaaacctaaataaacacatagattcacctgtaaaactttattttatataataaagtattccaccttaaattaaacaatttattttattttagcagttctgcaaatagaaaacaggaaaaaaacttttataaattaaatatatgtatgtaaaaatg

SEQ ID NO: 5553 - DNA, 927 bp, Homo sapiens
cgcgcagcgctggtaccccgttggtccgcgcgttgctgcgttgtgaggggtgtcagctcagtgcatcccaggcagctcttagtgtggagcagtgaactgtgtgtggttccttctacttggggatcatgcagagagcttcacgtctgaagagagagctgcacatgttagccacagagccacccccaggcatcacatgttggcaagataaagaccaaatggatgacctgcgagctcaaatattaggtggagccaacacaccttatgagaaaggtgtttttaagctagaagttatcattcctgagaggtacccatttgaacctcctcagatccgatttctcactccaatttatcatccaaacattgattctgctggaaggatttgtctggatgttctcaaattgccaccaaaaggtgcttggagaccatccctcaacatcgcaactgtgttgacctctattcagctgctcatgtcagaacccaaccctgatgacccgctcatggctgacatatcctcagaatttaaatataataagccagccttcctcaagaatgccagacagtggacagagaagcatgcaagacagaaacaaaaggctgatgaggaagagatgcttgataatctaccagaggctggtgactccagagtacacaactcaacacagaaaaggaaggccagtcagctagtaggcatagaaaagaaatttcatcctgatgtttaggggacttgtcctggttcatcttagttaatgtgttctttgccaaggtgatctaagttgcctaccttgaatttttttttaaatatatttgatgacataatttttgtgtagtttatttatcttgtacatatgtattttgaaatcttttaaacctgaaaaataaatagtcatttaatgttgaaaaaaaaaaaaaaaaaaaaaaaaaaaaaaa

SEQ ID NO: 5554 - DNA, 3282 bp, Homo sapiens
gggacagggctgaggatgaggagaaccctggggacccagaagaccgtgccttgcccggaagtcctgcctgtaggcctgaaggacttgccctaacagagcctcaacaactacctggtgattcctacttcagccccttggtgtgagcagcttctcaacatgaactacagcctccacttggccttcgtgtgtctgagtctcttcactgagaggatgtgcatccaggggagtcagttcaacgtcgaggtcggcagaagtgacaagctttccctgcctggctttgagaacctcacagcaggatataacaaatttctcaggcccaattttggtggagaacccgtacagatagcgctgactctggacattgcaagtatctctagcatttcagagagtaacatggactacacagccaccatatacctccgacagcgctggatggaccagcggctggtgtttgaaggcaacaagagcttcactctggatgcccgcctcgtggagttcctctgggtgccagatacttacattgtggagtccaagaagtccttcctccatgaagtcactgtgggaaacaggctcatccgcctcttctccaatggcacggtcctgtatgccctcagaatcacgacaactgttgcatgtaacatggatctgtctaaataccccatggacacacagacatgcaagttgcagctggaaagctggggctatgatggaaatgatgtggagttcacctggctgagagggaacgactctgtgcgtggactggaacacctgcggcttgctcagtacaccatagagcggtatttcaccttagtcaccagatcgcagcaggagacaggaaattacactagattggtcttacagtttgagcttcggaggaatgttctgtatttcattttggaaacctacgttccttccactttcctggtggtgttgtcctgggtttcattttggatctctctcgattcagtccctgcaagaacctgcattggagtgacgaccgtgttatcaatgaccacactgatgatcgggtcccgcacttctcttcccaacaccaactgcttcatcaaggccatcgatgtgtacctggggatctgctttagctttgtgtttggggccttgctagaatatgcagttgctcactacagttccttacagcagatggcagccaaagatagggggacaacaaaggaagtagaagaagtcagtattactaatatcatcaacagctccatctccagctttaaacggaagatcagctttgccagcattgaaatttccagcgacaacgttgactacagtgacttgacaatgaaaaccagcgacaagttcaagtttgtcttccgagaaaagatgggcaggattgttgattatttcacaattcaaaaccccagtaatgttgatcactattccaaactactgtttcctttgatttttatgctagccaatgtattttactgggcatactacatgtatttttgagtcaatgttaaatttcttgcatgccataggtcttcaacaggacaagataatgatgtaaatggtattttaggccaagtgtgcacccacatccaatggtgctacaagtgactgaaataatatttgagtctttctgctcaaagaatgaagctccaaccattgttctaagctgtgtagaagtcctagcattataggatcttgtaatagaaacatcagtccattcctctttcatcttaatcaaggacattcccatggagcccaagattacaaatgtactcagggctgtttattcggtggctccctggtttgcatttacctcatataaagaatgggaaggagaccattgggtaaccctcaagtgtcagaagttgtttctaaagtaactatacatgttttttactaaatctctgcagtgcttataaaatacattgttgcctatttagggagtaacattttctagtttttgtttctggttaaaatgaaatatgggcttatgtcaattcattggaagtcaatgcactaactcaataccaagatgagtttttaaataatgaatattatttaataccacaacagaattatccccaatttccaataagtcctatcattgaaaattcaaatataagtgaagaaaaaattagtagatcaacaatctaaacaaatccctcggttctaagatacaatggattccccatactggaaggactctgaggctttattcccccactatgcatatcttatcattttattattatacacacatccatcctaaactatactaaagcccttttcccatgcatggatggaaatggaagatttttttgtaacttgttctagaagtcttaatatgggctgttgccatgaaggcttgcagaattgagtccattttctagctgcctttattcacatagtgatggggtactaaaagtactgggttgactcagagagtcgctgtcattctgtcattgctgctactctaacactgagcaacactctcccagtggcagatcccctgtatcattccaagaggagcattcatccctttgctctaatgatcaggaatgatgcttattagaaaacaaactgcttgacccaggaacaagtggcttagcttaagtaaacttggctttgctcagatccctgatccttccagctggtctgctctgagtggcttatcccgcatgagcaggagcgtgctggccctgagtactgaactttctgagtaacaatgagacacgttacagaacctatgttcaggttgcgggtgagctgccctctccaaatccagccagagatgcacattcctcggccagtctcagccaacagtaccaaaagtgatttttgagtgtgccagggtaaaggcttccagttcagcctcagttattttagacaatctcgccatctttaatttcttagcttcctgttctaataaatgcacggctttacctttcctgtcagaaataaaccaaggctctaaaagatgatttcccttctgtaactccctagagccacaggttctcattccttttcccattatacttctcacaattcagtttctatgagtttgatcacctgatttttttaacaaaatatttctaacgggaatgggtgggagtgctggtgaaaagagatgaaatgtggttgtatgagccaatcatatttgtgattttttaaaaaaagtttaaaaggaaatatctgttctgaaaccccacttaagcattgtttttatataaaaacaatgataaagatgtgaactgtgaaataaatataccatattagctacccaccaaaaaaaaaaaaaaaaaa

SEQ ID NO: 5555 - DNA, 1207 bp, Homo sapiens
cctctccgccacttccctcgcttctgaccatagtttgcggggaagggagcgagcgcgtcgaaaaccaaggaacgtgcgcgctgacgtcacggttgaggctcggagctgaggggccgcggagggcgtggcctgcgggcggttataaagaggcagtggtgcgcgcgcggccggctcagtgctgccgggcaccggggcggcgggttggtctacgctgtgcgcggcggacgtcggaggcagcggggagcggagcggggccgccggggcctctccagggccgcagcggcagcagttgggccccccgccccggccggcggaccgaagaacgcaggaagggggccggggggacccgcccccggccggccgcagccatgaactccaacgtggagaacctacccccgcacatcatccgcctggtgtacaaggaggtgacgacactgaccgcagacccacccgatggcatcaaggtctttcccaacgaggaggacctcaccgacctccaggtcaccatcgagggccctgaggggaccccatatgctggaggtctgttccgcatgaaactcctgctggggaaggacttccctgcctccccacccaagggctacttcctgaccaagatcttccacccgaacgtgggcgccaatggcgagatctgcgtcaacgtgctcaagagggactggacggctgagctgggcatccgacacgtactgctgaccatcaagtgcctgctgatccaccctaaccccgagtctgcactcaacgaggaggcgggccgcctgctcttggagaactacgaggagtatgcggctcgggcccgtctgctcacagagatccacgggggcgccggcgggcccagcggcagggccgaagccggtcgggccctggccagtggcactgaagcttcctccaccgaccctggggccccagggggcccgggaggggctgagggtcccatggccaagaagcatgctggcgagcgcgataagaagctggcggccaagaaaaagacggacaagaagcgggcgctgcggcggctgtagtgggctctcttcctccttccaccgtgaccccaacctctcctgtcccctccctccaactctgtctctaagttatttaaattatggctggggtcggggagggtacagggggcactgggacctggatttgtttttctaaataaagttggaaaagcagaaaaaaaaaaaaaaaa

SEQ ID NO: 5556 - DNA, 1508 bp, Homo sapiens
gagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgaggaaagctgaaaataaatatgcaggagggaaccccgtttgcgtgcgcccaactcccaagtggcaaaaaggaattggagaattctttaggttgtcccctaaagattctgaaaaagagaatcagattcctgaagaggcaggaagcagtggcttaggaaaagcaaagagaaaagcatgtcctttgcaacctgatcacacaaatgatgaaaaagaatagaactttctcattcatctttgaataacgtctccttgtttaccctggtattctagaatgtaaatttacataaatgtgtttgttccaattagctttgttgaacaggcatttaattaaaaaatttaggtttaaatttagatgttcaaaagtagttgtgaaatttgagaatttgtaagactaattatggtaacttagcttagtattcaatataatgcattgtttggtttcttttaccaaattaagtgtctagttcttgctaaaatcaagtcattgcattgtgttctaattacaagtatgttgtatttgagatttgcttagattgttgtactgctgccatttttattggtgtttgattattggaatggtgccatattgtcactccttctacttgctttaaaaagcagagttagatttttgcacattaaaaaattcagtattaattaaacattacttattctaccctcttttttggcaaggaggacaaatacgcaatgttggaaaaccttggatggatatcttctctttaaaaaaatgtaaagataatttggtcttgagggtttaaacggttgataatgcctctacaacaacaagaaaaaagataaaatactaggatagaatcatggtgggcacagtggcttctcaggaggctgaggagggaggtttgcttgagtccaggagttggagaccagcccaggcaacatagcgtaaaccctatctctaaaacaatttttagccaggtgcggtggctcacgcctgtaatcccagcactctgggaggccgaggcgggtggatcatgaggtcaggagatcgagaccatcctgcctaacaaggtgaaaccccgtctctactaaaaatacaaaaaattagccgggcgcggtggcgggcgcctgtagtcccagctactcgggaggctgaggcaggagaatggcgtgaacccgggaagtggagcttgcagtgagccgagattgcgccactgcagtcggcagtccggcttgggcgacagagcgagactccgtctcaaaaaaaaaaaaaaaaaaaaaaaa

SEQ ID NO: 5557 - DNA, 5616 bp, Homo sapiens
gaaactgcgggtgtgacccccccgtggtggctctgggtgtctgcggaggagctgggggcggaagcatgaggctaacggcttggcttcagtgaacgcaccgggatgtgcaggccgggaggtagaggcaggctgatgggggagggaacgagcagcctgtgagacggggtgacggcggctaccagcccgggcgggcaccgggactggaagagttgcctgagcagccggctggtccggcggccaggctagggcgggggcgagcgcccagttgagcctgctggggctggaggagcgagaagggttttcttcacatttcagagcgaaccagacggggacagtaaggtttggaggaagggggatcgttggaagtagcaagaagtggagagaatctggcaatagacgagaaaccgaaagaatcagaaagaagtctatgtgagtagctgaaagcattgggtgaccagaaagaaggtcggtgtaagtgaaggaagagtgaggtgtggctggatcaaagggctaagagaagcgggtctgtgtaagtggatgtgagtgaggatcaaggaaaagccgtggaagtggccgggggtcggggccgcagaagtgccagacggggccggaaagcagccgagcggagttcaaatttgagagcgtttggaaattggaagacttggtggcgaacgagggtcaggacctgcatcctgcctcagagagttatcgacgtatccggaatgtgggatcagaggctggtgaggttggccctgttgcagcatctgcgggccttctatggtattaaggtgaagggtgtccgtgggcagtgcgatcgcaggagacatgaaacagcagccacggaaatagggggtaaaatatttggagtaccttttaatgcactgccccattctgctgtaccagaatatggacacattccaagctttcttgtcgatgcttgcacatctttagaagaccatattcataccgaagggctttttcggaaatcaggatctgtgattcgcctaaaagcactaaagaataaagtggatcatggtgaaggttgcctatcttctgcacctccttgtgatattgcgggacttcttaagcagttttttagggaactgccagagcccattctcccagctgatttgcatgaagcacttttgaaagctcaacagttaggcacagaggaaaagaataaagctacactgttgctctcctgtcttctggctgaccacacagttcatgtattaagatacttctttaactttctcaggaatgtttctcttagatccagtgagaataagatggacagcagcaatcttgcagtaatatttgcaccgaatcttcttcagacaagtgaaggacatgaaaagatgtcttctaacacagaaaagaagctacgattacaggctgcagtagtacagactcttatcgattatgcatcagatattgggcgtgtaccagattttatcctggaaaagataccagccatgttgggtattgatggtctctgtgctactccatcactggaaggctttgaagaaggtgaatatgaaactcctggtgaatataagagaaagagaagacaaagtgtaggagattttgttagtggagcactaaataaatttaaacctaacagaacaccttctattacacctcaagaagaaagaattgcccagctatctgaatcaccagtgattcttacaccaaatgctaagcgtacattgccagtagattcttctcatggtttctcaagtaagaaaaggaagtccatcaagcacaattttaactttgagctgttgccaagtaatctcttcaatagcagttctacaccggtatcagttcacatcgatacaagctcagaagggtcatctcagagttcactctctcctgtactcattggtggaaaccatttgatcactgcaggtgtgccaaggcgaagtaaaagaattgcaggcaaaaaagtttgcagagtggaatcaggaaaagcaggctgcttttctcctaaaatcagccataaagaaaaggttcgaagatctctgcgtttgaaattcaatctagggaaaaatggcagagaagtaaatggatgttctggtgtcaatagatatgaaagtgttggttggcgacttgcaaatcaacaaagtttaaaaaatcgaattgaatctgtaaaaacaggtttgctttttagcccagatgttgatgaaaagttaccaaagaaaggttcagaaaagatcagtaagtctgaggaaaccttactaactccagagcgactagttggaacaaattaccggatgtcttggacaggacctaataattcaagttttcaagaagtagatgcaaatgaagcttcttcaatggtggaaaatcttgaggtagaaaactctttggagcctgatattatggtagaaaagtcacctgctacttcatgtgaactcaccccttccaatttaaacaataagcataatagcaacataacaagtagccctcttagcggggatgaaaataacatgaccaaagagactttggtgaaagttcaaaaagcgttttctgaatctggaagtaatcttcacgcattgatgaatcagaggcagtcatcagtaactaatgtggggaaagtaaaattaactgaaccatcttatttagaagatagcccagaggaaaatctatttgaaactaatgatttgactatagtagaatcaaaggagaaatatgaacaccacactggtaaaggtgaaaaatgtttttcagagagggacttttcaccccttcaaactcaaacatttaatagagaaacaactataaaatgttattcaactcagatgaagatggaacatgaaaaagacattcattcaaatatgccaaaagattatttaagcaagcaagaattctccagtgatgaagaaataaagaaacagcagtccccaaaggataaactaaataataaattaaaagagaatgagaatatgatggaaggtaacttaccgaagtgtgcagcacatagcaaggacgaggctagatcctctttctcacagcagagtacatgtgttgtaacaaacttgtcaaaacctaggcctatgagaattgctaaacagcagtcattggaaacatgtgagaaaacagtttctgaaagttcacaaatgacagaacatagaaaggtttctgatcacatacagtggtttaacaagctttctttaaatgaaccaaatagaataaaagtcaagtcacctcttaagtttcagcgtactcctgttcgtcagtccgtcagaagaattaattctttgttggagtatagcagacaacctacagggcataagttggcgagtcttggtgatacagcttctcctttggtcaaatcagtgagctgtgacggtgctctttcctcttgtatagaaagtgcatcaaaagattcctctgtttcatgtatcaaatcaggtcctaaagaacagaagtccatgtcatgtgaagagtcaaatattggtgcaatttcaaagtcaagcatggagttaccctcgaaatctttcttaaagatgaggaagcacccagattcagtgaatgcttctcttaggtctactacagtttataaacagaagatcttatctgatggccaagttaaggttcccttggatgatctgactaatcatgatatagtaaaaccagttgtaaataacaacatgggcatttcttctgggataaataacagggtccttaggagaccatcagaaagaggaagggcctggtacaaaggttctccaaaacatcctatcggaaaaactcaattactaccaacaagtaaacctgtagatttgtaattggtaaatgttatacttgtcattaatgtaaataaagtgagtaattggtatgacttgcaggatgatgtacatgttagtttgtagctcaggatgattgttaagcaatagatttgctctattgaaaatgtttcatttttttcactgtacaagcaacttagatttttatttgtacaaattacttctttgtttttcttaatgatggcaatttttaaactttaattttattgtgatctcttaaagcagaggttagactttacctttctgactctgtcgtccaggctggagtgcagtggcgcaatctcactgcaagctccacttcctgggttcatgccattttcctgcctcagcctcccgagtagctgggactacaggtgcccgccaccacgcccagctaattttttgtatttttagtagagacggtttcaccgtgttagccaggatggtctcgatctcctgaccttgtgatccgcccgcctcagcctcccaaagtgctgggattacaggcatgagccaccacgcccggctagactttacctttctaaagaaattgtttactggatttataagaagttaatttttgaaaatgacatatttttgtgtgatagaaagaatggagcaagttgtgcctatttcctccaagtcagataaggtttctaaaataaataaatttctagcatataaagggtagagataaactctgcaaatcttatgtctggaattatattaatgtttattgtccttgccaaaattcctagaaattaatttccttcaatagcatcctaaaactctatttttatttggggcagagtaatttcatttatagtgccagtaggtgtaccttgtgttcactcgaactaagaacaatggttaaggcagaataatgactaaaatatgttcatatattatgatgtggaaataattgataacttttaagccatactatgtttttaaagataatttgcacaaacacgtttgtgtctgttctgtccaatatagatttggcaattatttaaagagggataatcttgaaaaaaattaaccaaggtgatttcttatatgtagatgctcgattttggaatttgaaatagtagatgcacctctttaccttttttacttggataaaaacctatgatgattttgtcctgtgtgtaaatgttatttatttagcatagacattaaagataactctctggaaaatgacttgactaaggctctcatgaaattcaaagtgccatttagaacatgcaccaaattgtcaagtaaatctgtctaaatttatattttaaattattacaaattacacatctttgaggaaagagtattatgaacaatagaacatattctctaggttgtagaggaaggaataagcagacagaatcaaccactaaaggtagtttttcagattggttgttagaatgtcatgtttagatgttggagcagattagagcagcattcatgccactcggagcaaccagacttacagcataagtatgtacgaggaatttcaaatcatcagatgtttgcttggctaggttctactttgtttatttgatatcaaataggtttgtagatgtttatggcatttctaattgtaagtagagacaaaatattcatatagtcagatatatgttgtctgctttaaacaatttttaaattttaaaaatgcattaacgtctttttatatccatcaagggaaggatgaaatgttgaatttgaagactaattcagtaagaagtcctaggggtttaactgtacatactacctgaactggcttttctgagagatgaatcaataatgaaacatgtctgttttaaaaactacc

SEQ ID NO: 5558 - DNA, 3889 bp, Homo sapiens
gagactgagtattctaccttgtaaatactgttatttgtatatactgtaaatgatgacatcggtgggcactaaccgagcccggggaaactgggaacaacctcaaaaccaaaaccagacacagcacaagcagcggccacaggccactgcagaacaaattagacttgcacagatgatttcggaccataatgatgctgactttgaggagaaggtgaaacaattgattgatattacaggcaagaaccaggatgaatgtgtgattgctttgcatgactgcaatggagatgtcaacagagctatcaatgttcttctggaaggaaacccagacacgcattcctgggagatggtcgggaagaagaagggagtctcaggccagaaggatggtggccagacggaatccaatgaggaaggcaaagaaaatcgagaccgggacagagactatagtcggcgacgtggtgggccaccaagacgggggagaggtgccagccgtggacgagagtttcgaggtcaggaaaatggattggatggcaccaagagtggagggccttctggaagaggaacagaaagaggcagaaggggccgtggccgaggcagaggtggctctggtaggcgaggaggaaggttttctgctcaaggaatgggaacctttaacccagctgattatgcagagccagccaatactgatgataactatggcaatagcagcggcaatacgtggaacaacactggccactttgaaccagatgatgggacgagtgcatggaggactgcaacagaggagtgggggactgaagattggaatgaagatctttctgagaccaagatcttcactgcctctaatgtgtcttcagtgcctctgcctgcggagaatgtgacaatcactgctggtcagagaattgaccttgctgttctgctggggaagacaccatctacaatggagaatgattcatctaatctggatccgtctcaggctccttctctggcccagcctctggtgttcagtaattcgaagcagactgccatatcacagcctgcttcagggaacacattttctcatcacagtatggtgagcatgttagggaaaggatttggtgatgtcggtgaagctaaaggcggcagtactacaggctcccagttcttggagcaattcaagactgcccaagccctggctcagttggcagctcagcattctcagtctggaagcaccaccacctcctcttgggacatgggctcgacgacacaatccccatcactggtgcagtatgatttgaagaacccaagtgattcagcagtgcacagcccctttacaaagcgccaggcttttaccccatcttcaaccatgatggaggtgttccttcaggagaagtcacctgcagtggctacctccacagctgcacctccacctccgtcttctcctctgccaagcaaatccacatcggctccacagatgtcgcctggatcttcagacaaccagtcctctagccctcagccggctcaccagaaactgaaacagcagaagaaaaaagcctccttgacttctaagattcctgctctggctgtggagatgcctggctcagcagatatctcagggctaaacctgcagtttggggcattgcagtttgggtcagagcctgtcctttctgattatgagtccacccccaccacgagcgcctcttcaagccaggctccaagtagcctgtataccagcacggccagtgaatcatcctctacaatttcatctaaccagagtcaggagtctggttatcagagcggcccaattcagtcgacaacctatacctcccaaaataatgctcagggccctctttatgaacagagatccacacagactcggcggtaccccagctccatctcttcatcaccccaaaaggacctgactcaggcaaagaatggcttcagttctgtgcaggccacgcagttacagaccacacaatctgttgaaggtgctacaggctctgcagtgaaatctgattcaccttccacttctagcatcccccctctcaatgaaacggtatctgcagcttccttactgacgacaaccaatcagcattcatcctccttgggtggcttgagccacagtgaggagattccaaatactaccaccacacaacacagcagcacgttatctacgcagcagaataccctttcatcatcaacatcttctgggcgcacttcgacatccactcttttgcacacaagtgtggagagtgaggcgaatctccattcttcctccagcactttttccaccacatccagcacagtctctgcacctcccccagtggtcagtgtctcctccagtctcaatagtggcagtagcctgggcctcagcctaggcagcaactccactgtcacagcctcgactcgaagctcagttgctacgacttcaggaaaagctcctcccaacctccctcctggggtcccgccgttgttgcctaatccgtatattatggctccagggctgttacatgcctacccgccacaagtatatggttatgatgacttgcagatgcttcagacaagatttccattggattactacagcatcccatttcccacacccactactccgctgactgggagggatggtagcctggccagcaacccttattctggtgacctcacaaagttcggccgtggggatgcctcctccccagccccggccacaaccttggcccaaccccaacagaaccagacgcagactcaccataccacgcagcagacattcctgaacccggcgctgcctcctggctacagttacaccagcctgccatactatacaggggtcccgggcctccccagcaccttccagtatgggcctgctgtgttccctgtggctcctacctcttccaagcagcatggtgtgaatgtcagtgtgaatgcatcggccacccctttccaacagccgagtggatatgggtctcatggatacaacactggtgtttcagtcacctccagtaacacgggcgtgccagatatctcgggttctgtgtactccaaaacccagcagtcctttgagaaacaaggttttcattccggtactcctgctgcttccttcaacttgccttcagccctaggaagtgggggccccatcaatccggccacagctgctgcctacccacctgccccctttatgcacattctgaccccccatcagcagccgcattctcagatccttcaccatcacctgcagcaggatggccagacgggcagcgggcaacgtagccagaccagctccatcccgcagaagccccagaccaacaagtctgcctacaacagctacagctggggggccaactgaggccctgaccctcttctcccggtcccatcttctgagagggcttctcagcctggaaactatggaaacagcatcaaagagaaaggaatgtggggggtttccgctgccccccacccccagcggcccaccccatgcctcagcttcatgtctgtcccattcctataccatccccaccctgttgtatgtattataggatttgtattttctccttttttttcccccttccattccttctcccctcttgcattcaagattatgaaactttgctatgggccctgcacttcctttgcttcctcctgttcaccctggtggtgtacggatgaggcggggaggtgggacccccaaacatatatcagcccaacagccctaagtctccttctttattattaggaaaacaacaacaacaacaaacaaaaaaatggcgtcatgaatatgaacagcattgtcagatgaattagttgaagtggttttttttttgtttttttttttttttttgtactgtgtcctcaaatttaatggattaatgtgtcttgtatatataaaaagaaaacctctaccttcaaaaaaaaaaaaaaaaaa

SEQ ID NO: 5559 - DNA, 5858 bp, Homo sapiens
ccttccagccatgtgggttcagcggaaagagaagcaaaaccactcttcctaaaatgttagaagctgctcttcgcttaccttggggcctttgcattgggagctgtttttcacatcaaagaatatgtgctgaatggaattttagtattttgctgtcgttttaatattttcgtctggtcttcctcagttcttccagacgctttctgagagaatgggggcaggagctctagccatctgtcaaagtaaagcagcggttcggctgaaagaagacatgaaaaagatagtggcagtgccattaaatgaacagaaggattttacctatcagaagttatttggagtcagtctccaagaacttgaacggcaggggctcaccgagaatggcattccagcagtagtgtggaatatagtggaatatttgacgcagcatggacttacccaagaaggtctttttagggtgaatggtaacgtgaaggtggtggaacaacttcgactgaagttcgagagtggagtgcccgtggagctcgggaaggacggtgatgtctgctcagcagccagtctgttgaagctgtttctgagggagctgcctgacagtctgatcacctcagcgttgcagcctcgattcattcaactctttcaggatggcagaaatgatgttcaggagagtagcttaagagacttaataaaagagctgccagacacccactactgcctcctcaagtacctttgccagttcttgacaaaagtagccaagcatcatgtgcagaatcgcatgaatgttcacaatctcgccactgtatttgggccaaattgctttcatgtgccacctgggcttgaaggcatgaaggaacaggacctgtgcaacaagataatggctaaaattctagaaaattacaataccctgtttgaagtagagtatacagaaaatgatcatctgagatgtgaaaacctggctaggcttatcatagtaaaagaggtctattataagaactccctgcccatccttttaacaagaggcttagaaagagacatgccaaaaccacctccaaaaaccaagatcccaaaatccaggagtgagggatctattcaggcccacagagtactgcaaccagagctatctgatggcattcctcagctcagcttgcggctaagttatagaaaagcctgcttggaagacatgaattcagcagagggtgctattagtgccaagttggtacccagttcacaggaagatgaaagacctctgtcacctttctatttgagtgctcatgtaccccaagtcagcaatgtgtctgcaaccggagaactcttagaaagaaccatccgatcagctgtagaacaacatctttttgatgttaataactctggaggtcaaagttcagaggactcagaatctggaacactatcagcatcttctgccacatctgccagacagcgccgccgccagtccaaggagcaggatgaagttcgacatgggagagacaagggacttatcaacaaagaaaatactccttctgggttcaaccaccttgatgattgtattttgaatactcaggaagtcgaaaaggtacacaaaaatacttttggttgtgctggagaaaggagcaagcctaaacgtcagaaatccagtactaaactttctgagcttcatgacaatcaggacggtcttgtgaatatggaaagtctcaattccacacgatctcatgagagaactggacctgatgattttgaatggatgtctgatgaaaggaaaggaaatgaaaaagatggtggacacactcagcattttgagagccccacaatgaagatccaggagcatcccagcctatctgacaccaaacagcagagaaatcaagatgccggtgaccaggaggagagctttgtctccgaagtgccccagtcggacctgactgcattgtgtgatgaaaagaactgggaagagcctatccctgctttctcctcctggcagcgggagaacagtgactctgatgaagcccacctctcgccgcaggctgggcgcctgatccgtcagctgctggacgaagacagcgaccccatgctctctcctcggttctacgcttatgggcagagcaggcaatacctggatgacacagaagtgcctccttccccaccaaactcccattctttcatgaggcggcgaagctcctctctggggtcctatgatgatgagcaagaggacctgacacctgcccagctcacacgaaggattcagagccttaaaaagaagatccggaagtttgaagatagattcgaagaagagaagaagtacagaccttcccacagtgacaaagcagccaatccggaggttctgaaatggacaaatgaccttgccaaattccggagacaacttaaagaatcaaaactaaagatatctgaagaggacctaactcccaggatgcggcagcgaagcaacacactccccaagagttttggttcccaacttgagaaagaagatgagaagaagcaagagctggtggataaagcaataaagcccagtgttgaagccacattggaatctattcagaggaagctccaggagaagcgagcggaaagcagccgccctgaggacattaaggatatgaccaaagaccagattgctaatgagaaagtggctctgcagaaagctctgttatattatgaaagcattcatggacggccggtaacaaagaacgaacggcaggtgatgaagccactatacgacaggtaccggctggtcaaacagatcctctcccgagctaacaccatacccatcattggttccccctccagcaagcggagaagccctttgctgcagccaattatcgagggcgaaactgcttccttcttcaaggagataaaggaagaagaggaggggtcagaagacgatagcaatgtgaagccagacttcatggtcactctgaaaaccgatttcagtgcacgatgctttctggaccaattcgaagatgacgctgatggatttatttccccaatggatgataaaataccatcaaaatgcagccaggacacagggctttcaaatctccatgctgcctcaatacctgaactcctggaacacctccaggaaatgagagaagaaaagaaaaggattcgaaagaaacttcgggattttgaagacaactttttcagacagaatggaagaaatgtccagaaggaagaccgcactcctatggctgaagaatacagtgaatataagcacataaaggcgaaactgaggctcctggaggtgctcatcagcaagagagacactgattccaagtccatgtgaggggcatggccaagcacagggggctggcagctgcggtgagagtttactgtccccagagaaagtgcagctctggaaggcagccttggggctggccctgcaaagcatgcagcccttctgcctctagaccatttggcatcggctcctgtttccattgcctgccttagaaactggctggaagaagacaatgtgacctgacttaggcattttgtaattggaaagtcaagactgcagtatgtgcacatgcgcacgcgcatgcacgcacacacacacacagtagtggagctttcctaacactagcagagattaatcactacattagacaacactcatctacagagaatatacactgttcttccctggataactgagaaacaagagaccattctctgtctaactgtgataaaaacaagctcaggactttattctatagagcaaacttgctgtggagggccatgctctccttggacccagttaactgcaaacgtgcattggagccctatttgctgccgctgccattctagtgacctttccacagagctgcgccttcctcacgtgtgtgaaaggttttccccttcagccctcaggtagatggaagctgcatctgcccacgatggcagtgcagtcatcatcttcaggatgtttcttcaggacttcctcagctgacaaggaattttggtccctgcctaggaccgggtcatctgcagaggacagagagatggtaagcagctgtatgaatgctgattttaaaaccaggtcatgggagaagagcctggagattctttcctgaacactgactgcacttaccagtctgattttatcgtcaaacaccaagccaggctagcatgctcatggcaatctgtttggggctgttttgttgtggcactagccaaacataaaggggcttaagtcagcctgcatacagaggatcggggagagaaggggcctgtgttctcagcctcctgagtacttaccagagtttaatttttttaaaaaaaatctgcactaaaatccccaaactgacaggtaaatgtagccctcagagctcagcccaaggcagaatctaaatcacactattttcgagatcatgtataaaaagaaaaaaaagaagtcatgctgtgtggccaattataatttttttcaaagactttgtcacaaaactgtctatattagacattttggagggaccaggaaatgtaagacaccaaatcctccatctcttcagtgtgcctgatgtcacctcatgatttgctgttacttttttaactcctgcgccaaggacagtgggttctgtgtccacctttgtgctttgcgaggccgagcccaggcatctgctcgcctgccacggctgaccagagaaggtgcttcaggagctctgccttagacgacgtgttacagtatgaacacacagcagaggcaccctcgtatgttttgaaagttgccttctgaaagggcacagttttaaggaaaagaaaaagaatgtaaaactatactgacccgttttcagttttaaagggtcgtgagaaactggctggtccaatgggatttacagcaacattttccattgctgaagtgaggtagcagctctcttctgtcagctgaatgttaaggatggggaaaaagaatgcctttaagtttgctcttaatcgtatggaagcttgagctatgtgttggaagtgccctggttttaatccatacacaaagacggtacataatcctacaggtttaaatgtacataaaaatatagtttggaattctttgctctactgtttacattgcagattgctataatttcaaggagtgagattataaataaaatgatgcactttaggatgtttcctatttttgaaatctgaacatgaatcattcacatgaccaaaaattgtgtttttttaaaaatacatgtctagtctgtcctttaatagctctcttaaataagctatgatattaatcagatcattaccagttagcttttaaagcacatttgtttaagactatgtttttggaaaaatacgctacagaatttttttttaagctacaaataaatgagatgctactaattgttttggaatctgttgtttctgccaaaggtaaattaactaaagatttattcaggaatccccatttgaatttgtatgattcaataaaagaaaacaccaagtaagttatataaaataaattgtgtatgagatgttgtgttttcctttgtaatttccactaactaactaactaacttatattcttcatggaatggagcccagaagaaatgagaggaagcccttttcacactagatcttatttgaagaaatgtttgttagtcagtcagtcagtggtttctggctctgccgagggagatgtgttccccagcaaccatttctgcagcccagaatctcaaggcactagaggcggtgtcttaattaattggcttcacaaagacaaaatgctctggactgggatttttcctttgctgtgttgggaatatgtgtttattaattagcacatgccaacaaaataaatgtcaagagttatttcataagtgtaagtaaacttaagaattaaagagtgcagacttataattttc

SEQ ID NO: 5560 - DNA, 9035 bp, Homo sapiens
ggaggcgcgccccccggctgggcgccgcgcgcaccatggggctcccagcgctcgagttcagcgactgctgcctcgatagtccgcacttccgagagacgctcaagtcgcacgaagcagagctggacaagaccaacaaattcatcaaggagctcatcaaggacgggaagtcactcataagcgcgctcaagaatttgtcttcagcgaagcggaagtttgcagattccttaaatgaatttaaatttcagtgcataggagatgcagaaacagatgatgagatgtgtatagcaagatctttgcaggagtttgccactgtcctcaggaatcttgaagatgaacggatacggatgattgagaatgccagcgaggtgctcatcactcccttggagaagtttcgaaaggaacagatcggggctgccaaggaagccaaaaagaagtatgacaaagagacagaaaagtattgtggcatcttagaaaaacacttgaatttgtcttccaaaaagaaagaatctcagcttcaggaggcagacagccaagtggacctggtccggcagcatttctatgaagtatccctggaatatgtcttcaaggtgcaggaagtccaagagagaaagatgtttgagtttgtggagcctctgctggccttcctgcaaggactcttcactttctatcaccatggttacgaactggccaaggatttcggggacttcaagacacagttaaccattagcatacagaacacaagaaatcgctttgaaggcactagatcagaagtggaatcactgatgaaaaagatgaaggagaatccccttgagcacaagaccatcagtccctacaccatggagggatacctctacgtgcaggagaaacgtcactttggaacttcttgggtgaagcactactgtacatatcaacgggattccaaacaaatcaccatggtaccatttgaccaaaagtcaggaggaaaagggggagaagatgaatcagttatcctcaaatcctgcacacggcggaaaacagactccattgagaagaggttttgctttgatgtggaagcagtagacaggccaggggttatcaccatgcaagctttgtcggaagaggaccggaggctctggatggaagccatggatggccgggaacctgtctacaactcgaacaaagacagccagagtgaagggactgcgcagttggacagcattggcttcagcataatcaggaaatgcatccatgctgtggaaaccagagggatcaacgagcaagggctgtatcgaattgtgggtgtcaactccagagtgcagaagttgctgagtgtcctgatggaccccaagactgcttctgagacagaaacagatatctgtgctgaatgggagataaagaccatcactagtgctctgaagacctacctaagaatgcttccaggaccactcatgatgtaccagtttcaaagaagtttcatcaaagcagcaaaactggagaaccaggagtctcgggtctctgaaatccacagccttgttcatcggctcccagagaaaaatcggcagatgttacagctgctcatgaaccacttggcaaatgttgctaacaaccacaagcagaatttgatgacggtggcaaaccttggtgtggtgtttggacccactctgctgaggcctcaggaagaaacagtagcagccatcatggacatcaaatttcagaacattgtcattgagatcctaatagaaaaccacgaaaagatatttaacaccgtgcccgatatgcctctcaccaatgcccagctgcacctgtctcggaagaagagcagtgactccaagcccccgtcctgcagcgagaggcccctgacgctcttccacaccgttcagtcaacagagaaacaggaacaaaggaacagcatcatcaactccagtttggaatctgtctcatcaaatccaaacagcatccttaattccagcagcagcttacagcccaacatgaactccagtgacccagacctggctgtggtcaaacccacccggcccaactcactccccccgaatccaagcccaacttcacccctctcgccatcttggcccatgttctcggcgccatccagccctatgcccacctcatccacgtccagcgactcatcccccgtcaggtctgttgcagggtttgtttggttttctgttgctgccgttgttctctcattggctcggtcctctcttcatgcagtgttcagcctcctcgtcaactttgttccctgccatccaaacctgcacttgctttttgacaggccagaagaagcggtacatgaagactccagcacaccgttccggaaggcaaaagccttgtatgcctgcaaagctgaacatgactcagaactttcgttcacagcaggcacggtcttcgataatgttcacccatctcaggagcctggctggttggaggggactctgaacggaaagactggcctcatccctgagaattacgtggagttcctctaaccgtgggccccagcagaactgctgagctttacatggtatccatgacaactgctgattccagtgtcgaggccatttctctttgccactgagaaatgcagcgtgactgactctgttgctacctgtcaacatgaatgtttctgtgagctctggtgtcactcatctccatgatcatctcagccaacatgcatcagtactgcaagaaaagaagtcaatcagcagaggagagcatttgataactaagaggaagacttgcaaagccgttttctcatgagtaccctgaatagggggcactcattttgtttcaacggtccaaacgcccaaccttcagaaagaggaagtcagatagaaatagtccctgagagcacactgtgtagctaagcctgctggggctgggtgaagaaattggcgctgagatccaggctggatccattgcttttgtttacaataggcactctctctaccccacctctcagtacttgagacttaaagtgctacaggcagctggatctgtttgcatgcaggatgaagagggttaaaacactgtttatataagatccaatctctcaccatctctaaagcagccgttggcctgtcatcagtgagatacaatccagtcttctcatgcacgggaacacacacaccctgcgtttctccctcccaggctaggaacctctctgccaccaagggctgccatccatcgcctagtaaccacggcaacccaacctactctaaaaccaaaccaaaaaaataaaataacacatcctctttgcatgacacattttttttctcccctttttggtacactttttttgaatggttttctaacaacttgaagcacaggatcaaggaattagggtggtctacttgaggcagatgggatagtagctgggaactgttccctttctgattaatttcagcagcatcggaatatatttggagcacaccctagtaacctcttgagattaaattacatagtcttaatatttctgttcctccatgcaactgatgtttgttttttaaagggtaagatgctgcctcccaatgggtgatgccatctgactggtttccccatgtcctcccattcacccatctctgctcccacccttgcctgcctctaacccaccactggccagcccccttgccctactctgggctgctgaacactggtgctgtggtggttttcaaggttaattcctaggctaaccgtatggcctatagtttaaaagcacatctatgttcactgccactctgaaaaagggaattatttctcagtctttcaaggcttgagactaatataggccattgtgattcaggaagaaacccaaggttggagggtgggatgagtaccctctgaaaaagggaatttgctggtgaaaagaggctggatcttgtggaagactgtcttggatggggaagtactacctggagatttcaaattcacttggcctgcaaacaacagagttatccgtatcttccacatgtgaatgtcattgcaagggtgactctagacaaactacaaaccgatggaccgtcaagctccccaggagccccttggatggcagcgttgcttcagagtgtttcctgtttctggaattccttgttagggaactttaaagaagaaaagaaaaacttgaattgtgttgaattactgtatcttttacttttttttttttgaaaagataaacttgtaaatagagtgatttgaaatactatatggcaaagttttatatttgatattctttaagttagttgctcacacacttaggctttgattgctgaagaagtatgtttaagagggagagaggggaggcaaagctgaagagagtcaaggtcactgtccccgcttcggcctgaaggaaagagaagacatttctatggccttgctctctgctgtcctgttggtgggcacgacacatcagtggtgttcagtctttatgtgtttttaagcatcccttgggctttggatttggagatgggaagagcatctccaggcaatgagtttttcaaagaatgcctacttagtagtaagatgaagctcaggatttaaataagtggggtcaggcattcgagtttttgtctttcttctcaggtgtatttcttggtacccccaagatatcaggccagaaagagatgagtcagttgctgtgctctttacttctttttctccacatcttctgaggctttagaaatgtggacaagctagttttcaaattttgtgtgcgtctgtaagttcttaaagaaccagcttcttagaatgttcagttctcaatgtgctgctgctttcccttctcctaaacattttaaaactcttccctttcacctccaattcccgtgatcccaaaagaagaggaagactccaggaggggtatagattgtgccgtcatagctttacaggtggttttaaagttaacaggggtttgtcatggtgattcactactcagtttatcagctcaaggattatacagctcttttccgggaactcacccaggagcaagcgagacactaccattgaatcagggaatgagaattaagaatggacaggaccaagacagaactcaagaaagccactggggaaaactcgagaagaaagggagtatactagtaggttagatctgtgaacctgaggacaagaagaccttgggaaatggaggcctcaggggatgtgcattcacatactattacgcttctcaaagagagaccaacatcatgcttttaacacatttgatgaggttttttatttgtgtttttgtttgttttttgagatggagtctcactctgtggcccaggctggagtgcagtggcgcaatcttggctcactgcaacctccacctcccaggttcaagtgattctcctgtctcagcctcccaagtagctgggactacaggcatgagccatcacacccagctagttttttgtatttttagtaaagatggggttttgccatgtttgccaggctgatctcgaactcctgacctcaagtgatctgcccacttcagacccccaaagtgctgggattccaggtgtgagccgctgcggccgaccacatttgatgtttgaagttgtaatctgtcccatcataaacttacctggagctcatgtggaggaacagaaggccaagatccttgctttgggggtgcctcacgaagcatccctgtagacatttggccccagcttcactgcttggaagcatgtccctccctcttgagttggctctgatttgaaatcgggagaaacagagctgctgccaatgggatcttttaggtaactccctccctagcttccgtgtgtctgtgcagtgcccatgagctgctgccaatgggatctttcaggtaccccctccccagcttccctgtggctgtgcggtgcccttgacagatggcttctctgtttccctttgcccagccaggctcccctccttcctattagctacaaaactggataaacttcagaatatgagccaatgagtaggaaggaacttgaagactaaagattttactctctcccctatccatgccccctacctctgactctctctgtgtgaacaggaaactttagggcagatgaggagaatgaattggttatcagagtggaagaccatggcccaggatccctgagctttcccagtagcctccagtttcctttgtaagacccagggatcacttagccatagcctgaatcttttaggggtattaaggtcagcctctcactcttccttcaggttactaacaaaatttcgtagctaaagaatgccatggccgggtgcagtggctcacgcctataatcccagcactttgggaggccgaggcgggcggatcacgaggtcaggagattgagaccatcctggctacgacggtgaaaccccgtctctactaaaaatacaaaaaattagccgggtgtggtggcgggcgcctgtagtcccagctactctggaggctgaggcaggagaatggcatgaacccaggaggcagagattgcagtgagccaagatcacgcccctgcactccagcctgggtgacagagccagactccgtctcaaaggaaaaaaaaaaaaaaaaaaaaagaatgccatgccaggagaagacagctggtttcaaatccctgcccccaggcaagtaaaaccctgacttgctcaagacagaagatcttttctcctgtttttcaaaataaacatatatagggatggaccctgtgcattgtggcctgccttggtgtcctagaattggagccagtctttagcttaatgtctgaagtatttatacggccaatatgtgttttcttatgtcagaccacactgtctttttgaatatcagttcatttcctctcaccgagtgcttttcggtgagaggcaaagagaaagaatgaacaatcaagtattgacagactggcattagcaggacagagccatactagtgacaagggcatcccaaggcacttgcccagagctgcagagttgtgtgtgccatacctgcggctcaaagggaaggccttctatcccctgagtttctatcagctgaaaatggcaactgctgtctcagtaaaagctctgtcttgactgcagaggctccaaaagcattcacagttgagggggagaaagacagaaagaagaagccaaagataacctgatccctgcctgtctgttggcacctgtcatcctctggcttctgctcccaaaagcaagtctggatgactgagttttgtggacatggcactcccggagacagcagtggccaccatggcacccagagtttgcccaagtactgaatgttttgtgagcaaccatgttccccaagtaggtagccagcgctgcagaaaccaaacagcctcttagctacctgactttaaaaggaatgacctaggtgttctgccaaaggagttatctatcatctctggcaaacttgacaatcatcacttacctcgacaaccctgccccacatcactttataaagtcagcaggatgtcttctcacccaccctgtgctggtgtctaacaaatttatcttgtcatgctcaaatgtgtttggcagccacaccgatcggctgggtgctgaaccgcctctctgtaattgtagcatcaaaatgacaacagcagcagagcagcgaatcttgcacagccccacagcatgcctgagacaagactccaacaagtaataattagctttttttctcctgccgcctacagtacctgtctaactaaagagcttcccaaagtggagggaaaggccatagaatccaggtgtcattcagagccagtccttgctgaaatgtggtcttccagtggaagcacctgtattattgagaggaaaaagtgttggatgcaaagtaacaccaggactagagagaaagagaaaggtgaaccatcctaaggagctttggatacttttttagaaggataaatattatgcttactgaggagaaaaaaaaaagcgatcacagaaaaatttcacagctaatatttttacaaaagttgtgccagacattacagagtgaaaacgtctctcaaggtggaatgctttagagagcaaaggcttagcatagacctagacccttgtgtgggtatgacatgacatgacatgtccatgtcaaaattcactttagtcagaaccagagtattgataaacaaaatgtcagttacctggagcagtcctggagaggttaagacattctatactgttctacgtcaaccatttctacaaagttgtccagacacctaaaagcagctttcttggttatccagatgccagaatcaaccttgtatctgacaatgcacatctgttgattctaaagtatatttatgtgtgtgtgtatgtgtgtgtatacagcacatatttacatctatgaagacatagacacttacagagacccacatgagctggcactttctgagcctttacagcctttaagactcggaggttgagaattagagacacaagagaggctgtggatggcctattaaaatgattaaagatgtaaattcagtgccattttaaaactgttcatatttatcaaacaattactgtctacagctacattttttgttaacttacttaaagtcatgtcgcaagaaagatcaaacccatgaatgcttagtagctaaggctagtgttcaaaagcactctaaaagacattttgtccacattttggaaaagaaaatatttgcatgtttaattcataatttaggctatctttgagtatactgtaaagtgctgtgtgatataatatcaataaagtactttggcactttaatgttttcttttaaaataacgcactgttctaaacttcagtattgactattgactcgtgcatagaatccaatgctgtaattagaaagtaatctgtgactagaatagacctttgtccctgttagtagccctgttgccatgttcaggcttttaaaaaatgcttttgtgtcaccaaatatatctataaagaaaacaaaatttctgttcagaggcctctgaaacttggctttcttacatgtggttggtttatgtgacaatccctatgaaatgagtggacgtatgatttttgaattaaatgacttttccatttggtggta

SEQ ID NO: 5561 - DNA, 2699 bp, Homo sapiens
aagcccctccccttctctgggccttgatttcccctcctgctcagtggggacgttcttggtcctccttcttgcccactctacccagtcgccgagtctggcgaagcagagctgtctgggggtcaccgcagcaggagggaccgagcttagatacgaaaaaagacttctacacggcaagagccacagaaaggacgctccagctggctcagcagaggggcatctctccctttcaagaacaaaaggtggcaggtacccgggggccctggggcagaacgaggtaaattctgcacggacttccacatctaagaccccagaaatctccagccggctccctccgaccgaatgagaccgtgctgcaccagttctgctgcccagccgccgacgcctgctccgacctggcctcccaaagattgaaatgctagaacataagtacggcggtcacctggtgtcccggcgcgccgcttgcaccatccaaaccgccttccgccaataccagctcagcaagaacttcgagaaaatccgcaactcgcttctggagagccgcctgccacggcggatctccctgcgcaaggtgcggtcacccacggccgagagcctggcggccgagaaagcgctcatggagggctacggcctcgtggggctgccgctggtgcgctcgccctccctgccgcccaccttcgcaggcaccctcaccgagctggaggactccttcaccgagcaggtgcaatccctggccaagtccatcgacgacgcgctcagcacgtggagcctcaagaccatgtgctccctgcgggagagtggcgcttaccagctccaccaggccctgcaggcggccgcggggcccccaggcctggaggccgaggggcgggcgccggagagcgcgggccccgggcccggggatgacgccgcggagacccccggcctgcccccggcccacagcgggaccctcatgatggctttccgggacgtcacggtgcagatcgccaaccagaacatatccgtctcctcctccacggctctgtcggtggccaactgcctgggcgctcagacggtccaggcccccgcagagcccgcggcgggcaaggccgagcagggcgagacctctgggcgggaggccccggaagcccccgccgtgggccgggaggacgcgtcagccgaggactcatgcgcagaggctgcggctagtggggcggcggatggggccacagcccccaaaacagaggaggaagaggaggaggaggagacggcggaggtggggagaggggccgaggccgaggcaggcgacttggagcagctgagcagcagcagcacgtccaccaagtccgccaagtcaggctcggaggcgtcggcctccgcctccaaggacgccctgcaggccatgatcctgagcctgccgcgctaccactgcgagaacccagccagctgcaagtcgcccacgctctccaccgacaccctgcgcaagcggctctaccgcatcggcctcaacctcttcaacataaaccccgacaagggcatccagttcctgatctcacgcggcttcatcccggacacccccatcggtgtggcccatttcctcctccagcgaaagggcctcagccgccagatgattggagagttcctgggcaacagcaagaagcagttcaaccgcgacgtgctggactgcgtggtggacgagatggacttctccagcatggagctggacgaggccctgcgcaagttccaggcacacatccgtgtgcagggggaggctcagaaggtggagcggctcattgaggccttcagccagcgctactgcatgtgcaaccccgaagtggttcagcagttccacaaccccgacaccatcttcatcctcgccttcgccatcatcctcctcaacaccgacatgtacagccccaacatcaagcctgaccggaagatgatgctggaggacttcatccgaaaccttcgaggtgtggacgatggcgctgacatccccagggagctggtggtaggcatctatgagaggatacagcagaaggagctcaagtccaatgaggaccacgtcacgtacgtcaccaaggtggagaagtccattgtgggcatgaagacagtgctgtccgtgccccaccgccgcctggtgtgctgcagccggctcttcgaggtgacggatgtgaacaagctgcagaagcaggcagcgcatcagagggaggtgttcctcttcaatgacctgctggtgattctcaaactttgcccgaagaagaagagctcctccacgtacaccttttgcaagtcagttggcctgctgggcatgcagttccagctctttgagaacgagtattactctcatggcatcacactggtgaccccgctctcgggctccgagaagaagcaggtgctgcatttctgtgccctgggctcggacgagatgcagaagttcgtggaggacctgaaggagtccattgctgaggtgacggagctggagcagatccgaatagagtgggagctggagaagcagcagggaacaaagacactctccttcaagccctgcggagcccagggggacccacagtcaaagcaaggatcgccgacagccaaaagggaagccgcgctcagggagaggccggcggagagcacggtggaggtattaatcaatgcctccccagcccgactcaccattttaccaatttcaagagatacaattaaaagttactgctagcatgggt

SEQ ID NO: 5562 - DNA, 6193 bp, Homo sapiens
gtttcagatttgggatattggtgtttctgttttggagaaattattctttttctttttaatttgaagaaaaatcatcagtcttggaatacagaagagaaactagaaatatacgtattttgtttcacatttgaacagtcattcttgaggaatactccatacctgagtagacagccatgtggccatcgcagctactaattttcatgatgctcttagctccaataattcatgctttcagccgtgccccaattccaatggctgtggtccgcagagagctatcctgtgagagctatcctatagagcttcgctgtccaggaacagacgtcatcatgatagaaagtgccaactatggcaggactgatgacaaaatttgtgactctgaccctgctcagatggagaatatccgatgttatctgccagatgcctataagattatgtctcaaagatgcaataacagaacccagtgtgcagtggtggcaggtcctgatgtttttccagacccgtgtccaggaacctataaataccttgaagtgcagtatgaatgtgtcccttacaaagtggaacaaaaagtttttctttgtcctggactactaaaaggagtataccagagtgaacatttgtttgagtccgaccaccaatctggggcgtggtgcaaagaccctctgcaggcatctgacaagatttattatatgccctggactccctacagaactgataccctgactgagtattcatccaaggatgacttcattgctggaagaccaactacaacctacaagctccctcacagggtggatggcacaggatttgtagtgtatgatggagctttgttcttcaacaaagagcgcaccaggaacatagtaaagtttgatttgcggactaggataaagagtggagaggctatcatagcaaatgccaattaccatgatacctccccttaccgatggggaggcaaatctgacatagacctggcagtagatgagaatgggctatgggtaatctatgcaacagaacaaaacaatggtaaaattgtcattagtcaattgaacccttacaccctacggatcgaaggaacatgggatactgcatatgataaaaggtcagcttccaatgcctttatgatttgtggaattctgtatgtggtcaaatctgtatatgaggatgatgacaatgaggctactggaaataagattgactacatttacaacactgaccaaagcaaggatagtttggtggatgtaccctttcctaattcataccagtacattgcagctgtggattacaaccccagggacaacctactttatgtatggaataactatcacgtcgtgaaatattctttggattttggacctctggatagtagatcagggcaggcacatcatggacaagtttcatacatttctccgccaattcaccttgactctgagctagaaagaccctctgttaaagatatctctaccacaggacctcttggcatgggaagcactaccaccagtaccacccttcggaccacaactttgagcccaggaaggagtaccaccccgtcagtgtcaggaagaagaaaccggagtactagtaccccatctccagctgtcgaggtacttgatgacatgaccacacaccttccatcagcatcgtcccaaatcccagctctcgaagagagctgtgaggctgtggaagcccgagaaatcatgtggtttaagactcgtcaaggacagatagcaaagcagccatgccctgcaggaactataggtgtatcaacttatctatgccttgctcctgatggaatttgggatccccaaggtccagatctcagcaactgttcttctccttgggtcaatcatataacacagaagttgaaatctggtgaaacagctgccaacattgctagagagctggctgaacagacaagaaatcacttgaatgctggggacatcacctactctgtccgggccatggaccagctggtaggcctcctagatgtacagcttcggaacttgaccccaggtggaaaagatagtgctgcccggagtttgaacaagcttcagaaaagagagcgctcttgcagagcctatgtccaggcaatggtcgagacagttaacaacctccttcagccacaagctttgaatgcatggagagacctgactacgagtgatcagctgcgtgcggccaccatgttgcttcatactgtggaggaaagtgcttttgtgctggctgataaccttttgaagactgacattgtcagggagaatacagacaatattaaattggaagttgcaagactgagcacagaaggaaacttagaagacctaaaatttccagaaaacatgggccatggaagcactatccagctgtctgcaaataccttaaagcaaaatggccgaaatggagagatcagagtggcctttgtcctgtataacaacttgggtccttatttatccacggagaatgccagtatgaagttgggaacggaagctttgtccacaaatcattctgttattgtcaattcccctgttattacggcagcaataaacaaagagttcagtaacaaggtttatttggctgatcctgtggtatttactgttaaacatatcaagcagtcagaggaaaatttcaaccctaactgttcattttggagctactccaagcgtacaatgacaggttattggtcaacacaaggctgtcggctcctgacaacaaataagacacatactacatgctcttgtaaccacctaacaaattttgcagtactgatggcacatgtggaagttaagcacagtgatgcggtccatgacctccttctggatgtgatcacgtgggttggaattttgctgtcccttgtttgtctcctgatttgcatcttcacattttgctttttccgggggctccagagtgaccgtaacaccatccacaagaacctctgcatcagtctctttgtagcagagctgctcttcctgattgggatcaaccgaactgaccaaccaattgcctgtgctgttttcgctgccctgttacatttcttcttcttggctgccttcacctggatgttcctggagggggtgcagctttatatcatgctggtggaggtttttgagagtgaacattcacgtaggaaatacttttatctggtcggctatgggatgcctgcactcattgtggctgtgtcagctgcagtagactacaggagttatggaacagataaagtatgttggctccgacttgacacctacttcatttggagttttataggaccagcaactttgataattatgcttaatgtaatcttccttgggattgctttatataaaatgtttcatcatactgctatactgaaacctgaatcaggctgtcttgataacatcaactatgaggataacagacccttcatcaagtcatgggttataggtgcaatagctcttctctgcctattaggattgacctgggcctttggactcatgtatattaatgaaagcacagtcatcatggcctatctcttcaccattttcaattctctacagggaatgtttatatttattttccattgtgtcctacagaagaaggtacgaaaagagtatgggaaatgcctgcgaacacattgctgtagtggcaaaagtacagagagttccattggttcagggaaaacatctggttctcgaactcctggacgctactccacaggctcacagagccgaatccgtagaatgtggaatgacacggttcgaaagcagtcagagtcttcctttattactggagacataaacagttcagcgtcactcaacagagagccctacagagagacaagtatgggagtaaagctaaacattgcatatcaaataggggcttctgaacaatgccagggatacaagtgtcatggatactctaccactgaatggtaaccatggcaatagttacagcattgccagcggcgaatacctgagcaactgtgtgcaaatcatagaccgtggctataaccataacgagaccgccctagagaaaaagattctgaaggaactcacttccaactatatcccttcttacctgaacaaccatgagcgctccagtgaacagaacaggaatctgatgaacaagctggtgaataaccttggcagtggaagggaagatgatgccattgtcctggatgatgccacctcgtttaaccacgaggagagtttgggcctggaactcattcatgaggaatctgatgctcctttgctgcccccaagagtatactccaccgagaaccaccagccacaccattataccagaaggcggatcccccaagaccacagtgagagctttttccctttgctaaccaacgagcacacagaagatctccagtcaccccatagagactctctctataccagcatgccgacactggctggtgtggccgccacagagagtgttaccaccagcacccagaccgaacccccaccggccaaatgtggtgatgccgaagatgtttactacaaaagcatgccaaacctaggctccagaaaccacgtccatcagctgcatacttactaccagctaggtcgcggcagcagtgatggatttatagttcctccaaacaaagatgggacccctcccgagggaagttcaaaaggaccggctcatttggtcactagtctatagaagatgacacagaaattggaaccaacaaaactgctaacaccttgttgactgttctgagttgatataagcagtggtaataatgtgtgtactcctaaatctttatgctgtcctctaaagacaaacacaaactctcagacttttttttttttaatgggatttttaggtcagcccaggggagaaagataactgctaaaattcccctgtaccccatcctttcttgtcctttccccttcagatggagacttcattatgttaatgaacaagatatgaagaaaatggcactcattgtggccttgttgaattatgttgtgtatgttttaacatctctgatgctgtgttactaaaattacaaggacctgctttttaaaaggccagaacaattgtctgaaattagtaacaatgctgcatctagattggagtgctgcacaaacaaacataagagcaaagcaaaactgtatcacatagggtttttggtcactcacaacctgaattcaccacagctggaatagctgtggaaaacaaaataaaacaacaaaattaataatgaaatggaggggaattctagaattatatgctaaatgcatattttatgatttgctgtattaactgatgataaaactaatggcagaaaaagaagttgagcaatttctatgtaatgtacagatactagcattgcacatatagtctgctttctgttcctccagaatttgagtcctgttaatgtagtagaaaaaaaaaaaagaaattttctttttcttttgtgctggtcttgcaagtttgtctaccagtaagagagcaaagtttccttcctttcttctctttcttcattttctttttttcttttttgccttttattcctttaaaatttcgcctggcaaaaaataaataaatggaactatcactttataagaatcattttctagtaatgcaaacaaattattttttacaaaaaaacaaaataaataaaattagacttccttccctcactatatatctttatgcagtcagaatatttccaacagtgttttttgcaaattagagcaggacaaacttttatgtttacagggcacgtctgttgtaatgcaaagcatatttggcaagcagttcatcaccaggacactagctatgattctagaagtcaaaaggtgtctatagaactagtggggcttctgcatgtgaaaaacggttttccataggcattaaagtgctgaatgctcagtctgatcaacaagtgggcacctgcactaccactttttagaggaaattcactccctcgtaagcattggaaggtcaaattattttgaagtgatttttttaaaaaaaagtcttctgtttattaacaggaaaatttatttatttgacaggattttgagtaatgtaggaatacaaaaggtaaattagcagcacatataatttttttttaatttatgatccattttgtatggtctcaaagttggatgacctcattactaatatttgttgtaaaagtgaaacttgtttgccaaccaataaacaactgattgagatttagaagatattgtaaaaaaaaaaaaaaaaa

SEQ ID NO: 5563 - DNA, 6734 bp, Homo sapiens
cccagttgtctgcgggctgcggggagctaagtccccagattggaggaggctggctctggtcttcgatgcacaggagtggccgttatggaacgcagcagcagcgtgcagggtcaaagacagccggccccccatgtcagtggtctaggatggccagtgaaggcaccaacatcccaagtcctgtggtgcgccagattgacaagcagtttctgatttgcagtatatgcctggaacggtacaagaatcccaaggttctcccctgtctgcacactttctgcgagaggtgcctgcagaactacattcctgcccacagtttaaccctctcctgcccagtgtgccgccagacctccatcctgcccgagaaaggggtggccgcgctccagaacaatttcttcatcacaaacctgatggacgtgctgcagcgaactccaggcagcaacgctgaggagtcttccatcctggagacagtcactgctgtggctgcgggaaagcctctctcttgcccaaaccacgatgggaatgtgatggaattttactgccagtcctgtgagactgccatgtgtcgggagtgcacggagggggagcacgcagagcaccccacagttccactcaaggatgtggtggaacagcacaaggcctcgctccaggtccagctggatgctgtcaacaaaaggctcccagaaatagattctgctcttcagttcatctctgaaatcattcatcagttaaccaaccaaaaggccagcatcgtggatgacattcattccacctttgatgagctccagaagactttaaatgtgcgcaagagtgtgctgcttatggaattggaggtcaactatggcctcaaacacaaagtcctccagtcgcagctggatactctgctccaggggcaggagagcattaagagctgcagcaacttcacagcgcaggccctcaaccatggcacggagaccgaggtcctactggtgaagaagcagatgagcgagaagctgaacgagctggccgaccaggacttccccttgcacccgcgggagaacgaccagctggatttcatcgtggaaaccgaggggctgaagaagtccatccacaacctcgggacgatcttaaccaccaacgccgttgcctcagagacagtggccacgggcgaggggctgcggcagaccatcatcgggcagcccatgtccgtcaccatcaccaccaaggacaaagacggtgagctgtgcaaaaccggcaacgcctacctcaccgccgaactgagcacccccgacgggagcgtggcagacggggagatcctggacaacaagaacggcacctatgagtttttgtacactgtccagaaggaaggggactttaccctgtctctgagactctatgaccagcacatccgaggcagcccgtttaagctgaaagtgatccgatccgctgatgtgtctcccaccacagaaggcgtgaagaggcgcgttaagtccccggggagcggccacgtcaagcagaaagctgtgaaaagacccgcaagcatgtacagcactggaaaacgaaaagagaatcccatcgaagacgatttgatctttcgagtgggtaccaaaggaagaaataaaggagagtttacaaatcttcagggggtagctgcatctacaaatggaaagatattaattgcagacagtaacaaccaatgtgtgcagatattttccaatgatggccagttcaaaagtcgttttggcatacggggacgctctccggggcagctgcagcggcccacaggagtggctgtacatcccagtggggacataatcattgccgattatgataataaatgggtcagcattttctcctccgatgggaaatttaagacaaaaattggatcaggaaagctgatgggacccaaaggagtttctgtggaccgcaatgggcacattattgttgtggacaacaaggcgtgctgcgtgtttatcttccagccaaacgggaaaatagtcaccaggtttggtagccgaggaaatggggacaggcagtttgcaggtccccattttgcagctgtaaatagcaataatgagattattattacagatttccataatcattctgtcaaggtgtttaatcaggaaggagaattcatgttgaagtttggctcaaatggagaaggaaatgggcagtttaatgctccaacaggtgtagcagtggattcaaatggaaacatcattgtggccgactggggaaacagcaggatccaggtttttgatgggagtggatcatttttgtcctacattaacacatctgctgacccactctatggcccccaaggcctggccctaacttcagatggtcatgttgtggttgcagactctggaaatcactgtttcaaagtctatcgatacttacagtaatggtgggcaggtggatacccgcttccatggtcttgcactataaactggaatggatttctcaatgcgggaccagattatgactagagtttttatgccagaaggaatcattggtgaactttccaaggttatttctgaatgtaacaatttccttaaaaatgacttatccaatttctgtatttcacctttagggttaaaaaaaactcttctactgaatctataaaaactgcagttttacatctgtgaactatggcttaagggacaggatttatgtagctaaactaattttgcaaatcaaacagacacttaaaaaaactagcatatgtaaaggtattcgttaatcctgtgaatggtagcttttgcacagaacttccaaaagcaaaacaaaaacaaaatctattgtagttatatacttcatttaacctaggtcacaagacccagggaatcttctaacctcacttttacagtaggtattactcttgtgacatttttttggttatcaacaactaaatataaattactttggaaaaagtaaggctgtcttgcaaaatgatcccagctctgattagcagccctctggagttcagaacttaagtatcagtgcaaatttctcaacctttctgggttagacaaagatccttttttgtgtgttcttttcaccacccctttggctcaccttgtatcagcaaacaaagtacttcttcagggaaacctgaaatttctaatgccttgaaaagcatattacaaaagtaatgctaccttttgggaaacaaactgccccgttaactccagatcattgcactggaatgtaatcaagaaagttagtcatgttttatgtaccatgttttcacacgtgtctcttctcttcgacttcctgaaagcgaaagctttacctcctgcaaatgtcagcacatgtagtaggacaccagtatcctaggacagagagccataagtagccctttggaggactgatggtgtcaaccaaaggcatgtgattgattaatgattcccccttagaaagcaagtgttaccaaagttgtgttatcttgaaagcattacaggtaagggcatgttatggttatttatcattgtttaatgaatagtagaggtgtcaagggactatgtatacatgattagggtaagatagaatgtattatatatatatatatatatacacacacacatatatatagctgaatctttggtgtattgaaataggcagcactctgaaagacagaagcttcgtccagccactcttcagcacattcctttactaagcagtttaaagccgtcctagtggagcaagccctaaagcagatttaatttttgccattttccaagaatgacggtggtggcttttagtcagaaaatggccttctgtgctttcaaaaaaaaaacaaaaaaaaaaccacacacacacataaaaaacccaacaggtcaaaataaaagttgaacttgagttacatttaatttaaatataaatgcattttgagaaatgttaagaacaatttagtcaatcgttcatctgtcattggtactgtaaaataagctgtggtctatttccactgtttaattttctactcagttctaccaaataggatgtcatgtttgacatttttgatagtgactttggggtcttcttcactgaaagcaccttagaactgtactataagaaaacatttcccctatgtataattatatgaatgtgatgtttattgcttattaatttataattcagtcattctctatataggacttcttaaaatttagaagggaaatctagctacttcaaattgtctgttaaatttattatgcccaaatcaacctctgaaaaaaggtttttccaggaagatttacatttaggtttaatatttttttagttaggtagagttttaaaaaatacttgagcctgtccgtgataaagctataaaattcaataactttttagaatgttaaatgaagacactgtttcctaacatcagtgagatacatctttgaatttaaacattcatatttactgagtacctactaggtaccaagtactcttttaggcactggaaatacagtgatggacaaaacaggtaaaaaatcgctgccccctcagagctgacattctggggtgggaatttcattttgccacgtactaacgttctgcacaaaagacaggctagactcttgtctagattgtttaaaagaaacttttcaaattggttacattaattttagtttattttcacaagtaaaaatggctttttatttagattctttctgtcccaggctgttgatcttaaaactagttgatttaaagagtttttttgcacaacatttcaattatatttgtgaacttagaaattaacttacaatctaaccagccatcatatcatatcctatcaggctagatatctcaatagtagactgaatacaaagctaattttttttacatgtcaatattggcacaaactggaatgaaagaatagtttgattcagacctgctccactatgtgttgctaaaacacatgctatgagcactcgaggaaacactatattttttccaaaaaatatgtgattatatatgttaaagtatagataacatttcacacttggatacatatgtgcatttactgtatttcttggtaagcatatttttgggggaaagtgctgctgatatgatacaagtagacaaaatttaaatgaaattttgtcacattctatggaaaatggtttctggtaaactgagaaggatattaaaataagtggcttttttctgggctaccattattgtttgatttctctttgtcaagtgtatagaacctgtcatacattcatgataagtagcactgaaaaattactcattcaaatttcccctgggcacgtaaggcaaaatattgccggttgggatttcaaggtcagtgacgacgcatttcctcccagtacagaccccccagccccccttgctggacatggggaggcagagagtcacttgaccatccagaaatacatgactacaagtcctttatgactgtttgccattttttttaatggtacttagtattttgatcaaactttagtctccagaactaaacaagtccctaagtttccttattttaatttactgtgactagatttgaagcaaataaatactccagatccatgcagctagaacacacttgcttccactactaaatatacagggtatgtcctaacatggagttaactggaatagcagtacactagcaagtatctgtgaatccttagcactgacgggttaacagaaatgctttggtaatacctacttagttaattggaggaagtagtaaataaacattaggtaatctgcagattacttcaaatgggaaaaatctttttgtagactctatagtaccctctctattcactagcttctgaaaagggaggagtatttttagtttgacaatttaataatttaaaaacaagacatctccaggtaggaaaaaatgaaagctatttcatgcaaacattatctaatttagcttaaaagtgaaagtggtaatactgttggtttctgtaaatgttgcagggttttaaactttataattactttaatatttttgataactagaaatctagtattgccataaaggaaactaagtgcccatcaaagatttgtttggtataaataaagaattatttgttttgttttcaatgacagtaagctacaaatcatgatgcttaaaaactttctaaagatgaattgtgtggcagtgattggtctgtttgtggagaatgtatgaaagctattaatattctagaatagattaataaattggctatgttgttccaatgaatgtacagcacttccattaacttttgaaagcaacacagccttaaactcaatgcttttgctttatgacatgggaatgttctgtcatcaatggagtgtattcttgtaatagaattctttatatcgttctcaattctatagactttcaagcctatgtatgaatatgaaggggtttttttttttttgctttgttttctttttagattttgtacattccatctttataggtctgtttcatatgttttatgtatagaacactaagtcttgcactctctgacattgatactgatatattctcgtcatttgttcttttatgaatcaaaatgttgactgcctatttaaagaaaagaatgaacgctgtgcatcaaagtgtttgtatgttcgtagctacatacgtaccacagtattttggatgctttagtctacaatgaaactttcaattaattctgtcttgaaacataggagaaacaggattcatgtgtatctctttaccatgcacaaaatctcaaatcattataataaagcttgttttctcc

SEQ ID NO: 5564 - DNA, 5979 bp, Homo sapiens
agcgctgagtcccagaaaaacagagcggggccagctgcagcgtgtagtgcgagtggggcggacgcgcgcagcccgcccgcccggcgaccagcaaggagttggcatcctttggaagagttcgtgaaagctttctgcccagagctcctggaccaatgcatcttcccaccaccttaaaccactgagcagttcagagccccagttgcagacgacttgtcctgccaccaccatgagttctgaatgtgatggtggttccaaagctgtgatgaatggcttggcacctggcagcaatgggcaagacaaagacatggatcctacaaaaatctgcactgggaagggagcggtgactctccgggcctcgtcttcctacagggaaaccccaagcagtagccctgcgagccctcaggaaacccggcaacacgaaagcaaaccaggtctggagccagagccttcttcagcagatgagtggaggctttcttccagtgctgatgccaatggaaatgcccagccctcttcactcgctgccaagggctacagaagtgtgcatcccaaccttccttctgacaagtcccaggatgccacttcctccagtgcagcccagccggaggtaatagttgtccctctctacctggttaatactgacagagggcaagaaggcactgccagacctccaacacctctggggcctcttggctgcgtccccacaatcccagcgactgcctctgccgcctcacctctgaccttcccgactctagatgatttcattccccctcatctgcagaggtggccccaccacagccagccagcccgcgcctctggctcctttgcccccattagccagacgccaccatccttctcaccaccacctccgctggtccctcctgccccggaggacctccgcagagtctcggagcctgacctcacgggagctgtttcgagtaccgattccagtcctctactaaatgaagtttcttcttcccttattggaactgattcccaagcctttccatcagttagcaagccttcatccgcctatccctccacaacgattgtcaatcctactattgtgctcttgcaacacaatcgagaacagcaaaaacgactcagtagcctttcagatcctgtctcagaaagaagagtgggagagcaggactcagcaccaacccaggaaaaacccacctcacctggcaaggctattgaaaaaagagcaaaggatgacagtaggcgggtggtgaagagcactcaggacttaagcgatgtttccatggatgaagtgggcatcccactccggaacactgagagatcaaaagactggtacaagactatgtttaaacagatccacaaactgaacagagatgatgattcagatctgtactctcccagatactcattttctgaagacacaaaatctcccctttctgtgcctcgctcaaaaagtgagatgagctacattgatggtgagaaggtagtcaagaggtcggccacactacccctcccagcccgctcttcctcactgaagtcaagctcagaaagaaatgactgggaacccccagataagaaagtagacacaagaaaatatcgtgcagagcccaagagcatttacgaatatcagcctggcaagtcttccgttctgaccaacgaaaagatgagctcagccatcagccctactccggaaatttcttcagagactcctggatatatatattcttccaacttccatgcagtgaagagggaatcagacggggctcctggggatctcactagcttggagaatgagagacaaatttataaaagtgtcttggaaggtggtgacatccctcttcagggcctgagtgggctcaagcgaccatccagctctgcttccactaaagattcagaatcgccaagacattttataccagctgattacttggaatccacggaagaatttattcgaagacgtcatgatgataaagagatgagacctgccagagccaaatttgactttaaagctcagacactaaaggagcttcctctgcagaagggagatattgtttacatttataagcaaattgatcagaactggtatgaaggagaacaccacggccgggtgggaatcttcccacgcacctacatcgagcttcttcctcctgctgagaaggcacagcccaaaaagttgacaccagtgcaggttttggaatatggagaagctattgctaagtttaactttaatggtgatacacaagtagaaatgtccttcagaaagggtgagaggatcacactgctccggcaggtagatgagaactggtacgaagggaggatcccggggacatcccgacaaggcatcttccccatcacctacgtggatgtgatcaagcgaccactggtgaaaaaccctgtggattacatggacctgcctttctcctcctccccaagtcgcagtgccactgcaagcccacagcaacctcaagcccagcagcgaagagtcacccccgacaggagtcaaacctcacaagatttatttagctatcaagcattatatagctatataccacagaatgatgatgagttggaactccgcgatggagatatcgttgatgtcatggaaaaatgtgacgatggatggtttgttggtacttcaagaaggacaaagcagtttggtacttttccaggcaactatgtaaaacctttgtatctataagaagactgaaaaccatggagattatttttattggaggaggaagcatcattcatgaaccgatctttttagttgagtcagtaggaaaattaatacagtggataaagtaagaagcaaaagacagggacagagaagtgttgtgtttaaaacccaagcctgtctaaggttactgtgtattagacagggccgaactagtgtgctgagcaaaaagaattgaagcaaattgtatttacttagccgcttctgggagccacttcagcctttcccctcccctccacttcttgggtaatctgacctgaagcatagtccaggagcagagttagccagaaatgcctcctgctgccccagccttagagagctcccatctcaatcattgagcctgaaggcttcaagcccaagaatgcaacaagacccccagcctacatttctcagctcccctggagccagctgatcctgtaacgctgctggaggtcagtctgagctaccaagactgtccctagacaaaggtggagtcccccacactgcccaagaccaaatccctcactcaacctgctgaggtgtggatggggaaacagaggcaaaactgaggcacctgatgcattcagcctgctgtgcagcagtgccattgactgccctgatgttcagagagaaacgcacacaaggtttgcccatgagaattggggagcagatggccaagcagataggttatgtctgttttctgagtgatgaagtcaggaagccctgtggctctggaggccacttgtggttcattcttttcccatatccttggcttttagaaatggttaccttcaggacagtgcagctgcatttatcagagcactattgctaagttttcttttctggcttgtgtttttctgggacagtttagaattgggaggcctattctcatagaacaccaaaaatgatgttcagtgattcatttaacatacaccaatgtactctggctgctggggggacaaccataagcaagacatgcccagggtttgccgtggctccagatctactccctgtaggagttcaaggatcacacaaacggtagtaaccagggttgtgaatctgagtacaccctggcaaggcttctcttcagactgaagcagcaattctgccactaccagcagcaaccaggacgtctgttctttgtgggggccagatcagaagagagaggcccctgtgacgcccgggctgcttggtcacaactctgtccaattcaaggatgtttatcggcctctcttagatcctgagtgagacaaatacagaaatgacccattccctgcccaccagaaactcagaggtgattggggagactgacacaggaaaatgaacttaatcaagagagactgtgatatgtgctaagaagggtgtgagggagggagagatgaattttccctggagggatcctagaaagcattgtcatattgccatctccattagctcacttttaaacaactagggtgctggaagaacctttgtctgagggtagttcatagctggaaatacttggaatattttccagagtctctaaactctcatcttcccccacagatacacatccaagctcacaaataggagtagcaattctaggtggtagggttgtgtacggaacccctggctgtctgcatatatctcagaattaccccaggaccattgtcccaaagtctagagtctttacaggtaggcaaaatttgttttcaatgcctgtgcctcagctgctgtcacaaatacccatcttaggatcccatcagcttcccatcccccaccagacagccacagtaccctcactttctccctattgttctttcaaatcctgttctcaggaaagaaactgccactaattcattcacactaaggtgtaaatgattgataataggaatgagttacctcttcccacagacatttgtttttaagtatgacagagcagggccttaatcccaagggaaaaggttatggaactggagggggtgagctttctgggtagaaggagacttcctgaatttccttaaaacccagtaagagtaagacctgttgttttggaaggtctgctccaccatctaagagcactgtttttttttttttgttgttgttgttgttttacggtctctgagggaatatagtaaaaatgcatatgcacgtgcaatttgcacggcagcatttcaccgattgtggactgtattggctaatgtgtttcctggtctttagatgcaaaccattaataacactatcttatctcatagttttttcaggggtgcttcttgattagtagggaattttgaacacctctttaaatacagctagaaaataaaaccaatttgtaaagccacatttgcatatgatgccagcctcacgcatttgtatatctccagaaattcaggtatgcctcaccaatttgcccgtctttaataaaatcttgtgttaaaatttgcatcacgtcgccttcctatgtatgacgaaacaagaaacagagatttccaattgctcttttgtcttcagacatttagtaatataaagtacctatttttatgctgaaatgtttatacaggtttattaatagcaagtgcaactaactggcggcatgccttgcaacacattttgatatattagccatgcttccgggtaaaggcaagccccaaactccttatcttttgcagtctctctgggatcagtaaaagaaaaaaaaaataatgtgcttaagaagtgggactgtaaatatgtatatttaactttgtatagcccatgtacctaccttgtatagaaaaataattttaaaaatttgaatggaagggggtaaaggaagtcatgaagtttttttgcatttttatttaaatgaaggaattccaaataactcacctacagatttttagcacaaaaatagccattgtaaagtgttaaaatttacgataagtattctattggggaggaaaggtaactctgatctcagttacagtttttttttcctttttaatttcattattttgggtttttggtttttgcagtcctatttatctgcagtcgtattaagtcctattgctagaataggttactacaaaaaaggttatattctgaaagaaaaataactgacattatatataaccaattaatttaaagtattgccatttaaattacacactgagagcatgtcctatgcagacatagatttttctgttcatttatttttcttcattgcagtggattgatttgataaatagatgtgttgaattactacatttgctgtacatattatttaataaactttattcagaattgcgtggcaaaaaaaaaaaaaaaaa

SEQ ID NO: 5565 - DNA, 4869 bp, Homo sapiens
aatgatttcctcagtgattacgtacagagcgagtccctgcgggttaggggccccctctggagccatcctgatggctttgggggccttgcttccattttccattattatgtggactaccggagcgacagcgcagtccaagaccttgcaggatgtctcgccgcaagcaagcgaaaccgagatccctcaaagaccccaactgtaaacttgaagacaagactgaagatggagaggcactagattgtaagaagaggccggaagacggggaggagttggaagacgaagctgtgcacagctgtgacagctgcctccaggtgtttgaatcgctgagcgatatcacagaacacaagattaatcaatgtcaactgacagatggagtggatgttgaagatgatccgacttgctcttggccagcttcctcaccttctagcaaggatcagacttcccctagccatggagaaggttgcgattttggagaggaagaaggtggccctgggcttccatacccgtgtcaattctgtgacaagtcgtttagccgcctcagctacctaaagcaccatgagcagagtcacagtgacaaactgcctttcaaatgcacctactgcagtaggctgttcaaacacaagcgcagccgagatcgccacataaaactccacaccggggacaagaagtaccactgcagtgaatgtgatgctgcgttttccagaagtgatcacttgaagatccacttaaagactcacacgtccaacaagccatataaatgtgccatttgtcgccgtgggtttctgtcctctagttccttacacggacacatgcaggttcatgagaggaacaaggacggctctcagtccggttccaggatggaggactggaagatgaaggacactcagaagtgcagtcagtgtgaggaaggctttgacttcccggaagacctccaaaaacacattgcagagtgccaccccgaatgctccccaaatgaggaccgagcggccctccagtgtgtctactgccacgagctcttcgtagaggagacctccctcatgaaccacatggagcaggtgcatagcggggagaagaagaactcatgcagcatttgttctgagagtttccacacagttgaggaactgtacagccacatggacagtcaccagcaaccggagtcatgcaatcacagcaacagcccttccctggtcacggtgggctatacctccgtgtccagtacgactccagattccaacctctcagtggacagctcaaccatggtggaagctgccccgccaatcccaaagagtcgagggaggaagagggccgctcaacaaacccctgacatgactggtccctcgagtaaacaagcaaaagttacctacagctgtatttactgcaacaaacaattattttcaagtcttgcagttctgcagattcacctgaaaactatgcacttagataagccagaacaggcccatatttgtcagtattgcttggaggtcctgccctcactctataacctaaatgaacatcttaagcaagtgcatgaagctcaggacccaggtctgattgtttctgccatgcctgccattgtctaccagtgtaacttctgttccgaagttgtcaacgacctcaacactcttcaggaacacatccgatgttctcatggatttgcaaaccctgcagctaaagatagtaatgcattcttttgtccccattgctatatggggtttctcactgactcttccctggaagagcatattagacaggttcattgtgacctcagtggctcccgatttgggtctccagtgcttgggactcccaaagaaccagtagtagaagtctattcttgttcctattgtacaaattcgccaatattcaacagcgttcttaaactgaacaagcatatcaaagagaatcataaaaacattcccttggccctgaattatatccacaatgggaagaaatccagggccttaagccccctatctcctgtggccatagagcagacatctcttaagatgatgcaggcagtaggaggtgcacctgcacgccccactggagaatatatctgtaatcaatgtggtgctaagtacacatccctagacagctttcagactcacctaaaaactcatctcgacactgtgcttccaaaattgacctgtcctcagtgcaacaaggaattccccaaccaagaatccttgctgaagcatgttaccattcactttatgatcacttcaacgtattacatctgtgagagttgtgacaagcaattcacatcagtggatgaccttcagaaacacctgctggacatgcacacctttgtcttctttcgctgcaccctctgccaggaagtttttgactcaaaagtctccattcagctccacttggctgtgaagcacagtaacgaaaagaaagtctataggtgcacatcttgcaactgggacttccgcaacgaaactgacttgcagctccatgtgaaacacaaccacctggaaaaccaagggaaagtgcataagtgcattttctgcggtgagtcctttggcaccgaggtggagctgcaatgccacatcaccactcacagtaagaagtacaactgcaagttctgtagcaaagccttccatgcgatcattttgttagaaaaacacttgcgagaaaaacactgtgtattcgaaaccaagacacccaactgtggaacaaatggagcttccgagcaagtgcagaaagaggaagtggagctgcagactttgctgaccaacagccaggagtcccacaacagtcacgatgggagcgaagaagacgttgacacctctgagcctatgtacggctgcgacatttgtggggcagcctacactatggaaactttgctgcagaatcaccagctccgagaccacaacatcagacctggagaaagtgccatcgtgaaaaagaaagctgagctcattaaagggaattacaagtgcaacgtgtgctctcgaaccttcttctccgaaaatggcctccgggaacatatgcagacccacctaggccctgtcaaacactacatgtgccctatttgcggagagcggtttccctcccttttaactcttactgaacacaaagtcacgcatagtaagagtcttgatactggaaactgccggatttgcaagatgcctctccagagtgaagaggagtttttagagcattgccaaatgcaccctgacttgaggaattccctgacaggctttcgctgcgtggtgtgcatgcagacagtgacctccaccttggaactcaaaatccatgggacgttccacatgcaaaagacagggaatgggtctgcagttcagaccacagggcggggccagcacgtccaaaaactgtataagtgcgcatcttgcctcaaagaattccgttccaagcaagatctggtgaaacttgatatcaatggcctgccatatggtctgtgtgccggctgcgtgaatctcagtaagagcgccagcccaggcattaacgtccctcccggcacgaatagaccaggcttgggccagaatgagaatctgagtgccattgaggggaaaggcaaggtggggggactgaagacacgctgctctagctgcaacgttaagtttgagtctgaaagtgaactccagaaccacatccaaaccatccaccgagagctcgtgccagacagcaacagcacacagttgaaaacgccccaagtatcaccaatgcccagaatcagtccctcccagtcggatgagaagaagacctatcaatgcatcaagtgtcagatggttttctacaatgaatgggatattcaggttcatgttgcaaatcacatgattgatgaaggactgaaccatgaatgcaaactctgcagccagacctttgactctcctgccaaactccagtgccacctgatagagcacagcttcgaagggatgggaggcaccttcaagtgtccagtctgctttacagtatttgttcaagcaaacaagttgcagcagcatattttctctgcccatggacaagaagacaagatctatgactgtacacaatgtccacagaagtttttcttccaaacagagctgcagaatcatacaatgacccaacacagcagttagtgcaagtacagtctctcaaggagaattgattttgtggcacaaaaagggaacatgttttactctttgcacgaaactttcattgttaatgtatattattcagaaacattgtattgtaccataaaacttgtattatcaaactgttggatgttcatgtgtttgaacttttgcgcaccggatagaccccttgtatataaagtgttgcacatgtattatgtcgtctgatactaaaatggtcttataaagacaagtggacttgggccctattcaggcaagattaaaaaaaaaaaagactatgaccaaaatggcttaagataaagtatttttaaggaagaaagattaaaaacaactgttatacatgagactatggttggacttccttttctttacacttaagcctagaatttctctttaggtatatcagcgcttaaatccaagactattttttattgctgaagattcttgcaaaccatgaagagatgttctcacagaacagaaccccacagctggataaggcccgtatatatatatttgtaagccttgcaatgtgacaggtagcatcactatatatgcaatagttgttatgtagactgtcaaagaatttttttttccctggatacatttgaagctttgagtgttcaaggttttccttaatgatttcacgcagccaaattcttgaatcagttgaactaacctgtatgttactgttattaatgtttactctgcagtctgaacctggagattactggaattgttttccaagaggaaataaattcagtttaccatt

SEQ ID NO: 5566 - DNA, 1567 bp, Homo sapiens
tttgacaagatggcggcaggaggcagtggcgttggtgggaagcgcagctcgaaaagcgatgccgattctggtttcctggggctgcggcccacttcggtggacccagcgctgaggcggcggcggcgaggcccaagaaataagaagcggggctggcggcggcttgctcaggagccgctggggctggaggttgaccagttcctggaagacgtgcggctacaggagcgcacgagcggtggcttgttgtcagaggccccaaatgaaaaactcttcttcgtggacactggctccaaggaaaaagggctgacaaagaagagaaccaaagtccagaagaagtcactgcttctcaagaaaccccttcgggttgacctcatcctcgagaacacatccaaagtccctgcccccaaagacgtcctcgcccaccaggtccccaacgccaagaagctcaggcggaaggagcagctatgggagaagctggccaagcagggcgagctgccccgggaggtgcgcagggcccaggcccggctcctcaacccttctgcaacaagggccaagcccgggccccaggacaccgtagagcggcccttctacgacctctgggcctcagacaaccccctggacaggccgttggttggccaggatgagtttttcctggagcagaccaagaagaaaggagtgaagcggccagcacgcctgcacaccaagccgtcccaggcgcccgccgtggaggtggcgcctgccggagcttcctacaatccatcctttgaagaccaccagaccctgctctcagcggcccacgaggtggagttgcagcggcagaaggaggcggagaagctggagcggcagctggccctgcccgccacggagcaggccgccacccaggagtccacattccaggagctgtgcgaggggctgctggaggagtcggatggtgagggggagccaggccagggcgaggggccggaggctggggatgccgaggtctgtcccacgcccgcccgcctggccaccacagagaagaagacggagcagcagcggcggcgggagaaggctgtgcacaggctgcgggtacagcaggccgcgttgcgggccgcccggctccggcaccaggagctgttccggctgcgcgggatcaaggcccaggtggccctgaggctggcggagctggcgcggcggcggaggcggcggcaggcgcggcgggaggctgaggctgacaagccccgaaggctgggacggctcaagtaccaggcacctgacatcgacgtgcagctgagctcggagctgacagactcgctcaggaccctgaagcccgagggcaacatccttcgagaccggttcaagagcttccagaggaggaatatgatcgagcctcgagagagagccaagttcaaacgcaagtacaaggtgaagctggtggagaagcgggcgttccgtgagatccagttgtagctgccatcagatgccggagactcgcccttcaataaaaaatctcttctagctgaaaaaaaaaaaaaaaaaaaaaaaaaaaaaaaaaaaaaaaaaaaaaaaaaaaaaaaaaaaaaaaaaaaaa

SEQ ID NO: 5567 - DNA, 2271 bp, Homo sapiens
gtgtgacgctggtatctgtgtgaactcgggcttgtgatgctgagcttggttcatctgctttctcctcccttttcctccccactccttcccaccagcgccacagcaacatcctcagagtctgagcgaactgcgcccagcgcgggcacggagcctcccaccgccagcaacctgcggccccggagaaggcagcgagcgcagtgacagcgcctcaccgccaccagctcctggaccaccatggccaagaaccgcagggacagaaacagttggggtggattttcggaaaagacatatgaatggagctcagaagaggaggagccagtgaaaaaggcaggaccagtccaagtcctcattgtcaaagatgaccattcctttgagttagatgaaactgcattaaatcggatccttctctcggaggctgtcagagacaaggaggttgttgctgtatctgttgctggagcatttagaaaaggaaaatcattcctgatggacttcatgttgagatacatgtacaaccaggaatcagttgattgggttggagactacaatgaaccattgactggtttttcatggagaggtggatctgagcgagagaccacaggaattcagatatggagtgaaatcttccttatcaataaacctgatggtaaaaaggttgcagtgttattgatggatactcagggaacctttgatagtcagtcaactttgagagattcagccacagtatttgcccttagcacaatgatcagctcaatacaggtatataacttatcccaaaatgtccaggaggatgatcttcagcacctccagcttttcactgagtatggcagactggcaatggaggaaacattcctgaagccatttcagagtctgatatttcttgttcgagactggagtttcccatacgaattttcatatggagccgatggtggtgccaaattcttggaaaaacgcctcaaggtctcagggaaccagcatgaagaactacagaacgtcagaaaacacatccattcctgtttcaccaacatttcctgttttctgctacctcatcctggcttaaaagtagctaccaatccaaactttgatggaaaattgaaagaaatagatgatgaattcatcaaaaacttgaaaatactgattccttggctacttagtcccgagagcctagatattaaagagatcaatgggaataaaatcacctgccggggtctggtggagtacttcaaggcttatataaagatctatcaaggtgaagaattaccacatcccaaatccatgttacaggccacagcagaagctaacaatttagcagccgtggcaactgccaaggacacatacaacaaaaaaatggaagagatttgtggtggtgacaaaccatttctggccccaaatgacttgcagaccaaacacctgcaacttaaggaagaatctgtgaagctattccgaggggtgaagaagatgggtggggaagaatttagccggcgttacctgcagcagttggagagtgaaatagatgaactttacatccaatatatcaagcacaatgatagcaaaaatatcttccatgcagctcgtaccccagccacactgtttgtagtcatctttatcacatatgtgattgctggtgtgactggattcattggtttggacatcatagctagcctatgcaatatgataatgggactgacccttatcaccctgtgcacttgggcatatatccggtactctggagaataccgagagctgggagctgtaatagaccaggtggctgcagctctgtgggaccagggaagtacaaatgaggctttgtacaagctttacagtgcagcagcaacccacagacatctgtatcatcaagctttccctacaccaaagtcggaatctactgaacaatcagaaaagaaaaaaatgtaatgcaaattttaagaaatacaggtgcatgaccaattgtcaattaaatattcagttttatgtctccatgcaaacattcaaagtgcttccatcagaacggagtaaaatactaaacacctctgaagactgcaaactggattagttcttttacttcagtgtttaataagcagatgtatgtatgcatggttatactattttgttaacatgtacaatttcctgatttttcttcaaaaatgctgttataaagtatttgtctatttatgataacagtacacgtgttctgcttgaatttactaaattctactactgggttataattaaatcatgtgatattccaaaaaaaaaaaaaaaaaaaaaaaaaaa

SEQ ID NO: 5568 - DNA, 10316 bp, Homo sapiens
gagaccagaagcgggcgaattgggcaccggtggcggctgcgggcagtttgaattagactctgggctccagcccgccgaagccgcgccagaactgtactctccgagaggtcgttttcccgtccccgagagcaagtttatttacaaatgttggagtaataaagaaggcagaacaaaatgagctgggctttggaagaatggaaagaagggctgcctacaagagctcttcagaaaattcaagagcttgaaggacagcttgacaaactgaagaaggaaaagcagcaaaggcagtttcagcttgacagtctcgaggctgcgctgcagaagcaaaaacagaaggttgaaaatgaaaaaaccgagggtacaaacctgaaaagggagaatcaaagattgatggaaatatgtgaaagtctggagaaaactaagcagaagatttctcatgaacttcaagtcaaggagtcacaagtgaatttccaggaaggacaactgaattcaggcaaaaaacaaatagaaaaactggaacaggaacttaaaaggtgtaaatctgagcttgaaagaagccaacaagctgcgcagtctgcagatgtctctctgaatccatgcaatacaccacaaaaaatttttacaactccactaacaccaagtcaatattatagtggttccaagtatgaagatctaaaagaaaaatataataaagaggttgaagaacgaaaaagattagaggcagaggttaaagccttgcaggctaaaaaagcaagccagactcttccacaagccaccatgaatcaccgcgacattgcccggcatcaggcttcatcatctgtgttctcatggcagcaagagaagaccccaagtcatctttcatctaattctcaaagaactccaattaggagagatttctctgcatcttacttttctggggaacaagaggtgactccaagtcgatcaactttgcaaatagggaaaagagatgctaatagcagtttctttgacaattctagcagtcctcatcttttggatcaattaaaagcgcagaatcaagagctaagaaacaagattaatgagttggaactacgcctgcaaggacatgaaaaagaaatgaaaggccaagtgaataagtttcaagaactccaactccaactggagaaagcaaaagtggaattaattgaaaaagagaaagttttgaacaaatgtagggatgaactagtgagaacaacagcacaatacgaccaggcgtcaaccaagtatactgcattggaacaaaaactgaaaaaattgacggaagatttgagttgtcagcgacaaaatgcagaaagtgccagatgttctctggaacagaaaattaaggaaaaagaaaaggagtttcaagaggagctctcccgtcaacagcgttctttccaaacactggaccaggagtgcatccagatgaaggccagactcacccaggagttacagcaagccaagaatatgcacaacgtcctgcaggctgaactggataaactcacatcagtaaagcaacagctagaaaacaatttggaagagtttaagcaaaagttgtgcagagctgaacaggcgttccaggcgagtcagatcaaggagaatgagctgaggagaagcatggaggaaatgaagaaggaaaacaacctccttaagagtcactctgagcaaaaggccagagaagtctgccacctggaggcagaactcaagaacatcaaacagtgtttaaatcagagccagaattttgcagaagaaatgaaagcgaagaatacctctcaggaaaccatgttaagagatcttcaagaaaaaataaatcagcaagaaaactccttgactttagaaaaactgaagcttgctgtggctgatctggaaaagcagcgagattgttctcaagaccttttgaagaaaagagaacatcacattgaacaacttaatgataagttaagcaagacagagaaagagtccaaagccttgctgagtgctttagagttaaaaaagaaagaatatgaagaattgaaagaagagaaaactctgttttcttgttggaaaagtgaaaacgaaaaacttttaactcagatggaatcagaaaaggaaaacttgcagagtaaaattaatcacttggaaacttgtctgaagacacagcaaataaaaagtcatgaatacaacgagagagtaagaacgctggagatggacagagaaaacctaagtgtcgagatcagaaaccttcacaacgtgttagacagtaagtcagtggaggtagagacccagaaactagcttatatggagctacagcagaaagctgagttctcagatcagaaacatcagaaggaaatagaaaatatgtgtttgaagacttctcagcttactgggcaagttgaagatctagaacacaagcttcagttactgtcaaatgaaataatggacaaagaccggtgttaccaagacttgcatgccgaatatgagagcctcagggatctgctaaaatccaaagatgcttctctggtgacaaatgaagatcatcagagaagtcttttggcttttgatcagcagcctgccatgcatcattcctttgcaaatataattggagaacaaggaagcatgccttcagagaggagtgaatgtcgtttagaagcagaccaaagtccgaaaaattctgccatcctacaaaatagagttgattcacttgaattttcattagagtctcaaaaacagatgaactcagacctgcaaaagcagtgtgaagagttggtgcaaatcaaaggagaaatagaagaaaatctcatgaaagcagaacagatgcatcaaagttttgtggctgaaacaagtcagcgcattagtaagttacaggaagacacttctgctcaccagaatgttgttgctgaaaccttaagtgcccttgagaacaaggaaaaagagctgcaacttttaaatgataaggtagaaactgagcaggcagagattcaagaattaaaaaagagcaaccatctacttgaagactctctaaaggagctacaacttttatccgaaaccctaagcttggagaagaaagaaatgagttccatcatttctctaaataaaagggaaattgaagagctgacccaagagaatgggactcttaaggaaattaatgcatccttaaatcaagagaagatgaacttaatccagaaaagtgagagttttgcaaactatatagatgaaagggagaaaagcatttcagagttatctgatcagtacaagcaagaaaaacttattttactacaaagatgtgaagaaaccggaaatgcatatgaggatcttagtcaaaaatacaaagcagcacaggaaaagaattctaaattagaatgcttgctaaatgaatgcactagtctttgtgaaaataggaaaaatgagttggaacagctaaaggaagcatttgcaaaggaacaccaagaattcttaacaaaattagcatttgctgaagaaagaaatcagaatctgatgctagagttggagacagtgcagcaagctctgagatctgagatgacagataaccaaaacaattctaagagcgaggctggtggtttaaagcaagaaatcatgactttaaaggaagaacaaaacaaaatgcaaaaggaagttaatgacttattacaagagaatgaacagctgatgaaggtaatgaagactaaacatgaatgtcaaaatctagaatcagaaccaattaggaactctgtgaaagaaagagagagtgagagaaatcaatgtaattttaaacctcagatggatcttgaagttaaagaaatttctctagatagttataatgcgcagttggtgcaattagaagctatgctaagaaataaggaattaaaacttcaggaaagtgagaaggagaaggagtgcctgcagcatgaattacagacaattagaggagatcttgaaaccagcaatttgcaagacatgcagtcacaagaaattagtggccttaaagactgtgaaatagatgcggaagaaaagtatatttcagggcctcatgagttgtcaacaagtcaaaacgacaatgcacaccttcagtgctctctgcaaacaacaatgaacaagctgaatgagctagagaaaatatgtgaaatactgcaggctgaaaagtatgaactcgtaactgagctgaatgattcaaggtcagaatgtatcacagcaactaggaaaatggcagaagaggtagggaaactactaaatgaagttaaaatattaaatgatgacagtggtcttctccatggtgagttagtggaagacataccaggaggtgaatttggtgaacaaccaaatgaacagcaccctgtgtctttggctccattggacgagagtaattcctacgagcacttgacattgtcagacaaagaagttcaaatgcactttgccgaattgcaagagaaattcttatctttacaaagtgaacacaaaattttacatgatcagcactgtcagatgagctctaaaatgtcagagctgcagacctatgttgactcattaaaggccgaaaatttggtcttgtcaacgaatctgagaaactttcaaggtgacttggtgaaggagatgcagctgggcttggaggaggggctcgttccatccctgtcatcctcttgtgtgcctgacagctctagtcttagcagtttgggagactcctccttttacagagctcttttagaacagacaggagatatgtctcttttgagtaatttagaaggggctgtttcagcaaaccagtgcagtgtagatgaagtattttgcagcagtctgcaggaggagaatctgaccaggaaagaaaccccttcggccccagcgaagggtgttgaagagcttgagtccctctgtgaggtgtaccggcagtccctcgagaagctagaagagaaaatggaaagtcaagggattatgaaaaataaggaaattcaagagctcgagcagttattaagttctgaaaggcaagagcttgactgccttaggaagcagtatttgtcagaaaatgaacagtggcaacagaagctgacaagcgtgactctggagatggagtccaagttggcggcagaaaagaaacagacggaacaactgtcacttgagctggaagtagcacgactccagctacaaggtctggacttaagttctcggtctttgcttggcatcgacacagaagatgctattcaaggccgaaatgagagctgtgacatatcaaaagaacatacttcagaaactacagaaagaacaccaaagcatgatgttcatcagatttgtgataaagatgctcagcaggacctcaatctagacattgagaaaataactgagactggtgcagtgaaacccacaggagagtgctctggggaacagtccccagataccaattatgagcctccaggggaagataaaacccagggctcttcagaatgcatttctgaattgtcattttctggtcctaatgctttggtacctatggatttcctggggaatcaggaagatatccataatcttcaactgcgggtaaaagagacatcaaatgagaatttgagattacttcatgtgatagaggaccgtgacagaaaagttgaaagtttgctaaatgaaatgaaagaattagactcaaaactccatttacaggaggtacaactaatgaccaaaattgaagcatgcatagaattggaaaaaatagttggggaacttaagaaagaaaactcagatttaagtgaaaaattggaatatttttcttgtgatcaccaggagttactccagagagtagaaacttctgaaggcctcaattctgatttagaaatgcatgcagataaatcatcacgtgaagatattggagataatgtggccaaggtgaatgacagctggaaggagagatttcttgatgtggaaaatgagctgagtaggatcagatcggagaaagctagcattgagcatgaagccctctacctggaggctgacttagaggtagttcaaacagagaagctatgtttagaaaaagacaatgaaaataagcagaaggttattgtctgccttgaagaagaactctcagtggtcacaagtgagagaaaccagcttcgtggagaattagatactatgtcaaaaaaaaccacggcactggatcagttgtctgaaaaaatgaaggagaaaacacaagagcttgagtctcatcaaagtgagtgtctccattgcattcaggtggcagaggcagaggtgaaggaaaagacggaactccttcagactttgtcctctgatgtgagtgagctgttaaaagacaaaactcatctccaggaaaagctgcagagtttggaaaaggactcacaggcactgtctttgacaaaatgtgagctggaaaaccaaattgcacaactgaataaagagaaagaattgcttgtcaaggaatctgaaagcctgcaggccagactgagtgaatcagattatgaaaagctgaatgtctccaaggccttggaggccgcactggtggagaaaggtgagttcgcattgaggctgagctcaacacaggaggaagtgcatcagctgagaagaggcatcgagaaactgagagttcgcattgaggccgatgaaaagaagcagctgcacatcgcagagaaactgaaagaacgcgagcgggagaatgattcacttaaggataaagttgagaaccttgaaagggaattgcagatgtcagaagaaaaccaggagctagtgattcttgatgccgagaattccaaagcagaagtagagactctaaaaacacaaatagaagagatggccagaagcctgaaagtttttgaattagaccttgtcacgttaaggtctgaaaaagaaaatctgacaaaacaaatacaagaaaaacaaggtcagttgtcagaactagacaagttactctcttcatttaaaagtctgttagaagaaaaggagcaagcagagatacagatcaaagaagaatctaaaactgcagtggagatgcttcagaatcagttaaaggagctaaatgaggcagtagcagccttgtgtggtgaccaagaaattatgaaggccacagaacagagtctagacccaccaatagaggaagagcatcagctgagaaatagcattgaaaagctgagagcccgcctagaagctgatgaaaagaagcagctctgtgtcttacaacaactgaaggaaagtgagcatcatgcagatttacttaagggtagagtggagaaccttgaaagagagctagagatagccaggacaaaccaagagcatgcagctcttgaggcagagaattccaaaggagaggtagagaccctaaaagcaaaaatagaagggatgacccaaagtctgagaggtctggaattagatgttgttactataaggtcagaaaaagaaaatctgacaaatgaattacaaaaagagcaagagcgaatatctgaattagaaataataaattcatcatttgaaaatattttgcaagaaaaagagcaagagaaagtacagatgaaagaaaaatcaagcactgccatggagatgcttcaaacacaattaaaagagctcaatgagagagtggcagccctgcataatgaccaagaagcctgtaaggccaaagagcagaatcttagtagtcaagtagagtgtcttgaacttgagaaggctcagttgctacaaggccttgatgaggccaaaaataattatattgttttgcaatcttcagtgaatggcctcattcaagaagtagaagatggcaagcagaaactggagaagaaggatgaagaaatcagtagactgaaaaatcaaattcaagaccaagagcagcttgtctctaaactgtcccaggtggaaggagagcaccaactttggaaggagcaaaacttagaactgagaaatctgacagtggaattggagcagaagatccaagtgctacaatccaaaaatgcctctttgcaggacacattagaagtgctgcagagttcttacaagaatctagagaatgagcttgaattgacaaaaatggacaaaatgtcctttgttgaaaaagtaaacaaaatgactgcaaaggaaactgagctgcagagggaaatgcatgagatggcacagaaaacagcagagctgcaagaagaactcagtggagagaaaaataggctagctggagagttgcagttactgttggaagaaataaagagcagcaaagatcaattgaaggagctcacactagaaaatagtgaattgaagaagagcctagattgcatgcacaaagaccaggtggaaaaggaagggaaagtgagagaggaaatagctgaatatcagctacggcttcatgaagctgaaaagaaacaccaggctttgcttttggacacaaacaaacagtatgaagtagaaatccagacataccgagagaaattgacttctaaagaagaatgtctcagttcacagaagctggagatagaccttttaaagtctagtaaagaagagctcaataattcattgaaagctactactcagattttggaagaattgaagaaaaccaagatggacaatctaaaatatgtaaatcagttgaagaaggaaaatgaacgtgcccaggggaaaatgaagttgttgatcaaatcctgtaaacagctggaagaggaaaaggagatactgcagaaagaactctctcaacttcaagctgcacaggagaagcagaaaacaggtactgttatggataccaaggtcgatgaattaacaactgagatcaaagaactgaaagaaactcttgaagaaaaaaccaaggaggcagatgaatacttggataagtactgttccttgcttataagccatgaaaagttagagaaagctaaagagatgttagagacacaagtggcccatctgtgttcacagcaatctaaacaagattcccgagggtctcctttgctaggtccagttgttccaggaccatctccaatcccttctgttactgaaaagaggttatcatctggccaaaataaagcttcaggcaagaggcaaagatccagtggaatatgggagaatggtagaggaccaacacctgctaccccagagagcttttctaaaaaaagcaagaaagcagtcatgagtggtattcaccctgcagaagacacggaaggtactgagtttgagccagagggacttccagaagttgtaaagaaagggtttgctgacatcccgacaggaaagactagcccatatatcctgcgaagaacaaccatggcaactcggaccagcccccgcctggctgcacagaagttagcgctatccccactgagtctcggcaaagaaaatcttgcagagtcctccaaaccaacagctggtggcagcagatcacaaaaggtcaaagttgctcagcggagcccagtagattcaggcaccatcctccgagaacccaccacgaaatccgtcccagtcaataatcttcctgagagaagtccgactgacagccccagagagggcctgagggtcaagcgaggccgacttgtccccagccccaaagctggactggagtccaacggcagtgagaactgtaaggtccagtgaaggcactttgtgtgtcagtacccctgggaggtgccagtcattgaatagataaggctgtgcctacaggacttctctttagtcagggcatgctttattagtgaggagaaaacaattccttagaagtcttaaatatattgtactctttagatctcccatgtgtaggtattgaaaaagtttggaagcactgatcacctgttagcattgccattcctctactgcaatgtaaatagtataaagctatgtatataaagctttttggtaatatgttacaattaaaatgacaagcactatatcacaatctctgtttgtatgtgggttttacactaaaaaaatgcaaaacacattttattcttctaattaacagctcctaggaaaatgtagacttttgctttatgatattctatctgtagtatgaggcatggaatagttttgtatcgggaatttctcagagctgagtaaaatgaaggaaaagcatgttatgtgtttttaaggaaaatgtgcacacatatacatgtaggagtgtttatctttctcttacaatctgttttagacatctttgcttatgaaacctgtacatatgtgtgtgtgggtatgtgtttatttccagtgagggctgcaggcttcctagaggtgtgctataccatgcgtctgtcgttgtgcttttttctgtttttagaccaattttttacagttctttggtaagcattgtcgtatctggtgatggattaacatatagcctttgttttctaataaaatagtcgccttcgttttctgtaaaaaaaaaaaaaaaaaaaaaa

SEQ ID NO: 5569 - DNA, 3832 bp, Homo sapiens
gccgggctgaggagccgggagtccgccgcgccggctcggggctgcgggatggggagttagcgccacggcggcggcagtggccgcagcgcaccccgccgccgcccaggagcccgtccagccaggggtgccgggcccgcccagcccgccccggagccaggcccgcgggcggcggcggagctgggcaggtggatgcggctggaagatggcgccctcgggcccgggcagcagcgccaggcggcggtgccggcgggtgctgtactggatcccggtggtgttcatcaccctcctgctcggctggtcctactacgcctacgccatccagctgtgcatagtgtccatggaaaacactggcgaacaagttgtgtgcctgatggcctatcatctactttttgcaatgtttgtctggtcatactggaaaactatctttacattaccaatgaatccttcaaaagaattccatctctcttatgcagagaaagatttgttggagagagagccaagaggagaagcccatcaggaagttcttaggcgagcagccaaggatcttcccatctataccaggaccatgtctggagccatccgatactgtgacagatgccaacttataaaaccagatcgctgccatcactgctccgtctgtgataaatgtattttgaagatggatcatcattgtccatgggtgaacaattgtgttggattttcaaattataagttctttctccttttcttggcttattctctgctctactgcctttttattgcggcaacagatttacagtattttatcaaattttggacaaatggcctacctgatactcaagccaagttccatattatgtttttattctttgctgcagctatgttttctgtcagcttgtcttctctgtttggctatcattgttggctagtcagcaaaaataaatctacattagaggcattcagaagtccagtatttcgacatggaacagataagaatggattcagcttgggtttcagtaaaaacatgcgacaagtttttggtgatgagaagaagtactggttgctacccattttttcaagtctaggtgatggctgctcctttccaacttgccttgttaaccaggatcctgaacaagcatctactcctgcagggctgaattccacagctaaaaatctcgaaaaccatcagtttcctgcaaagccattgagagagtcccagagccaccttcttactgattctcagtcttggacggagagcagcataaacccaggaaaatgcaaagctggtatgagcaatcctgcattaaccatggaaaatgagacttaactcttcaagcaagataaattcatactttataaaagtatcaatgctgtagatggatggaagaggcttcccacaggaaggtgccaccagtcagttgtgcctatgtccctttggctggaaatgcagaatatgaattgattagttctctccaagccattgcttaaaatataacatgttttggatccaatacacacattgttacaactaacacaaattcctattaaatattaaaagtagttctggtttattaatcaacggggaaaacatcttctccaaaaaacttggaataaatccaaggaccagtttttacccaaatatatgggtagcacagtttatcacatagaaactccattaatcatctgattttccgaatctgaaaattgagactattaagatattaagatttcagagatttcaagtcacattataatgataagcattattcataaaacttgttacctttaagaaggtggaagtggcaaaccatacttctttttttttcctctgatgtgaatccagcctcagactgagtgaactgtaataattatgaattcattacagagtccaggtggcctgcagttgaagatcatcaaccatttttgcctcacttaattccagccttttgttttctgctggaaaataagtgtggacattgaagcttgagctctcaaagcagttggctggaatacttttgtcagaatacggtacatttctattacatcagaaatatattttcatctcttcttgttaaattgggaggaaatttatgatagcaattatgaagattgttttatgacattcttttgtcagtttggctttctaaaaatctctttttagattatttctcctgttgaacatagtaaaactattgaatttctcttaagaattcctaataggtcaatagatttaccctccagtgatatctatattatttctttctcgtctcatcaaaatgatgacaggtaaactatatttttccttaaacacctattacagttaaattatgcaaatcattaaataaaaatcatacaacttttggaaagttagttcaacatgaactaaaatggcatgctatttggaaatttagtttgagataaactaaagtgtgttgatgccagaatgttcagcttcagtaaatataataagctcttgtgccttgtatgcactatttaaaaaaagttttttttatttgagtccagtataattcatgtaaatgttaacaattagaataatactctgtatgcttttttgatactgattttgagaatttaaagcagattaccttttaaaactggaccaactaagtaattggtatttaatcaaagagaaaatggtaataaacttttcaaaatctttgttaaaccaaacattcaacacaaaataaactagaaggccagaggataatggaataaaagatcattgcaattacttatccttcctaaaaatatagttttatattaattgtgcttatggaagaaacaatgtcagccaagtccattttatagtttgagtgcaattctttgaacaatagaaatatctgcagtctttcacagatttgtattatgctgaagagtttcatctgacaatctgcttcaagaaatctcagaaaatatgataacattttaactttcgttttagagcacgttttggtcatttttaaaaatacctaaagtgccagaccggaacctatagctactgctagaagtcttaaaaaaaccaacagcagcacaggatgtattaagaattatatgaagtcaggtttgtttttttttttttttttttcaaagcacagtactgttagctgtttttgtggacaggattcgattaagtattccctcttgtcaaactggaagctaggggaaaaagagggatttttatcctttactcttctagagtactgttaatgcccctttcccacagtcttttatataattaaatatatgtcaatacacattagaatcagatttgaaaaagttaaaacaatttcattgttgtaattgttccctttctgttttcatatagtgaataacctttaaagggttgttttgttttgttttgaattataggagttataatctttggagatgattgcatatctcattagatatgcaatataaatttatctgagtgaacaaagtgctaaataaatagatctacattttgtacatatttatataaaatttacctttaagtatttactttaaaaaatttaatggcttaactcgaacttgaagacacatacttcaactgtccttattgtccattaaactgataattttgatttttcttgcttttatagattttactatataggaatcaagatttaagaaattttgcattaaaaatagtgtaccaatgcttcatatacgttagttatttgctattatgtagggaagaggattgttatttcaaagatatattaaagaacagttgcatctgaatataatcatgatgcattcaatgaagttcatatccatgaattcactcctaatataccctaataaagtggttgaaaccgaaaaaaaaaaa

SEQ ID NO: 5570 - DNA, 2288 bp, Homo sapiens
aaagttaagagtggcgccagggatttgaaccgcgctgacgaagtttggtgatccatcttccgagtatcgccgggatttcgaatcgcgatgatcatcccctctctagaggagctggactccctcaagtacagtgacctgcagaacttagccaagagtctgggtctccgggccaacctgagggcaaccaagttgttaaaagccttgaaaggctacattaaacatgaggcaagaaaaggaaatgagaatcaggatgaaagtcaaacttctgcatcctcttgtgatgagactgagatacagatcagcaaccaggaagaagctgagagacagccacttggccatgtcaccaaaacaaggagaaggtgcaagactgtccgtgtggaccctgactcacagcagaatcattcagagataaaaataagtaatcccactgaattccagaatcatgaaaagcaggaaagccaggatctcagagctactgcaaaagttccttctccaccagacgagcaccaagaagctgagaatgctgtttcctcaggtaacagagattcaaaggtaccttcagaaggaaagaaatctctctacacagatgagtcatccaaacctggaaaaaataaaagaactgcaatcactactccaaactttaagaagcttcatgaagctcattttaaggaaatggagtccattgatcaatatattgagagaaaaaagaaacattttgaagaacacaattccatgaatgaactgaagcagcagcccatcaataagggaggggtcaggactccagtacctccaagaggaagactctctgtggcttctactcccatcagccaacgacgctcgcaaggccggtcttgtggccctgcaagtcagagtaccttgggtctgaaggggtcactcaagcgctctgctatctctgcagctaaaacgggtgtcaggttttcagctgctactaaagataatgagcataagcgttcactgaccaagactccagccagaaagtctgcacatgtgaccgtgtctgggggcaccccaaaaggcgaggctgtgcttgggacacacaaattaaagaccatcacggggaattctgctgctgttattaccccattcaagttgacaactgaggcaacgcagactccagtctccaataagaaaccagtgtttgatcttaaagcaagtttgtctcgtcccctcaactatgaaccacacaaaggaaagctaaaaccatgggggcaatctaaagaaaataattatctaaatcaacatgtcaacagaattaacttctacaagaaaacttacaaacaaccccatctccagacaaaggaagagcaacggaagaaacgcgagcaagaacgaaaggagaagaaagcaaaggttttgggaatgcgaaggggcctcattttggctgaagattaataattttttaacatcttgtaaatattcctgtattctcaacttttttccttttgtaaattttttttttttgctgtcatccccactttagtcacgagatctttttctgctaactgttcatagtctgtgtagtgtccatgggttcttcatgtgctatgatctctgaaaagacgttatcaccttaaagctcaaattctttgggatggtttttacttaagtccattaacaattcaggtttctaacgagacccatcctaaaattctgtttctagatttttaatgtcaagttcccaagttccccctgctggttctaatattaacagaactgcagtcttctgctagccaatagcatttacctgatggcagctagttatgcaagcttcaggagaatttgaacaataacaagaatagggtaagctgggatagaaaggccacctcttcactctctatagaatatagtaacctttatgaaacggggccatatagtttggttatgacatcaatattttacctaggtgaaattgtttaggcttatgtaccttcgttcaaatatcctcatgtaattgccatctgtcactcactatattcacaaaaataaaactctacaactcattctaacattgcttacttaaaagctacatagccctatcgaaatgcgaggattaatgctttaatgcttttagagacagggtctcactgtgttgcccaggctggtctcaaactccaccaaatgtacttcttattcattttatggaaaagactaggctttgcttagtatcatgtccatgtttccttcacctcagtggagcttctgagttttatactgctcaagatcgtcataaataaaattttttctcattgtcataaaaaaaaaaaaaa

SEQ ID NO: 5571 - DNA, 2415 bp, Homo sapiens
cccgcggctgccgccgccatttcgggcgctgctgtgaagctgaaaccggagccggtccgctgggcggcgggcgccgggggccggaggggcgcgcgcggcggcggcaccccagcgtttaggcgcggaggcagccatggcgggcaacttcgactcggaggagcggagtagctggtactgggggaggttgagtcggcaggaggcggtggcgctgctgcagggccagcggcacggggtgttcctggtgcgggactcgagcaccagccccggggactatgtgctcagcgtctcagagaactcgcgcgtctcccactacatcatcaacagcagcggcccgcgcccgccggtgccaccgtcgcccgcccagcctccgcccggggtgagcccctccagactccgaataggagatcaagagtttgattcattgcctgctttactggaattctacaaaatacactatttggacactacaacgttgatagaaccagtttccagatccaggcagggtagtggagtgattctcaggcaggaggaggcggagtatgtgcgagccctctttgactttaatgggaatgatgaggaagatcttccctttaagaaaggagacatcttgagaatccgggacaagcctgaagagcagtggtggaatgcggaggacagcgaaggcaagagagggatgattccagtcccttacgtcgagaagtatagacctgcctccgcctcagtatcggctctgattggaggtaaccaggagggttcccacccacagccactgggtgggccggagcctgggccctatgcccaacccagcgtcaacactccgctccctaacctccagaatgggcccatatatgccagggttatccagaagcgagtccccaatgcctacgacaagacagccttggctttggaggtcggtgagctggtaaaggttacgaagattaatgtgagtggtcagtgggaaggggagtgtaatggcaaacgaggtcacttcccattcacacatgtccgtctgctggatcaacagaatcccgatgaggacttcagctgagtatagttcaacagttttgctgacagatgggaacaatcttttttttttttttccaactgccatctatacaattttcttacagatgtcaaaagcagtctagtttatataagcattctgttacctgtgatattttttagactgaactgctccattcctagtcttaattaccatattcagggtacgaactggagggcttgtgtgttagcttctgaattggcaattggaggcggtagtggtcgtgcctgtgtgtatcagaagggataggtatcttgcctcctttctctcaggcagtgcaaatcaccctgtggaaaaccgatggacaggaaggagtgttacacactgcttaccctgatttattcagtggttttgttttcattctggaaccatactatcaaatggcgacagactgttccgttccacccccgtgaagtaatcatgcaccgtgtgaatagtatcaagcaggattgctttcattgtatggagcatgaccagcgtgtgactcattctgacatttcagatcctaagaattctaagaacactactagaagcatttgttccctcctagtcaatgcttcatactttttcttgggattcttttagcccttgacattcttgtcccccaaacctgtaagtaggtgaattcctaagataagtgtgtattttcattccaggtgaaaagcaggatgtaccgagcactttattcagtgcatagctttaagccagtgttggattcactaagtggacagccagtctcccagctctctgccttccccaaaagggtcgtagtaggtcacccttctacagcagctaactagagtcctaactaatgggatccagcagggccatttctccagagggccagtatcctattaggagactcttggaattcttaggttctactcaagagtggaaggaccaatcacctctgatattctgtggaaggttttggggtcaaattctgccctctgcattctgtgcaacttgtataaaagtcaagttagtattacatgaatttggggtagggttagtgctttgaaaaaatgttgaaccggctgggcgcggtggctcacgtctgtaatcccagcactttgggaggccgaggcgggtggatcatgaggtcaggagttcgagaccagcctggccaacatagtgaaaccccatctctgctaaagatataaaaaattagcccggcgtggtggtgcacgcctgtaatcccagctactcgggaggctgaggcaggagaattgcttcaacctgggaggtggaggctgcagtgagccgagatcgcaccactgcgttccagcctgagcgacagggcaagactcagtctcaaaaaaaaaaaaaaggaaaaaaaaaagaaaaaaaaa

SEQ ID NO: 5572 - DNA, 1112 bp, Homo sapiens
tagcacttcatagactgctatcacgcattcatttttactagtacctattgaacactaagttccaggcactgggctaggcactgggatggtgtggtgagcaaaaactgaccagtcctgccgtggagtttgctgggggagacacatgttactcaaagaatcacactaaggatagcaatttatctcaaagctgcaagttcctgccatctacatgtgcccagagtccccaaaattgagtgtcaaacagaggctgggtgacctcctgtccaggattgctctcatcgtatgaatcgaagttttcatcttaacgtgtttttttctcctgagaataggccaaccaatcaatggctcagacagataagccaacatgcatcccgccggagctgccgaagatgctgaaggagtttgccaaagccgccattagggtgcagccgcaggacctcatccagtgggcagccgattattttgaggccctgtcccgtggagagacgcctccggtgagagagcggtctgagcgagtcgctttgtgtaaccgggcagagctaacacctgagctgttaaagatcctgcattctcaggttgctggcagactgatcatccgtgcagaggagctggcccagatgtggaaagtggtgaatctcccaacagatctgtttaatagtgtgatgaatgtgggtcgcttcacggaggagatcgagtggctgaagtttttagcccttgcttgcagcgctctgggagttactattaccaaaactctcaagatagtgtgtgaggtcttatcatgtgaccataatggtgggtcgccccggatcccgttcagcaccttccagtttctctacacgtatattgccaaagtggatggggagatctctgcatcacatgtcagcaggatgctaaactacatggaacaggaagtaattggccctgatggtataatcacagtgaatgactttacccaaaaccccagggttcagctggagtaaaagcacaattttggcaattttaaaggaagatacagagatgattgtacttcagaatgactgaaacccatataccacccaaaatccattttcttgtacaactggtacacactaataaacaattaaaaaaaaaaa

SEQ ID NO: 5573 - DNA, 2480 bp, Homo sapiens
agtactaacatggactaatctgtgggagcagtttattccagtatcacccagggtgcagccacaccaggactgtgttgaagggtgttttttttcttttaaatgtaatacctcctcatcttttcttcttacacagtgtctgagaacatttacattatagataagtagtacatggtggataacttctacttttaggaggactactctcttctgacagtcctagactggtcttctacactaagacaccatgaaggagtatgtgctcctattattcctggctttgtgctctgccaaacccttctttagcccttcacacatcgcactgaagaatatgatgctgaaggatatggaagacacagatgatgatgatgatgatgatgatgatgatgatgatgatgatgaggacaactctctttttccaacaagagagccaagaagccatttttttccatttgatctgtttccaatgtgtccatttggatgtcagtgctattcacgagttgtacattgctcagatttaggtttgacctcagtcccaaccaacattccatttgatactcgaatgcttgatcttcaaaacaataaaattaaggaaatcaaagaaaatgattttaaaggactcacttcactttatggtctgatcctgaacaacaacaagctaacgaagattcacccaaaagcctttctaaccacaaagaagttgcgaaggctgtatctgtcccacaatcaactaagtgaaataccacttaatcttcccaaatcattagcagaactcagaattcatgaaaataaagttaagaaaatacaaaaggacacattcaaaggaatgaatgctttacacgttttggaaatgagtgcaaaccctcttgataataatgggatagagccaggggcatttgaaggggtgacggtgttccatatcagaattgcagaagcaaaactgacctcagttcctaaaggcttaccaccaactttattggagcttcacttagattataataaaatttcaacagtggaacttgaggattttaaacgatacaaagaactacaaaggctgggcctaggaaacaacaaaatcacagatatcgaaaatgggagtcttgctaacataccacgtgtgagagaaatacatttggaaaacaataaactaaaaaaaatcccttcaggattaccagagttgaaatacctccagataatcttccttcattctaattcaattgcaagagtgggagtaaatgacttctgtccaacagtgccaaagatgaagaaatctttatacagtgcaataagtttattcaacaacccggtgaaatactgggaaatgcaacctgcaacatttcgttgtgttttgagcagaatgagtgttcagcttgggaactttggaatgtaataattagtaattggtaatgtccatttaatataagattcaaaaatccctacatttggaatacttgaactctattaataatggtagtattatatatacaagcaaatatctattctcaagtggtaagtccactgacttattttatgacaagaaatttcaacggaattttgccaaactattgatacataagggttgagagaaacaagcatctattgcagtttctttttgcgtacaaatgatcttacataaatctcatgcttgaccattcctttcttcataacaaaaaagtaagatattcggtatttaacactttgttatcaagcatattttaaaaagaactgtactgtaaatggaatgcttgacttagcaaaatttgtgctctttcatttgctgttagaaaaacagaattaacaaagacagtaatgtgaagagtgcattacactattcttattctttagtaacttgggtagtactgtaatatttttaatcatcttaaagtatgatttgatataatcttattgaaattaccttatcatgtcttagagcccgtctttatgtttaaaactaatttcttaaaataaagccttcagtaaatgttcattaccaacttgataaatgctactcataagagctggtttggggctatagcatatgcttttttttttttaattattacctgatttaaaaatctctgtaaaaacgtgtagtgtttcataaaatctgtaactcgcattttaatgatccgctattataagcttttaatagcatgaaaattgttaggctatataacattgccacttcaactctaaggaatatttttgagatatccctttggaagaccttgcttggaagagcctggacactaacaattctacaccaaattgtctcttcaaatacgtatggactggataactctgagaaacacatctagtataactgaataagcagagcatcaaattaaacagacagaaaccgaaagctctatataaatgctcagagttctttatgtatttcttattggcattcaacatatgtaaaatcagaaaacagggaaattttcattaaaaatattggtttgaaataaaaaaaaaaaaaa

SEQ ID NO: 5574 - DNA, 7239 bp, Homo sapiens
cacctcgcggccgtaggctaacgtggaagtcggaccagccggccggcggaagaacctagagcgcgctgcctggcgagtcaggcgcgcggggcggcgttggtggtcttcgcggcgcaactcggcctttcctgggagggagtgatggggcgcaccggggccggggagcgggcgccagtgtagcccgcgcggcgcctggcccggagcgcggcggctgcggcggcggcggcggcgggcgctggaggcctgtgagagccgcagcccggagcgcccggcttcccacgccatggcccccatgggcatccgcctttccccactgggggtggcagtgttttgcctgctggggctcggcgtgctctaccacctctactcgggcttcttggccggccgcttcagcctcttcggcctgggcggcgagcctggcggcggcgcggcggggcccgcggccgcggccgatgggggcaccgtggacttgcgcgagatgctggctgtgtcagtgctggccgcagtccgcggcggcgacgaggtgaggcgcgtccgcgagagcaacgtcctccacgagaagtccaaggggaagacgcgcgagggagccgaggacaagatgaccagcggcgacgtgctgtccaaccgcaagatgttctacctgctcaagaccgccttccccagcgtccagattaatactgaggaacacgtggatgcagctgatcaggaggttatcttgtgggatcataagattcctgaggatatcctaaaggaagtaactactcctaaagaggtaccagcagaaagtgttactgtctggattgacccacttgatgctacacaggaatatacagaggatcttcgaaagtacgtcactactatggtgtgtgtggctgtaaatggtaaacccatgctaggagttatacataagccattttccgaatatacagcttgggcaatggtagatggtggttcaaatgtgaaagcccgctcttcctacaatgagaagaccccaaggatcgttgtgtctcgttcccattcagggatggtcaaacaggtcgctcttcagacttttggaaaccagactacaattatcccagctggtggtgctggttataaagttttagcacttttggatgtgcctgataagagtcaagaaaaagctgatttatacatccatgtgacatacatcaaaaagtgggatatatgtgctggtaatgccatcttaaaagccctaggggggcatatgactaccctgagtggtgaagaaatcagttacactggttcagacggcattgaagggggactccttgctagcatcagaatgaaccaccaggccctggtcagaaaactcccagatctagaaaagacaggacataaatgagcataactgattacagggtacagttcttcacagctgaaatggttagcctgagatgctggaagcttcaaaggattggtggagactatgcatggttaaggccatcccgaactttttaaagtatttatgaagcatcagagacttattttccctgtaatagaatgcaaaatcagggaaaatgggttgctttgtgtctcaagtattgtctttatttttgagactattttcatacagttgtcatacacaaggcgcatatatatatttgtgaattaaaatctgtagctgagtctacattgttatgagtcaccattttcacacaacatcatgaatcttcactgttagtactttcatatagaattcggttgaaggaaagattgatttttgtgtagatgtttaatataactttacaactatatctcattgaaaataaagtcattggggatttttacctctaatttggatggaaagcacaagaagccacacattcattaatatgcaacaaatgttgtatttatgttactgaatatttctatggattaaaatagaaaaagtttaattgattttttcttttaaattttaataacaggttcaccagctggtagaaaatagagacacatgatgatttgcattgtaataatttctgtgtgtatgtgtgtgtgttgttttgtttttataaagaaaagtgtgtttgtacccatgagttcagcatttctgccatcttgctattttcattttccctgtggaagatgcatggttgcatccttttccttctgaccaacacttagtctttaactttgtaaggttcggtttaaggtttcagggttagcactatagttttggttcattttctcattaacgataaaatatgctgtaaggcactataagaatataaatgattctattacaattgaaagttacttgacattacatgaattgaactgcctttcattatcttcagacactttgttttagtatttttttttaatttgctaggtttgtatatagaagatcctttcattatcaagaatgagtatggttgcttttgccatggttgcttttactattaataaatgtatctagcctacccaaactctgtagtaacttttgagattctcttaatttcccctcagattaaaatagagaaggttgaaggtactttttgatgaaatttttttctagtctggttagaaaaaaaaagttgtgacatattcattgtgttaccgtaactagaaccttgctttgtgaactgtctttcattgggatgtatggtttctctcaatgtgaaatctggaaacttcatgtaaactacccatgccgttatttcatgtgactccagtgcccttgtattccataacatgctgatgagagggatttctcacggtttctttctttgctaaattttttaaccataaagcagcttaccctttattttcccatcttggaagtaaaattgaccaaagaatgtacgttctagcctggtggaatgtgcatactttaggtttgtatgttacattgtccaaagccctttactttcttattagtaaactgaatctaatatgacacaaatgttttcacccaatctcttgcaactggtcaaattcgagaaggtgttgggccttagcagtaggccttttcagtgaaaattcattcaaagttttggtaggtggaacacttgatatttaaataggacttgaaaattttgaaaagagtatcagagacctcatttttttcctttgcaataagctgaagaaactttctttttcaggagagatggcaaaggtatatgctgttgccagagtcctgtggtataagcatctgtttttattatagtatgtcaaagttagggaaatgggactggcaagtaaaaaatggaatttaatttcaatgttttatgggaactctgatttaatgggaagcaaactagttcatattagcaggaattattttattttttcgagacagagtttcactctcgttggccaggctggagtgcaatggcgtgatctcggctcaccgcaacctctgcttcccgggttcaagcgattctcctgcctcagcctcccaagtagctgggattacaggcatacaccaccacacccagctaatttttttgtatttttgttagagacagggtttctccatgttggtcaggctggtctcgaactcccgacctcaggtgatccgcccacctcggcctcccaaagtgatgattttatttttatttttaattgtattaatctgcatctagataatgactttgtgaagggtgtgtgttgtgtgcaaaacttaaggtattggttgagagttaaatacattatttttataatatgttgggtatagtctagttactaatgattttttttaagtacttttataaaaagttcatttttaaaattgtttgtttttaaaagccaatatacgttgcagaattaggaacagtatttatatttatttacacaagacattgtgccatagcatcctagtaaaacaccttcatgaatgagtaatgttatctcccagaattacattaaaattatttctaaaaagtagcaaagtcattaccttttgcttttaatgacccacacctcaccagctcctggtcttttcttcactgttgcccttattttgaggcaatttttcttaaaatatgacttttatgcaccacatttagtagaggcagtgacatcagtgatctcagtacccatcagctgtccccctcctctgcccttcttcatctcttctaccttgtgaccatttcccttaccggttcatgttctcctttatctctgcttttctttcttagccaggatacttccctcacaactctcactcccaaattcttttagatatacatttttctggatattggctgctgaaatctgaagctctggtaaagttcctagtatcagagatcaatcctggaggaggcctagttcactattagattacaaagactcctcacaaagtaaaggaaaatcaccttcaaaaccacaaccctttatgttgtcaagtctaatatgagtgtttttacgaagtatttctttctacccattgttcaagaatgtaaatgtaaaaaaaaatacaagagagttgggtagatatgcatgcttgaggaaacttgcttttactgttttcctacttgtatccccagttcagttgaatttacaaggacctacaagatggtcatgtttgtcttggtatgtgctaccccaattttagtgtttctttctttattttaaatcagtaattattcagttgattgtttatactatataatgaagtaacaaaaacattttggtttgtatgttttaagtaacagttgtgcaaattcctcttgtttgttaggtgctccctttgaatattttgtgaactgtgtcagagggagaggggtggtggctaggaagagggtcagaaagaagctagagggaggtcaggagaagggtaacagggaggatgcaaagcagacatctaccctggtcaccccaggatcaggatatctgtccttgtttcatgttgaattcaaaaattggatctcacttaggctttgaaggtgacagccatctctgatagctgagcataagtaaagaaaggtggagtgccgatgcagaaaggaaaatattcagctttcctctcttagatcgcactttgaagatggccttttggagacaatctgacaggttaaaacaggaactgttggaattattctagctgtaactacctattggctatgtgttgattgatcctagaaagaaaaaataatttttcattttagatcttgattgaatttaagatgtatttatatgcctacaaaaggtctgtcttgtaactgttgtataaaataaacctaatctatggtttcatttttaatctaaaaaaagttgtgccttaacaatagggcattgtatgttaataagggaaaacaacctttttagtagatgggggaaaataggaactttttgccattaaaacttaagttcttttgatgtttttaatattatagttgggggagattcattaaaattaaattgaaataaaattatttttgcataacctagcatttacaactaaagtatgttttttataagaactggcatcttgatgtatataggtctgaaataatatttcatcttttgatttttaattttaataatattagaccaggatagatcacagttttacaaatcttagttttaaataaattatttcagtgtgctgttagtcctctacagtcattttggtttaaaaagtgactatttatttatggtagcatatcaataatttattaatgttaaaaaatactgtgtatgacattacaaaccagaacagttcctgggggagaggattctaattgattggcagttctgagagggcaagaagaatggaactttatacttcaaaaggaggttttggttttaccaggtactgcttatgtaaatcgtttatttttatttcatcaaagcctggcaagtatatgcattccaatttaccattggcaaagctttatttatttttaaggttggatgttgaattaattttgtgggaaaatgagatttgtaagtagttttctttctagataagataacataaaccaaactttcagaagttaaggatgatgaataatattgaaatgacttgttatatattgtaagggttcccttaagtatcataattaacaatttgtggaaattgaaaaagcataaactgtgttatttgattagtaatatgttcccttaaaattcattttgaggtgtatgttatacacacagtaaatttttgttcaggaatgacttgctcattctgtgtttttaaaaataggaaataaggcatagtgagtcatcattacatcaattaaccaaaaaatatttcatcccctccgtcactgaaattatctacttcagccacctttcttattctcgtgttaggagggcacgtttatggactttttaatttccatgtgccatattgtccactaccggcagtagccaaagctagctgtttcagtcccacagaagagacagtgctctgccatgatgacagggcactgctagggctggtttttcttgtttttcccttttggcagtgtggacttcaggaactagatgtatatgcacaagggattgagtttacactaaaactaggaaatggagttttcaatctatgttcttgcctcttcatacttttatttattttttgtcatcctgccttatactgggctaacaatgagataaaataaaaatacctttgaatactcttttccctttcatgcatttaaagccatggaggaactagaccattagctgttgccgtcacatgcttagacaccagtttacttagcgtgttatgaccttcctcacccatactaccaaatttaaatgggtcccgacttcaccctctggaaggaagtaaactcttctctccccatggtttcagagcagtttttacctgcaagcaccatctctgtatgtgctcttactagattatacagttcttgagagggattgcatcttagtgtttttgtatttccacctcacccccagcacatagcccagtctcttgcacaaattaagtacttaatgtgtgttgagctaaattgaataaaggattattagcattagcatattttgtgccttggttgtataagctggttgtttgttttgttacctttgcaaatatttatgattatcacccccccacatactaaattgtttttaaaagttttgcctttccttcagatactaccccaggcaatttgctgtagataatgtgattgcttccaatgacataattatcccaaactctctgccccggatatactttgccaaacgaaatttgaattctctgaataaattggtcatgtctaaaagagaaaaaaaaaaaaa

SEQ ID NO: 5575 - DNA, 3393 bp, Homo sapiens
gtttccgggacgttcggagggtggcctctctcccaccgggttccgcataccccaggcaccggcccgcatccaagtgtcaggttggagccgggaagcggccctggtggtagcggcggcgggggcaggatgagcgcggaggcggcggaccgggaggcggccacctccagccggccctgcaccccgccgcagacctgctggtttgagtttctgctggaggagtcactgttggagaaacatctgcgcaagccctgcccggatcctgcaccagttcaacttatagttcagtttttggaacaggcttccaaaccttcagttaatgaacaaaaccaagttcaacctccgcctgataacaagagaaatcgtattttaaaactacttgctcttaaagttgctgcacatttgaagtgggacttagacatattagagaaaagtttgtctgttccagtattgaatatgctactaaatgaactactctgcatcagtaaagttcctcctgggacaaagcatgtagacatggatctggccactttacctccgaccactgccatggctgtacttctctataatagatgggcaattaggacaattgttcaaagtagttttccagtcaaacaggcaaaacccggaccccctcagttaagtgttatgaatcaaatgcaacaggaaaaagagctaacagaaaacattttgaaagtgctcaaagaacaagctgctgattctattttggtactagaagcagccctaaaattaaacaaggatctttatgtccatacgatgagaactctagatttattggccatggaaccaggcatggtaaatggagaaactgagagttctactgctggattgaaagtcaaaaccgaagaaatgcagtgccaggtgtgctatgatttgggcgcagcatacttccagcaaggctccacaaattcagctgtctatgaaaatgccagggaaaaattttttagaaccaaagaactaattgcagagataggttcattatctcttcattgtaccatagatgagaagcggttagctggctattgtcaagcatgtgatgttcttgtaccttcttctgatagtacatctcaacagttgactccatatagtcaagtccatatttgtttgagatctggcaactatcaggaggtaatacagattttcattgaagacaacttaaccttgagtttacctgtccagttccgacagtcagtcctaagagaactctttaagaaagctcaacagggaaatgaagctctagatgaaatctgttttaaagtttgtgcctgtaatacagtccgtgatatactggaaggcagaacaattagtgttcaatttaaccagctatttcttagaccaaataaagagaaaatagactttcttcttgaggtatgttcaagatcagtaaatttagaaaaagcttcagagtctttgaaaggaaacatggctgcttttctaaagaatgtgtgtctggggttggaagatctgcagtatgttttcatgatttcttcacatgagcttttcattacattgttgaaagatgaagaacgaaagctacttgttgatcagatgaggaagagatcccctagagtaaatctgtgcattaaacctgtaacttcattttatgatatcccagcttcagcaagtgtcaacattggtcagttagagcatcaacttatattgtcagtggatccttggaggattagacaaattttaattgaattacatggtatgacttcagagcgccagttctggacagtgtctaataagtgggaagtaccttctgtctatagtggtgttatcctgggaattaaagacaatttaacaagagatttggtttatattcttatggccaaaggtttgcactgcagtactgttaaggacttttcccatgctaaacagctctttgctgcttgtttggagttggtaacagagttctcaccgaagcttcgtcaggtcatgctgaatgagatgttgcttttggatattcatacacacgaagctgggacagggcaggcaggagagagaccgccatccgaccttataagtagagtacgaggctatctggaaatgaggcttcctgatattcctcttcgtcaagttatagctgaggaatgtgttgcctttatgttaaactggagagaaaatgaataccttacactccaagttcctgcatttttgcttcagagtaatccatatgtaaagcttggacagcttttagcagctacatgcaaagaacttccaggccctaaagaaagcagacggactgccaaagacctttgggaagttgttgttcaaatctgtagtgtgtccagtcagcacaaacgaggaaatgatggcagagttagtttaataaaacagagggaatctacgttaggtatcatgtatcggagtgaactgctttcttttatcaaaaaattacgagaaccactcgttttgactattattttatcactctttgtgaaacttcacaatgttcgggaggacattgtgaatgatattacagctgaacacatttctatttggccatcttccattcccaacctccagtctgtggactttgaagctgtggcaatcacagtgaaagagctagttcgatatacactcagtataaatccaaataaccattcttggttaattatccaggcagatatttactttgcaacgaatcagtattcagcagctcttcactattacctccaggcaggagctgtgtgttctgacttctttaacaaggctgtgccccctgatgtttatacagaccaggtaataaaacgaatgataaaatgttgttctttgctgaattgccacacacaggtggctattttatgtcagttcctcagagaaattgactacaaaacagcgtttaaatctctgcaagaacaaaacagtcatgatgctatggactcctactacgactacatatgggatgttaccattttggaatacttgacttatcttcatcataaaagaggagaaacagataaaagacaaattgcaatcaaagccatcggccagacagagttgaatgcaagcaatccagaagaagtgttacagctggcagcgcagagaaggaaaaaaaagtttctccaagcaatggcaaaactttacttttaagcagttaaatttttttaacttttattttttaaacaatgggctaaaaataaacagtattaaaaggttaagtttatataatacatatgtacacaattagtggtgttttcttttcagacaaaatactgaaacaaatattagtttaaaaacaaactatacagaagacttcataccgtaacaataaatgtatagtttcttcaaagggagaagagattcacatatctgataacaaaataaactagcaatctagttttctaatctaaaaaaaaaaaaaaaaaaaaa

SEQ ID NO: 5576 - DNA, 1025 bp, Homo sapiens
gttatatgaggccccgctccggccccacgcggaacccgcggctccgagccttcgccggcgtcccgacccgaggccggacccgaggccagtcccgccgctgcgcagccgaagccagtgcggggcctgagagggacgcgcgccccggggcccccgccgcgggcaccatgggcgctgcccactccgcgtctgaggaggtgcgggagctcgagggcaagaccggcttctcatcggatcagatcgagcagctccatcggagatttaagcagctgagtggagatcagcctaccattcgcaaggagaacttcaacaatgtcccggacctggagctcaaccccatccgatccaaaattgttcgtgccttcttcgacaacaggaacctgcgcaagggacccagtggcctggctgatgagatcaatttcgaggacttcctgaccatcatgtcctacttccggcccatcgacaccaccatggacgaggaacaggtggagctgtcccggaaggagaagctgagatttctgttccacatgtacgactcggacagcgacggccgcatcactctggaagaatatcgaaatgtggtcgaggagctgctgtcgggaaaccctcacatcgagaaggagtccgctcgctccatcgccgacggggccatgatggaggcggccagcgtgtgcatggggcagatggagcctgatcaggtgtacgaggggatcaccttcgaggacttcctgaagatctggcaggggatcgacattgagaccaagatgcacgtccgcttccttaacatggaaaccatggccctctgccactgacccaccgccacctccgcggagaaactgcactttgcaatggggccgcctccccgcgtagctggagcagcccaggcccggcggacagcctcttcctgcagcgccggtacatagccaaggctcgtctgcgcaccttgtgtcttgtagggtatggtatgtgggacttcgctgtttttatctccaataaaaaaaaaaaaaaggtttgttaattaaaaaaaa

SEQ ID NO: 5577 - DNA, 3958 bp, Homo sapiens
ttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccccagcacttaagcaaacgggaattctcgcccgagcctcttgaagccattcttacagatgatgaaccagaccacggcccgttgggagctccagaaggggatcatgacctcctcacctgtgggcagtgccagatgaacttcccattgggggacattcttatttttatcgagcacaaacggaaacaatgcaatggcagcctctgcttagaaaaagctgtggataagccaccttccccttcaccaatcgagatgaaaaaagcatccaatcccgtggaggttggcatccaggtcacgccagaggatgacgattgtttatcaacgtcatctagaggaatttgccccaaacaggaacacatagcagataaacttctgcactggaggggcctctcctcccctcgttctgcacatggagctctaatccccacgcctgggatgagtgcagaatatgccccgcagggtatttgtaaagatgagcccagcagctacacatgtacaacttgcaaacagccattcaccagtgcatggtttctcttgcaacacgcacagaacactcatggattaagaatctacttagaaagcgaacacggaagtcccctgaccccgcgggttggtatcccttcaggactaggtgcagaatgtccttcccagccacctctccatgggattcatattgcagacaataacccctttaacctgctaagaataccaggatcagtatcgagagaggcttccggcctggcagaagggcgctttccacccactccccccctgtttagtccaccaccgagacatcacttggacccccaccgcatagagcgcctgggggcggaagagatggccctggccacccatcacccgagtgcctttgacagggtgctgcggttgaatccaatggctatggagcctcccgccatggatttctctaggagacttagagagctggcagggaacacgtctagcccaccgctgtccccaggccggcccagccctatgcaaaggttactgcaaccattccagccaggtagcaagccgcccttcctggcgacgccccccctccctcctctgcaatccgcccctcctccctcccagcccccggtcaagtccaagtcatgcgagttctgcggcaagacgttcaaatttcagagcaacctggtggtgcaccggcgcagccacacgggcgagaagccctacaagtgcaacctgtgcgaccacgcgtgcacccaggccagcaagctgaagcgccacatgaagacgcacatgcacaaatcgtcccccatgacggtcaagtccgacgacggtctctccaccgccagctccccggaacccggcaccagcgacttggtgggcagcgccagcagcgcgctcaagtccgtggtggccaagttcaagagcgagaacgaccccaacctgatcccggagaacggggacgaggaggaagaggaggacgacgaggaagaggaagaagaggaggaagaggaggaggaggagctgacggagagcgagagggtggactacggcttcgggctgagcctggaggcggcgcgccaccacgagaacagctcgcggggcgcggtcgtgggcgtgggcgacgagagccgcgccctgcccgacgtcatgcagggcatggtgctcagctccatgcagcacttcagcgaggccttccaccaggtcctgggcgagaagcataagcgcggccacctggccgaggccgagggccacagggacacttgcgacgaagactcggtggccggcgagtcggaccgcatagacgatggcactgttaatggccgcggctgctccccgggcgagtcggcctcggggggcctgtccaaaaagctgctgctgggcagccccagctcgctgagccccttctctaagcgcatcaagctcgagaaggagttcgacctgcccccggccgcgatgcccaacacggagaacgtgtactcgcagtggctcgccggctacgcggcctccaggcagctcaaagatcccttccttagcttcggagactccagacaatcgccttttgcctcctcgtcggagcactcctcggagaacgggagtttgcgcttctccacaccgcccggggagctggacggagggatctcggggcgcagcggcacgggaagtggagggagcacgccccatattagtggtccgggcccgggcaggcccagctcaaaagagggcagacgcagcgacacttgttcttcacacacccccattcggcgtagtacccagagagctcaagatgtgtggcagttttcggatggaagctcgagagcccttaagttctgagaaaatttgaagcccccaggggtggggtggacgcgtgccgcccagtcgacgtcagcgtggtctgtcatcctgctagtttgtgatgttttctgacagtagcctccaagaagccgttgtgcgaagacagagtcctgcagagtccttccagcctaggcctgcagcgccattttatttatattttttaataaaaagtaaaaacaaaaaaacagacccacattggaacagtgaatcagtcccatagagagggcccgtggaccatcgctgtcatgagtgatgccctggcccttctgaaaccagccaacctaattacctgtattgtggaaatgcgcatgagtccccaaccccttgtttctatacattctatgttgtcttttaaaaagtgtgcttaacattgacacaataaatgttggagctttaggtggtgtttgcttgttctttaatttttaatgcttataagacaatgaggctgcttatgattttgtacttctgtacctgtttcctacagacacccatcgggtgggtaggaggaacagatttgagaaatgggcaggagatgtaggaggggaactaggttaccgcttatcagatggcataaattttcaaggagaatcaaaatgcaaaacttgggaataaatcatagcaatatcataattaatgtagtagtaatattgctgtttattaatgctgaagtgtggttttcctaactgtctgacttataatttgcataccattaaataatgcataatatggcacgccgaatcctgtttttcaaatatatgcttttggtggctaccatgcaggatttgaatttgtcttttaatttagcttaggaaagaacatcactgggcgagcggtaaatcctaaagaaggtgataaatgtcagtagtttcttattaaatattctaattttaggttcccaaaccttcaggaaatatatcttaatgcagacaaacaaacataaaacttctttagtacttacatcaggaaatttggggcagattttagaggggggaaattataggaggaaagaagttcacatcagaacagacaatcacagcaatgctctattccttagaaattagtgccacaaataagttacatctacaaacaggtggtaaaaattctttctggcccagttaatttgcacagaacttttctcagtttggtattttttactgcttggagatccagaagagaattagaaacaacatagcaaattaaaataggtttgtcaataatagagctcagacacctgtgtgctgtagattcacatacaggccgtgaacctaagtggggaaaatcctacctatccaccttctggctagattacctagcttagtgaaaagatagccaaataattggcatgtgaattatttcctgcttattcataataaataatgactgtcta

SEQ ID NO: 5578 - DNA, 4498 bp, Homo sapiens
agaggccgccggggccgtggatggggagggcgcgccgcccggcggtcccagcgcacaggcggccacgatgagggtcaacgagaagtactcgacgctcccggccgaggaccgcagcgtccacatcatcaacatctgcgccatcgaggacatcggctacctgccgtccgagggcacgctgctgaactccttatctgtggaccctgatgccgagtgcaagtatggcctgtacttcagggacggccggcgcaaggtggactacatcctggtgtaccatcacaagaggccctcgggcaaccggaccctggtcaggagggtgcagcacagcgacaccccctctggggctcgcagcgtcaagcaggaccaccccctgccgggcaagggggcgtcgctggatgcaggctcgggggagcccccgatggactaccacgaggatgacaagcgcttccgcagggaggagtacgagggcaacctcctggaggcgggcctggagctggagcgggacgaggacactaaaatccacggagtcgggtttgtgaaaatccatgccccctggaacgtgctgtgcagagaggccgagtttctgaaactgaagatgccgacgaagaagatgtaccacattaatgagacccgtggcctcctgaaaaaaatcaactctgtgctccagaaaatcacagatcccatccagcccaaagtggctgagcacaggccccagaccatgaagagactctcctatcccttctcccgggagaagcagcatctatttgacttgtctgataaggattcctttttcgacagcaaaacccggagcacgattgtctatgagatcttgaagagaacgacgtgtacaaaggccaagtacagcatgggcatcacgagcctgctggccaatggtgtgtacgcggctgcatacccactgcacgatggagactacaacggtgaaaacgtcgagttcaacgacagaaaactcctgtacgaagagtgggcacgctatggagttttctataagtaccagcccatcgacctggtcaggaagtattttggggagaagatcggcctgtacttcgcctggctgggcgtgtacacccagatgctcatccctgcctccatcgtgggaatcattgtcttcctgtacggatgcgccaccatggatgaaaacatccccagcatggagatgtgtgaccagagacacaatatcaccatgtgcccgctttgcgacaagacctgcagctactggaagatgagctcagcctgcgccacggcccgcgccagccacctcttcgacaaccccgccacggtcttcttctctgtcttcatggccctctgggctgccaccttcatggagcactggaagcggaaacagatgcgactcaactaccgctgggacctcacgggctttgaagaggaagaggaggctgtcaaggatcatcctagagctgaatacgaagccagagtcttggagaagtctctgaagaaagagtccagaaacaaagagactgacaaagtgaagctgacatggagagatcggttcccagcctacctcactaacttggtctccatcatcttcatgattgcagtgacgtttgccatcgtcctcggcgtcatcatctacagaatctccatggccgccgccttggccatgaactcctccccctccgtgcggtccaacatccgggtcacagtcacagccaccgcagtcatcatcaacctagtggtcatcatcctcctggacgaggtgtatggctgcatagcccgatggctcaccaagatcgaggtcccaaagacggagaaaagctttgaggagaggctgatcttcaaggctttcctgctgaagtttgtgaattcctacacccccatcttttacgtggcgttcttcaaaggccggtttgttggacgcccgggcgactacgtgtacattttccgttccttccgaatggaagagtgtgcgccagggggctgcctgatggagctatgcatccagctcagcatcatcatgctggggaaacagctgatccagaacaacctgttcgagatcggcatcccgaagatgaagaagctcatccgctacctgaagctgaagcagcagagcccccctgaccacgaggagtgtgtgaagaggaaacagcggtacgaggtggattacaacctggagcccttcgcgggcctcaccccagagtacatggaaatgatcatccagtttggcttcgtcaccctgtttgtcgcctccttccccctggccccactgtttgcgctgctgaacaacatcatcgagatccgcctggacgccaaaaagtttgtcactgagctccgaaggccggtagctgtcagagccaaagacatcggaatctggtacaatatcctcagaggcattgggaagcttgctgtcatcatcaatgccttcgtgatctccttcacgtctgacttcatcccgcgcctggtgtacctctacatgtacagtaagaacgggaccatgcacggcttcgtcaaccacaccctctcctccttcaacgtcagtgacttccagaacggcacggcccccaatgaccccctggacctgggctacgaggtgcagatctgcaggtataaagactaccgagagccgccgtggtcggaaaacaagtacgacatctccaaggacttctgggccgtcctggcagcccggctggcgtttgtcatcgtcttccagaacctggtcatgttcatgagcgactttgtggactgggtcatcccggacatccccaaggacatcagccagcagatccacaaggagaaggtgctcatggtggagctgttcatgcgggaggagcaagacaagcagcagctgctggaaacctggatggagaaggagcggcagaaggacgagccgccgtgcaaccaccacaacaccaaagcctgcccagacagcctcggcagcccagcccccagccatgcctaccacgggggcgtcctgtagctatgccagcggggctgggcaggccagccgggcatcctgaccgatgggcaccctctcccagggcaggcggcttcccgctcccaccagggcccggtgggtcctgggttttctgcaaacatggaggaccactttctgataggacattttcctttcttctttctgttttctttcccttgtttttgcacaaagccattatgcagggaatattttttaatctgtagtattcaagatgaatcaaaatgatggctggtaatacggcaataaggtagcaaaggcaggtgctttgcagaaagaatgcttggaaacttgagtctccctagaggtgaaaagtgagcagaggcccctagaaaccctcctctgaatcctcctaattccttaagatagatgcaaaatggtaagccgaggcatcgcgcaaaagctggtgcgatgcttcagggaaaatggaaaacccacgcaagaataatgattgattccggttccaaaaggtgtcacctacctgtttcagaaaagttagactttccatcgccttttccttccatcagttgagtggctgagagagaagtgcctcatccctgagccacacagggggcgtgggagcatcccagttatccctggaaagctagaaggggacagaggtgtccctgattaagcaggaaacagcacccttggcgtccccagcaggctccccactgtcagccacacacctgcccccatcacaccaagccgacctcagagttgttcatcttccttatgggacaaaaccggttgaccagaaaatgggcagagagagatgacctcggaagcatttccacagatggtgtcagggtttcaagaagtcttagggcttccaggggtcccctggaagctttagaatatttatgggtttttttttcaaatatcaattatatggtagattgaggattttttttctgtagctcaaaggtggagggagtttattagttaaccaaatatcgttgagaggaatttaaaatactgttactaccaaagatttttattaataaaggcttatattttggtaacacttctctatatttttactcacaggaatgtcactgttggacaattattttaaaagtgtataaaaccaagtctcataaatgatatgagtgatctaaatttgcagcaatgatactaaacaactctctgaaatttctcaagcaccaagagaaacatcattttagcaaaggccaggaggaaaaatagaaataaatttgtcttgaagatctcattgatgtgatgttacattccctttaatctgccaactgtggtcaaagttcataggtgtcgtacatttccattatttgctaaaatcatgcaatctgatgcttctcttttctcttgtacagtaagtagtttgaagtgggttttgtatataaatactgtattaaaaattaggcaattaccaaaaatccttttatggaaaccatttttttaaaaagtgaatgtacacaaatccacagaggactgtggctggacattcatctaaataaatttgaatatacgaaaaaaaaaaaaaaaaaaaaaaaa

SEQ ID NO: 5579 - DNA, 2467 bp, Homo sapiens
tcttccgggtgagggtcctgcagcccgtgaatccctggtcccgccgagacttggacctggtgcgaactggaggcgaagcgggtgcacccacaacctataggaagggctggcggcgagctctgagcactcgggcgtcggagggaacgctctgctttcaacactcttggccctttctcaagagaacatgaaaatgaaaaaatttcagataccagtttcattccaggacctgactgtgaacttcacccaagaggaatggcagcaactggaccctgctcagaggctcctgtacagggatgtgatgctggagaactacagcaacttggtctctgtggggtatcatgttagcaaaccagatgtgattttcaaattggagcaaggagaagagccatggatagtggaggaattctcaaatcagaactacccagacattgatgatgccttagagaagaacaaggaaatccaagataaacatttgacacaaactgtattcttcagcaacaaaacactgattacagaaagagagaatgtatttgggaaaacacttaatctgggcatgaatagtgttccctcaagaaaaatgccctataaatgtaatccaggaggaaacagtttgaaaactaattcagaagtaattgttgcaaagaaaagcaaagaaaacagaaagattcctgatggatacagtggatttgggaagcatgagaaaagtcatttgggaatgaaaaaatacagatacaatccaatgaggaaagccagcaatcaaaacgaaaatcttattctgcaccagaacattcagattttgaaacaaccgtttgactataataaatgtgggaaaaccttcttcaagagggcaattctcattacacaaaaggggagacagactgaaaggaaaccaaatgaatgtaatgaatgtaggaaaaccttttctaagagatctaccctcattgtacatcagagaattcatacaggggagaaaccgtatgtttgtagtgattgtaggaaaacttttcgtgtgaagacaagcctcactcgacaccgaagaattcatactggagagagaccctatgaatgcagtgaatgcaggaaaaccttcattgacaaatctgcccttattgtacaccagaaaattcatggaggggagaaatcctatgagtgtaatgaatgtggaaagaccttttttcggaagtcagccctggctgaacatttcaggtcacacacaggggagaagccttacgaatgcaaggaatgtggaaatgccttcagcaagaaatcgtatcttgttgtacatcaaagaactcacagaggagagaagccaaatgaatgtaaggaatgtgggaaaaccttcttctgtcagtcagcccttactgcgcatcagagaattcacacaggggaaaaaccctatgaatgtagtgaatgtgagaaaaccttcttttgtcaatctgccctcaatgtgcatcgaagaagtcatacaggagagaagccctatgaatgcagtcaatgtggaaaatttttatgtacgaaatcagccctcattgcacatcagataactcatagaggaaagaagtcttatgaatgtaatgaatgtgggaaatttttctgccataagtcaacactcactatacatcagagaacacacacaggagagaaacatggtgtgtttaataaatgtggtagaatctccattgtgaagtcaaactgcagtcagtgtaagagaatgaacacaaaggagaatctttatgagtgtagtgaacatgggcatgccgtcagcaaaaactcacacctcattgtacatcagagaactatatgggagagaccatatgaatgcaatgaatgtgggagaacctactgcaggaagtcagccctgactcaccatcagagaacacacacaggacagagaccctatgagtgtaatgaatgtgggaaaaccttctgtcagaagttctcctttgttgaacatcagcgaactcacactggggagaaaccatatgaatgtaatgaatgtgggaaatccttctgccataagtcagccttcagagtccatagaagaattcacacaggagagaaaccatatgaatgtaatcaatgtgggaaaacctaccgtcgcctgtggactctcactgaacatcagaaaatacacacaggagagaaaccttatgaatgtaacaaatgtgagaaaacatttcgccacaaatcaaactttcttttacatcagaaatcccacaaggaataagttccaacaaagtaataaattccaacaaagcaacaaatcaaataacttacacaatgctaaactgtgagtatgtatagaggagtaaaatcttataaatgtaatgaatatggaaaatttttctgccataagtcaaccctcaatgtaacatcagagaaatcatgtaggaaagaaataatttgtttaataaatgtattattcattgtgaactatgaaaatattcaacagcaaaaaaaaaaaaaa

SEQ ID NO: 5580 - DNA, 2635 bp, Homo sapiens
ggccgacgcgagcgccgcgcttcgcttcagctgctagctggcccaagggaggcgaccgcggagggtggcgaggggcggccaggacccgcagccccggggccgggccggtccggaccgccagggagggcaggtcagtgggcagatcgcgtccgcgggattcaatctctgcccgctctgataacagtccttttccctggcgctcacttcgtgcctggcacccggctgggcgcctcaagaccgttgtctcttcgatcgcttctttggacttggcgaccatttcagagatgtcttccagaagtaccaaagatttaattaaaagtaagtggggatcgaagcctagtaactccaaatccgaaactacattagaaaaattaaagggagaaattgcacacttaaagacatcagtggatgaaatcacaagtgggaaaggaaagctgactgataaagagagacacagacttttggagaaaattcgagtccttgaggctgagaaggagaagaatgcttatcaactcacagagaaggacaaagaaatacagcgactgagagaccaactgaaggccagatatagtactaccgcattgcttgaacagctggaagagacaacgagagaaggagaaaggagggagcaggtgttgaaagccttatctgaagagaaagacgtattgaaacaacagttgtctgctgcaacctcacgaattgctgaacttgaaagcaaaaccaatacactccgtttatcacagactgtggctccaaactgcttcaactcatcaataaataatattcatgaaatggaaatacagctgaaagatgctctggagaaaaatcagcagtggctcgtgtatgatcagcagcgggaagtctatgtaaaaggacttttagcaaagatctttgagttggaaaagaaaacggaaacagctgctcattcactcccacagcagacaaaaaagcctgaatcagaaggttatcttcaagaagagaagcagaaatgttacaacgatctcttggcaagtgcaaaaaaagatcttgaggttgaacgacaaaccataactcagctgagttttgaactgagtgaatttcgaagaaaatatgaagaaacccaaaaagaagttcacaatttaaatcagctgttgtattcacaaagaagggcagatgtgcaacatctggaagatgataggcataaaacagagaagatacaaaaactcagggaagagaatgatattgctaggggaaaacttgaagaagagaagaagagatccgaagagctcttatctcaggtccagtttctttacacatctctgctaaagcagcaagaagaacaaacaagggtagctctgttggaacaacagatgcaggcatgtactttagactttgaaaatgaaaaactcgaccgtcaacatgtgcagcatcaattgcttgtaattcttaaggagctccgaaaagcaagaaatcaaataacacagttggaatccttgaaacagcttcatgagtttgccatcacagagccattagtcactttccaaggagagactgaaaacagagaaaaagttgccgcctcaccaaaaagtcccactgctgcactcaatgaaagcctggtggaatgtcccaagtgcaatatacagtatccagccactgagcatcgcgatctgcttgtccatgtggaatactgttcaaagtagcaaaataagtatttgttttgatattaaaagattcaatactgtattttctgttagcttgtgggcattttgaattatatatttcacattttgcataaaactgcctatctacctttgacactccagcatgctagtgaatcatgtatcttttaggctgctgtgcatttctcttggcagtgatacctccctgacatggttcatcatcaggctgcaatgacagaatgtggtgagcagcgtctactgagactactaacattttgcactgtcaaaatacttggtgaggaaaagatagctcaggttattgctaatgggttaatgcaccagcaagcaaaatattttatgttttgggggtttgaaaaatcaaagataattaaccaaggatcttaactgtgttcgcattttttatccaagcacttagaaaacctacaatcctaattttgatgtccattgttaagaggtggtgatagatactattttttttttcatattgtatagcggttattagaaaagttggggattttcttgatctttattgctgcttaccattgaaacttaacccagctgtgttccccaactctgttctgcgcacgaaacagtatctgtttgaggcataatcttaagtggccacacacaatgttttctcttatgttatctggcagtaactgtaacttgaattacattagcacattctgcttagctaaaattgttaaaataaactttaataaacccatgtagccctctcatttgattgacagtattttagttatttttggcattcttaaagctgggcaatgtaatgatcagatctttgtttgtctgaacaggtatttttatacatgctttttgtaaaccaaaaacttttaaatttcttcaggttttctaacatgcttaccactgggctactgtaaatgagaaaagaataaaattatttaatgttttaaaaaaaaaaaaaaaaaaaa

SEQ ID NO: 5581 - DNA, 10611 bp, Homo sapiens
cctgaggggaagcggtcagcgtaagtcccggatccccgctccggagccgcctcgtgggagcggggcaaggagatccaggaggggtctcgaatctgccatggcgaaccggcgagtggggcgaggctgctgggaagtgagcccgaccgagcggaggccgcccgcggggctgcggggccccgcggccgaggaggaggcgtcttccccgccggtcctgtctctcagccacttctgcaggtctcctttcctttgcttcggggacgttctcctgggagcctcacggacgctgtctctggccctagacaaccctaacgaggaggtggcagaagtgaagatctcccacttcccggccgcggacctgggcttcagtgtgtcgcagcgctgtttcgtgttgcagcctaaagagaaaattgttatttctgttaactggacaccactcaaagaaggccgagtaagagagattatgacatttcttgtaaatgatgttctgaaacaccaagctatattactaggaaatgcagaagagcagaaaaagaaaaagaggagtctttgggataccattaaaaagaagaaaatttcagcctctacaagtcacaacagaagggtttcaaatattcagaatgttaataaaacatttagtgtttcccaaaaagttgacagagttaggagcccactacaagcttgtgaaaacttggctatgaatgaaggcggtcccccaacagaaaacaattctttaatacttgaagaaaataaaatacccatatcacctattagccctgctttcaatgaatgccatggtgcaacttgcttgccactctctgtacgtcgatctactacctactcatctcttcatgcatcagaaaatagggaactattaaatgtacacagtgccaacgtttcaaaagtttcttttaatgagaaagctgtaactgaaacttcctttaattccgtaaatgttaatggccaaagaggagagaatagtaaacttagtcttacccccaactgttcttcaactttgaacattacacaaagccaaatacattttctaagtccagattcttttgtaaataatagtcatggagctaataatgaactagaattagtaacatgtctttcatcagatatgtttatgaaagataattcacagcctgtgcatttggaatcaacaattgcacatgaaatttatcagaaaattttaagtccagattctttcataaaagataattatggactaaatcaggatctagaatcagagtcagttaatcctattttatcccctaatcaatttttaaaagataacatggcatatatgtgtacatctcagcaaacatgtaaagtaccattatcaaatgaaaattctcaagtcccacagtctcctgaagattggagaaaaagtgaagtttcgccacgtattcctgaatgtcagggttcaaaatctcccaaagctatttttgaagaactagtagaaatgaagtcaaattactacagttttataaaacaaaataatcctaaattttctgcagttcaggatatttctagtcatagccacaataaacaacctaagagacgtccaatactttctgccactgttactaaaaggaaggccacctgtaccagagaaaaccaaactgagattaataaaccaaaagcaaaaagatgtctcaacagtgcagtgggtgaacatgaaaaagtaataaataatcaaaaggaaaaagaagattttcattcttatcttccaattatagatccaatattaagtaaatctaagagttataaaaacgaggtaacaccctcttcgacaacagcttcagttgctcggaaaagaaagagcgatggaagcatggaagatgcaaatgtgagagttgcaattacagaacatacagaagtgcgagaaatcaaaagaatccatttttctccctcagagcctaaaacatcagctgttaagaaaacaaaaaatgtgacaacacccatctcaaaacgtattagcaacagagagaaattaaacctgaagaagaaaactgatttatcaatattcagaactccaatttctaaaacaaacaaaaggacaaaacccattatcgctgtggcacagtccagtttgaccttcataaaaccattaaaaacagatattcccagacacccgatgccatttgctgcaaaaaacatgttttatgatgaacgctggaaggaaaagcaggaacagggcttcacttggtggttaaattttatattaacccctgatgacttcactgtaaaaacaaatatttctgaagtaaatgctgctactcttcttttgggaatagagaatcaacataaaataagtgttcctagagcacctacaaaagaggaaatgtctctcagagcttatactgctcggtgtaggttaaacagactacgtcgtgcagcatgccgtttgtttacttctgaaaaaatggttaaagctattaaaaagcttgaaattgaaattgaagctaggcggttaattgttcgaaaagatagacacctatggaaagatgtgggagaacgtcagaaagtcctgaattggctgttgtcctacaatcctttgtggcttcgaattggtctagagacaacttatggagaactcatatctttggaagataacagtgatgtcacagggttggctatgtttattctgaatcgcctactttggaatcctgatatagcagctgagtatagacaccccactgttcctcacctgtatagagatggtcatgaagaagctttgtccaagtttacattgaaaaagttattgttgttggtctgttttcttgattatgctaaaatttccagactcattgatcatgatccttgtctcttctgtaaagatgccgaattcaaggctagtaaagaaatccttttggctttttcacgagatttcctaagtggtgaaggtgacctttcccgtcaccttggcttattgggattacctgttaaccatgttcagacaccatttgatgaatttgattttgccgttacaaatcttgccgtagacttgcaatgtggagtgcgccttgtgcgaaccatggaacttctcacacagaactgggacctctcaaagaaactcaggattccggcaataagtcgtcttcaaaagatgcacaatgttgacattgttcttcaagttcttaaatcacgaggaattgaattaagtgatgagcatggaaatacaattctatctaaggatattgtggataggcacagagaaaaaactctcaggttgctttggaaaatagcgtttgcttttcaggtggatatttcccttaacttagatcaattaaaggaagaaattgcctttctaaaacacacaaagagtataaagaaaacaatatctctactatcatgccattctgatgatcttattaataagaaaaaaggcaaaagggatagtggttcctttgaacaatatagtgaaaacataaagttattgatggattgggtaaatgctgtttgtgccttctataataaaaaggtggagaattttacagtgtctttctcagacggccgtgtgttatgttacctgatccaccattaccatccttgctatgtgccatttgacgctatatgtcagcgtactactcaaactgtggaatgtacgcaaactggttcagtggtattaaattcatcatctgaatctgatgacagttctctggatatgtctcttaaagcatttgatcatgaaaatacttcagagctatacaaagagctcctagaaaatgaaaagaaaaattttcacttggttaggtctgcagttagagaccttggtggaatacctgctatgattaatcattcagatatgtcaaatacaattccagatgaaaaggtggttattacctatttgtcatttctttgtgcaaggcttttggatcttcgtaaagaaataagagctgctcgactcatacaaacaacatggagaaaatataaactaaaaacagatctcaaacgccatcaggagagagagaaagctgcaagaattattcaattggctgtaatcaattttctagcaaaacaaagattgagaaaaagagttaatgcagcactcgtcattcagaaatattggcgaagagtcttagcacagagaaaattattaatgttaaaaaaggaaaagctggaaaaagttcaaaataaagcagcatcacttattcagggatattggagaagatattccactagacaaagatttctgaaattgaaatattattcaatcatcctgcaatctaggataagaatgataattgctgttacatcttataaacgatatctttgggctacagttacaattcagaggcattggcgtgcttatttaagaagaaaacaagatcaacaaagatatgaaatgctaaaatcatcaactcttataatccaatctatgttcagaaaatggaagcaacgtaaaatgcaatcacaagtaaaagctacagtaatattgcaaagagcttttagagaatggcatttaagaaaacaagctaaagaagaaaattctgctattatcatacaatcatggtatagaatgcataaagaattacggaaatatatttatattagatcttgtgttgttatcattcagaaaagatttcggtgctttcaagcccaaaagttatataaaagaagaaaagagtccatactaaccatccagaagtactacaaagcatatctgaaaggaaagattgagcgcaccaactatttgcagaaacgagctgcagccattcaattacaagctgcttttaggagactgaaagctcataatttatgtagacaaattagagctgcttgtgttattcagtcatactggagaatgagacaagacagagttcgatttttaaaccttaagaagactattatcaaatttcaggcacatgtaagaaaacatcaacaacgacagaaatataagaagatgaagaaagcagctgttataattcagactcatttccgagcttatatttttgccatgaaagttctagcatcttaccagaaaacacgctctgctgtcattgtgctgcagtctgcatatagagggatgcaagccaggaaaatgtatattcacatcctcacatctgttataaagattcaatcatattatcgtgcttatgtttctaaaaaggaatttttgagcctaaaaaatgctacaataaaattgcagtcaactgttaagatgaaacaaacacgtaaacaatatttgcatttaagagcagctgcactatttatccagcaatgttaccgttccaaaaaaatagctgcacaaaagagagaagagtatatgcagatgcgggaatcttgtatcaaactgcaagcatttgttagaggataccttgtccgaaagcagatgaggttacaaagaaaagctgttatttcactacagtcttatttcagaatgagaaaggctcggcagtattatctgaaaatgtataaagcaattattgtcattcagaattactatcatgcatacaaagcacaggtcaatcagaggaagaacttcttgcaagtcaaaaaagcagctacttgcttgcaagcagcttacagaggttataaagtacgccagctaatcaaacaacaatctatagctgctcttaaaattcagtctgcttttagaggctataataaaagggtaaaatatcaatctgtgcttcaatctataataaagattcagagatggtacagggcgtacaagactcttcatgatacaagaacacattttttgaagacaaaggcagctgtgatttccctccagtctgcttatcgtggctggaaggttcggaaacagattagaagggaacatcaagctgccttgaagattcagtctgcttttagaatggccaaggcccagaaacagtttagattgtttaaaacagcagcattagtcatccagcaaaatttcagagcatggactgcaggaaggaagcaatgtatggagtatattgaactccgtcatgcggtactggtgcttcaatctatgtggaagggaaaaacactgagaagacagcttcaaaggcaacataaatgtgctatcatcatacagtcatactatagaatgcatgtgcaacaaaagaagtggaaaatcatgaaaaaagctgctcttctgattcaaaagtattatagggcttacagtattggaagagaacagaatcatttatatttgaaaacaaaagcagctgtagtaactttacagtcagcttatcgtggtatgaaagtgagaaaaagaataaaggattgcaacaaagcagcagtcactatacagtctaaatacagagcttacaaaaccaaaaagaaatatgcaacctatagagcttcagctattataattcagagatggtatcgaggtattaaaattacaaaccatcagcataaggagtatcttaatttgaagaagacagcaattaaaatccaatctgtttatagaggtattagagttagaagacatattcaacacatgcacagggcagccacttttattaaagccatgtttaaaatgcatcagtcaagaataagttaccatacaatgagaaaagcagctattgttattcaagtaagatgtagagcatattatcaaggtaaaatgcagcgtgaaaagtacctgacaattttgaaagctgttaaagtccttcaggcaagttttagaggagtaagagttagacggactcttagaaagatgcagactgcagcaacactcattcagtcaaactacagaagatacagacagcaaacatactttaataagttaaagaaaataacaaaaacagtacagcaaagatactgggcaatgaaagaaagaaacatacaatttcaaaggtataacaaactgaggcattctgtaatatacattcaggctatttttaggggaaagaaagctagaagacatttaaaaatgatgcatatagccgcaactctcattcagaggagatttagaactctaatgatgagaagaagattcctctctctcaagaaaactgctattttgattcagagaaaatatcgggcacatctttgtacaaagcatcacttacagttccttcaggtacaaaatgcagttattaaaatccagtcatcatacagaagatggatgataaggaaaaggatgcgagagatgcacagggctgctactttcatccagtctactttcagaatgcacagattacatatgagatatcaggctttgaaacaggcctccgttgtgatccaacagcaataccaagcaaatagagctgcaaaactgcagaggcagcattatctcagacaaagacactctgctgtgatccttcaggctgcattcaggggtatgaaaactagaagacatttgaagagtatgcattcctctgcaacccttattcagagtaggtttagatcattactggtgaggagaagattcatttccctcaaaaaagctactatttttgttcagaggaaatatcgagccaccatttgtgccaaacataaattgtaccaattcttgcacttaagaaaggcagccattacaatacagtcatcttacagaagactgatggtaaagaagaagttacaagaaatgcaaagggctgcagttctcattcaggctactttcaggatgtacagaacatatattacatttcagacttggaaacatgcttcaattctaattcagcaacattatcgaacatatagagctgcaaaattacaaagagaaaattatatcagacaatggcattctgctgtggttattcaggctgcatataaaggaatgaaagcaagacaacttttaagggaaaaacacaaagcttctatcgtaatacaaagcacctacagaatgtataggcagtattgtttctaccaaaagcttcagtgggctacaaaaatcatacaagaaaaatatagagcaaataaaaagaaacagaaagtatttcaacacaatgaacttaagaaagagacttgtgttcaggcaggttttcaggacatgaacataaaaaaacagattcaggaacagcaccaggctgccattattattcagaagcattgtaaagcctttaaaataaggaagcattatctccaccttagagcaacagtagtttctattcaaagaagatacagaaaactaactgcagtgcgtacccaagcagttatttgtatacagtcttattacagaggctttaaagtacgaaaggatattcaaaatatgcaccgggctgccacactaattcagtcattctatcgaatgcacagggccaaagttgattatgaaacaaagaaaactgcaattgtggttatacagaattattataggttgtatgttagagtaaaaacagaaagaaaaaactttttagcagttcagaaatctgtacgaactattcaggctgcttttagaggcatgaaagttagacaaaaattgaaaaatgtatcagaggaaaagatggcagccattgttaaccaatctgcactctgctgttacagaagtaaaactcagtatgaagctgttcaaagtgaaggtgttatgattcaagagtggtataaagcttctggccttgcttgttcacaggaagcagagtatcattctcaaagtagggctgcagtaacaattcaaaaagctttttgtagaatggtcacaagaaaactggaaacacagaaatgtgctgccctacggattcagttcttccttcagatggctgtgtatcggagaagatttgttcagcagaaaagagctgctatcactttacagcattattttaggacgtggcaaaccagaaaacagtttttactatatagaaaagcagcagtggttttacaaaatcactacagagcatttctgtctgcaaaacatcaaagacaagtctatttacagatcagaagcagtgttatcattattcaagctagaagtaaaggatttatacagaaacggaagtttcaggaaattaaaaatagcaccataaaaattcaggctatgtggaggagatatagagccaagaaatatttatgtaaagtgaaagctgcctgcaagattcaagcctggtatagatgttggagagcacacaaagaatatctagctatattaaaagctgttaaaattattcaaggttgcttctataccaaactagagagaacacggtttttgaatgtgagagcatcagcaattatcattcagagaaaatggagagctatacttcctgcaaagatagctcatgaacacttcttaatgataaaaagacatcgagctgcttgtttgatccaagcacattatagaggatataaaggaaggcaggtctttcttcggcagaaatctgctgctttgatcatacaaaaatatatacgagccagggaggctggaaagcatgaaaggataaaatatattgaatttaaaaaatctacagttatcctacaagcactggtgcgtggttggctagtacgaaaaagatttttagaacagagagccaaaattcgacttcttcacttcactgcagctgcatattatcacctgaatgctgttagaattcaaagagcctataaactttacctggctgtgaagaatgctaacaagcaggttaattcagtcatctgtattcagagatggtttcgagcaagattacaagaaaagagatttattcagaaatatcatagcatcaaaaagattgagcatgaaggtcaagaatgtctgagccagcgaaatagggctgcatcagtaatacagaaagcagtgcgccattttctcctccgtaaaaagcaggaaaaattcactagtggaatcattaaaattcaggcattatggagaggctattcttggaggaagaaaaatgattgtacaaaaattaaagctatacgactaagtcttcaagttgttaatagggagattcgagaagaaaacaaactctacaaaagaactgcacttgcacttcattaccttttgacatataagcacctttctgccattcttgaggccttaaaacacctagaggtagttactagattgtctccactttgttgtgagaacatggcccagagtggagcaatttctaaaatatttgttttgatccgaagttgtaatcgcagtattccttgtatggaagtcatcagatatgctgtgcaagtcttgcttaatgtatctaagtatgagaaaactacttcagcagtttatgatgtagaaaattgtatagatatactattggagcttttgcagatataccgagaaaagcctggtaataaagttgcagacaaaggcggaagcatttttacaaaaacttgttgtttgttggctattttactgaagacaacaaatagagcctctgatgtacgaagtaggtccaaagttgttgaccgtatttacagtctctacaaacttacagctcataaacataaaatgaatactgaaagaatactttacaagcaaaagaagaattcttctataagcattccttttatcccagaaacacctgtaaggaccagaatagtttcaagacttaagccagattgggttttgagaagagataacatggaagaaatcacaaatcccctgcaagctattcaaatggtgatggatacgcttggcattccttattagtaaatgtaaacattttcagtatgtatagtgtaaagaaatattaaagccaatcatgagtacgtaaagtgatttttgctctc

SEQ ID NO: 5582 - DNA, 3363 bp, Homo sapiens
ggctttggccctggaaagcctcgcggacgtgttctgacccaaggttttagcagtggatgtggcgttttcttccattccttctttcagtttttctgtactcgttgcttgcaattaagtgtaaatacttttgctagtggataatgggggaggcaaggactgagacctgcggtatgacgatagctctggctcttaatagtttgaggtaaagcgagatactctgagcttttgtctcccgtaaaaagggtggtgaatatgaataagggctttcttagcgttataagaattaaagggcatagttctgtggtgtgaaatctttaaaagatgttcagtaaataaaaatgattttcctccttcccctctcagacctctttttcttctttctttctttttttttgacaagttctcactcctctcacccaggctggagtctttctgaaagagttcttccgcttgttgttggctttcaactgttggatttgaggcgcttagcgccttcttcgtccgggtgcagcacattcttgattggtctcatgcctttgtggttgtaaatgtgcctggaatcctagcctttcatggtttgttctgagtaatgaataccctattactatgatactagtatcttccttaattatcctactcattgtctcaacattctgacagttggattgagcatattcaaattttgaaaattattgtagaaatgtttttacctcatatgaaccacctgacattggaacagactttcttttcacaagtgttaccaaagactgtgaaattattcgatgacatgatgtatgaattaaccagtcaagccagaggactgtcaagccaaaatttggaaatccagaccactctaaggaatattttacaaacaatggtgcagctcttaggagctctcacaggatgtgttcagcatatctgtgccacacaggaatccatcattttggaaaatattcagagtctcccctcctcagtccttcatataattaaaagcacatttgtgcattgtaagaatagtgaatctgtgtattctgggtgtttacacctagtttcagaccttctccaggctcttttcaaggaggcctattctcttcaaaagcagttaatggaactgctggacatggtttgcatggaccctttagtagatgacaatgatgatattttgaatatggtaatagttattcattctttattggatatctgctctgttatttccagtatggaccatgcatttcatgccaatacttggaagtttataattaagcagagccttaagcaccagtccataataaaaagccagttgaaacacaaagatataattactagcttgtgtgaagacattcttttctccttccattcttgtttacagttagctgagcagatgacacagtcagatgcacaggataatgctgactacagattatttcagaaaacactcaaattgtgtcgtttttttgccaactcccttttgcactacgctaaggaatttcttcctttcctctctgattcttgctgtactttgcaccaactgtatcttcagatacacagcaagtttcctccaagcctttatgctaccaggatttctaaagcacaccaagaggaaatagcaggtgctttcctagtgacactggatccacttatcagtcagctgctcacatttcagcctttcatgcaggtggttttggacagtaaattagacctgccatgtgaactgcagtttccacaatgtcttcttctggttgttgtcatggataagctgccatctcagcctaaggaagtgcaaaccctgtggtgcacagacagccaggtctcagaaacgacaaccaggatatctctactcaaagccgttttctacagttttgagcagtgttctggtgaactctctctacctgttcatttacagggattaaagagtaaggggaaagctgaggtggctgtcaccttgtatcagcatgtttgtgttcatctgtgtacatttattacttcctttcatccctcactgtttgctgaactggatgctgctctgctgaatgctgtacttagtgctaatatgatcacctctttgttagctatggatgcatggtgcttccttgctcgatatgggactgctgaactgtgtgcacaccatgtcaccatagtggctcatctgataaagtcatgccctggagaatgttatcaactcatcaacctatcaatactgttgaagcgtctctttttcttcatggcaccaccccatcagctggagtttatccagaaattttccccaaaagaagcagaaaatctgcctctgtggcaacatatttccttccaggcgttacctcctgagcttagggaacaaactgtccatgaggtcaccacagtaggcactgcagaatgcaggaaatggctgagcaggagtcgtactttgggagaactagaatctctgaacacagtactgtctgctttgcttgcagtatgtaattctgctggtgaagctttggatacaggaaaacaaactgcaattatcgaagttgtgagtcagctttgggcttttttaaacattaaacaggtagcagatcaaccttatgttcaacagacattcagccttttacttccactgttgggatttttcattcaaactctagatcctaaactgatacttcaggcagtaactttgcagacctcgctacttaaattagagcttcctgactatgttcgtttggcaatgttggattttgtatcttctttaggaaaactttttatacctgaagctatccaggacagaattctgcccaacctgtcctgtatgtttgccttactgctagctgacaggagttggctgctagaacaacataccttggaggcgtttactcagttcgctgagggaacaaatcatgaagagatagttccacagtgtctcagttctgaagaaactaagaacaaagttgtatcctttctggagaagactgggtttgtagatgaaactgaagctgccaaagtggaacgtgtgaaacaggaaaaaggtattttctgggaaccctttgctaatgtgactgtagaagaagcaaagaggtcatctttacagccttatgcaaaaagagctcgtcaggagttcccctgggaagaagagtacaggtcagcgctgcatacaatagcaggggctttggaagcaactgagtcactactccaaaagggtcctgctccagcctggctttcaatggaaatggaggcgctccaagaaaggatggataagctaaaacgttacatacatactctagggtgaaacttatcactaggcagaactgggtttgatgctttgtcaactgaaaatacttatgtctgtacattttctaacagatataaaacaaattttgtaaagttgaa

SEQ ID NO: 5583 - DNA, 3396 bp, Homo sapiens
cctttaagagcggctggccaggcacggcctccgcctctcagtacgcggagcgccggcggtcacctggggctcgcggagcggccagatcgcggcggagtcggcgcgcttccccgagggaaggtgggagaggggacccggacgcgaggtgccccgaagccctctcgagcgtaaccgtcccgcgcctctctgaggcggaggatgcgggagcgcatctgggcgccgccgctgctgctgctgctgccgctgctactgccgccgccactgtggggcggccccccggacagcccacgccgggagctggagctggagcccgggcctctgcagcccttcgacctgctctacgccagcggcgcggccgcctactacagcggagactacgagcgagcggtgcgcgacttggaagcggcgctgcgcagccaccggcgcctgcgggaaatccgcacgcgctgtgcccgccactgcgcggcgcgccacccgctcccgcccccgccccccggcgagggccccggcgctgagctgccccttttccgctccttgttggggcgggcgcgctgttatcgcagctgtgagacccagcgcctcgggggccccgcatcccgccaccgcgtcagcgaggatgtgcgcagcgacttccagcgcagagtgccctacaactacctgcagcgggcctacatcaagcttaaccagctcgaaaaagcagtggaagcagctcacacatttttcgtggctaaccctgagcacatggaaatgcagcagaacattgagaattacagggcgacagctggtgttgaagcattgcagttggtagacagagaagccaagccacacatggagagttacaatgcaggagttaaacattatgaggctgatgactttgagatggctatcaggcatttcgaacaagccttaagagaatatttcgttgaagatacagaatgccggaccctatgtgaggggcctcagagatttgaagaatatgagtatttagggtataaggctggtctgtatgaagctattgcagatcactacatgcaggtgcttgtttgtcagcatgaatgtgtgagggaacttgccacccgccctggccgcctctctcccatcgagaattttcttcctctgcactatgattacctacagtttgcctactatcgagttggtgagtatgtgaaagccctggagtgtgccaaagcctatcttctatgccatccagatgatgaggatgtcctagacaatgtggattactatgagagtctgctggatgatagcattgacccggcatccattgaggccagagaggatttaacaatgtttgtgaaacgtcataagctggagtctgagctgataaaatcagctgcagaaggtctggggttttcatacactgaaccgaattattggatcagatatggaggacgacaggatgagaatcgggtcccttcaggagtgaacgtagagggagcagaagttcatggattctcaatgggaaaaaagctatcacccaagatagatcgagacctaagagaaggtggtcctctactctatgagaacatcacattcgtctacaactcggagcagctgaacgggactcagcgggttctcctggataacgtcctgtcggaagaacagtgccgggagctccacagcgtggccagtggaatcatgcttgttggtgatggatacagaggaaaaacttcaccccatacacccaatgaaaagtttgaaggtgcaactgtcctgaaagcactcaaatctggttatgaaggtcgagtcccactgaagagcgctcgtctgttttatgacatcagcgaaaaggctcgaaggattgtagaatcttattttatgctgaactcaactctgtatttttcctatacacacatggtctgccgaacagccctgtctggtcagcaggatagaagaaatgacctcagtcatcccatccatgctgacaactgtttgttggatccagaggccaacgaatgctggaaggagcctcctgcttacacatttcgagactatagtgctctcctatatatgaatgatgactttgaaggaggagaattcatattcacagagatggatgctaagactgtgactgcctctataaaaccaaaatgtgggcgcatgatcagcttctcatctggaggagagaaccctcatggggtgaaggcagtcaccaagggaaagaggtgtgctgtggctctgtggttcaccttggacccactttatagagaattggagcgaatacaggctgatgaagtgattgcaattctggatcaagaacagcaagggaagcatgaactgaatatcaaccctaaagatgagctataaaaatgagaaagaatgttctatcaaatatttatttaaattgttaatcttatgagaacctttttatttttgtacagagccatggtataaattaacaggttaatgtcagtcatcagatcttccttctcttcctaaggatgcttgtgttgcctcaatctatcaatctatctttcttgttttgggttgttttctctctctctctctctctctcttcttagagacatggtctaaccatgttgtctaggatatagggcagtggctattcacagatgtgatgatagcacactggagcctcaaactcttaggctcaggcgatccttcaagcctcccggggagctgggaccacaggcacgtgccaccacacccagctctctttcttggtttttcatcatttcatgtatctatcaaagcccagttcacctcctcccccaaacacacacacacacacacacacacacacacacaattaagttgctgcagattcaaaagcttagagagaataagcttcttggtggtgaaactacaactctcacgtgtgctccagttctaaaattaacctgtgcctggtctctgaagccctttcttgctctgtgcctttcagccacatccttaggtgctaacggccatgagctccgactctccaaagtgagctccactttgggtctgaggagcccctggcagagtccacgctgcctcaggtatcatgggcgtaatgatcacccaggctccgggagatctcatggatgattactgtatgagacagaggggacttcagtctttccagggccttggtggaatttttggctctggtgttttcgccagacaataaacttacactggaagctttgatccaccctccacagtactccagaaaggactgtcctataagttgtacactttaaaaggtcatgtagaggttgtagtagaatggcttttcaccctggtgactttggaagaaactcttgaatactgcctgcatccgggcaccatggccaggttgcctaggagtggggtccactgatgaaaagaggtgttttgtacttacataagaaaaataaatttctgattgatttt

SEQ ID NO: 5584 - DNA, 2637 bp, Homo sapiens
atggatctggataaaccatctgtttggggctcattaaaacagcggaccaggccattgttgatcaacttaagcaagaagaaggtgaaaaagaacccaagtaagcccccagatctacgggcaaggcatcacttggaccgccgtctcagcctctctgtgcctgatctcctggaggctgaggccttggccccagagggccggccttactccgggccacagtcttcctacacctcggtgcccagcagtctgtccactgcagggatctttcccaagagcagcagtagctccttgaaacagtctgaagaagaattggattggagccaggaagaagccagtcacctccatgtggtggaaacagactcagaggaggcctatgcctctcctgctgagcggagacgggtgtccagcaacggcatctttgatcttcagaaaacttcccttggaggggatgcaccagaagagccagagaagctatgtggaagcagtgacctgaatgcttctatgacatctcaacattttgaagaacaatctgtaccgggggaagccagtgatggcttgagtaacctccccagcccttttgcgtacctcctcaccatacacctgaaggaaggccggaacctggttgtccgagatcgctgtggcacaagtgatccttatgtgaaatttaagctgaatgggaagacgctgtacaaaagtaaagtcatatataagaacttgaacccagtatgggatgagatagttgtattgccaatccaaagccttgatcaaaagctacgtgtgaaggtatatgatcgagatttaaccacatctgatttcatgggttctgcatttgtcattctcagtgatcttgagcttaacagaacaactgaacatattttaaaactggaagatccaaacagtttagaagatgacatgggagtgatcgtcttaaatttgaacctagtggtaaaacagggtgatttcaagagacaccgttggtcaaatcggaagcgattaagtgccagcaagtcctctttgatacgcaacctacggctctctgagtccttgaaaaagaaccaactctggaacgggattataagtataactttgttggaagggaagaatgtctcaggaggaagcatgacagagatgtttgtccagttaaaactgggagatcagaggtataaaagtaagacactgtgtaagagtgcaaatccgcagtggcaggaacattttgactttcactacttctctgacaggatgggcattttggacattgaagtgtggggaaaggacaacaaaaagcatgaggaacgtctgggcacatgtaaagtggatatctcggcactccctctgaagcaagccaactgcctggagctgccactggacagctgtctgggggctctccttatgttggtcacacttacaccctgtgcgggggtctccgtctctgatctgtgtgtctgccccttagcagacctcagcgaaagaaagcagattacccagcgatattgcttacagaaccccctgaaagatgtgaaagacgtcggcattctacaagtgaaggttttaaaggcagcagatctcttagcggcagatttctcagggaagagtgacccattttgcttgttggagttaggcaatgaccgacttcagacgcataccgtctacaaaaacctcaaccctgaatggaacaaagtttttacatttcccattaaagatatccatgatgttttggaagtgacagtgtttgatgaagatggagataaacccccagattttcttggaaaagttgccattcccttgctgtccattagagatggacaaccgaattgttatgtactaaagaataaagatttagaacaagcttttaaaggagttatttacttagagatggaccttatatataatccggtgaaagcaagtattaggacttttactccccgggaaaagcgctttgttgaagacagccgcaagctgtccaaaaagatcttatcaagagatgtggaccgtgtgaaaagaatcactatggcaatatggaatacaatgcagttccttaaaagctgcttccagtgggaatccacattaagaagtacaatagcattcgcggtatttttgatcactgtctggaattttgaactatatatgatccccttggcattgttgctgatctttgtctacaatttcatcagacctgtgaaaggcaaggtcagcagcatccaggacagccaggagagcacagacatagatgacgaggaggatgaagatgacaaggaatctgagaaaaaggggttgattgaaagaatctatatggtacaggatattgtttcaactgttcaaaacgtcttggaggaaatagcttcttttggagaaaggattaagaacacatttaactggacggtccccttcctttcatctctggcctgtttgattctggcagcagccaccatcattttgtatttcattccactgcggtacatcattttaatctggggcataaataaatttactaagaagcttcgaaatccctattccatcgacaataatgagctactagacttcctctctagggtaccgtctgatgttcaaaaggtgcagtatgcagaattgaaactctgcagcagccacagccccctgcggaagaagcgcagcgctctctag

SEQ ID NO: 5585 - DNA, 5248 bp, Homo sapiens
gcgtgcaaccctagaagggaaaaggacgggaagagattgagccgcggctgggagacagcgagccagagtctgggtgtttgtgcgagagccacggcgggggctggggcgagtggccggcatggctgaaggctgcgctctgcaaccttgaagagccgctgcattgagaggccagggacagggagaccggtgcgatggcagagcgcggcccccgccgctgcgccgggccggcccggctggcctgagccgccggaggagcggggctgcctctgcgcgtccatggagcagcgggaagggcgaaactccggagcgccgcgtccctgcgccgctgcggcggactgctgaaggggccgagcccgcgcggaccgccgaggaagagacccccgctccagcccgcaggccggctgcccgggggcggcgggggacatcggagggcagcggagcgagcagcgccgcgggagaggccggcgcgggaggcggccgcagcaatgccgggcccgctagggctgctctgcttcctcgccctggggctgctcggctcggccgggcccagcggcgcggcgccgcctctctgcgcggcgccctgcagctgcgacggcgaccgtcgggtggactgctccgggaaggggctgacggccgtgcccgaggggctcagcgccttcacccaagcgctggatatcagtatgaacaacattactcagttgccagaagatgcatttaagaactttccttttctagaagagctacaattggcgggcaacgacctttcttttatccacccaaaggccttgtctgggttgaaagaactcaaagttctaacgctccagaataatcagttgaaaacagtacccagtgaagccattcgagggctgagtgctttgcagtctttgcgtttagatgccaaccatattacctcagtccccgaggacagttttgaaggacttgttcagttacggcatctgtggctggatgacaacagcttgacggaggtgcctgtgcaccccctcagcaatctgcccaccctacaggcgctgaccctggctctcaacaagatctcaagcatccctgactttgcatttaccaacctttcaagcctggtagttctgcatcttcataacaataaaattagaagcctgagtcaacactgttttgatggactagataacctggagaccttagacttgaattataataacttgggggaatttcctcaggctattaaagcccttcctagccttaaagagctaggatttcatagtaattctatttctgttatccctgatggagcatttgatggtaatccactcttaagaactatacatttgtatgataatcctctgtcttttgtggggaactcagcatttcacaatttatctgatcttcattccctagtcattcgtggtgcaagcatggtgcagcagttccccaatcttacaggaactgtccacctggaaagtctgactttgacaggtacaaagataagcagcatacctaataatttgtgtcaagaacaaaagatgcttaggactttggacttgtcttacaataatataagagaccttccaagttttaatggttgccatgctctggaagaaatttctttacagcgtaatcaaatctaccaaataaaggaaggcacctttcaaggcctgatatctctaaggattctagatctgagtagaaacctgatacatgaaattcacagtagagcttttgccacacttgggccaataactaacctagatgtaagtttcaatgaattaacttcctttcctacggaaggcctgaatgggctaaatcaactgaaacttgtgggcaacttcaagctgaaagaagccttagcagcaaaagactttgttaacctcaggtctttatcagtaccatatgcttatcagtgctgtgcattttggggttgtgactcttatgcaaatttaaacacagaagataacagcctccaggaccacagtgtggcacaggagaaaggtactgctgatgcagcaaatgtcacaagcactcttgaaaatgaagaacatagtcaaataattatccattgtacaccttcaacaggtgcttttaagccctgtgaatatttactgggaagctggatgattcgtcttactgtgtggttcattttcttggttgcattatttttcaacctgcttgttattttaacaacatttgcatcttgtacatcactgccttcgtccaaattgtttataggcttgatttctgtgtctaacttattcatgggaatctatactggcatcctaacttttcttgatgctgtgtcctggggcagattcgctgaatttggcatttggtgggaaactggcagtggctgcaaagtagctgggtttcttgcagttttctcctcagaaagtgccatatttttattaatgctagcaactgtcgaaagaagcttatctgcaaaagatataatgaaaaatgggaagagcaatcatctcaaacagttccgggttgctgcccttttggctttcctaggtgctacagtagcaggctgttttccccttttccatagaggggaatattctgcatcacccctttgtttgccatttcctacaggtgaaacgccatcattaggattcactgtaacgttagtgctattaaactcactagcatttttattaatggccgttatctacactaagctatactgcaacttggaaaaagaggacctctcagaaaactcacaatctagcatgattaagcatgtcgcttggctaatcttcaccaattgcatctttttctgccctgtggcgtttttttcatttgcaccattgatcactgcaatctctatcagccccgaaataatgaagtctgttactctgatattttttccattgcctgcttgcctgaatccagtcctgtatgttttcttcaacccaaagtttaaagaagactggaagttactgaagcgacgtgttaccaagaaaagtggatcagtttcagtttccatcagtagccaaggtggttgtctggaacaggatttctactacgactgtggcatgtactcacatttgcagggcaacctgactgtttgcgactgctgcgaatcgtttcttttaacaaagccagtatcatgcaaacacttgataaaatcacacagctgtcctgcattggcagtggcttcttgccaaagacctgagggctactggtccgactgtggcacacagtcggcccactctgattatgcagatgaagaagattcctttgtctcagacagttctgaccaggtgcaggcctgtggacgagcctgcttctaccagagtagaggattccctttggtgcgctatgcttacaatctaccaagagttaaagactgaactactgtgtgtgtaaccgtttcccccgtcaaccaaaatcagtgtttatagagtgaaccctattctcatctttcatctgggaagcacttctgtaatcactgcctggtgtcacttagaagaaggagaggtggcagtttatttctcaaaccagtcattttcaaagaacaggtgcctaaattataaattggtgaaaaatgcaatgtccaagcaatgtatgatctgtttgaaacaaatatatgacttgaaaaggatcttaggtgtagtagagcaatataatgttagttttttctgatccataagaagcaaatttatacctatttgtgtattaagcacaagataaagaacagctgttaatattttttaaaaatctattttaaaatgtgattttctataactgaagaaaatatcttgctaattttacctaatgtttcatccttaatctcaggacaacttactgcagggccaaaaaagggactgtcccagctagaactgtgagagtatacataggcattactttattatgttttcacttgccatccttgacataagagaactataaattttgtttaagcaatttataaatctaaaacctgaagatgtttttaaaacaatattaacagctgttaggttaaaaaaatagctggacatttgttttcagtcattatacattgctttggtccaatcagtaattttttcttaagtgttttgtgattacactactagaaaaaaagtaaaaggctaattgctgtgtgggtttagtcgatttggctaaactactaactaatgtgggggtttaatagtatctgagggatttggtggcttcatgtaatgttctcattaatgaatacttcctaatatcgttggctctactaatattttccaatttgctgggatgtcacctagcaatagcttggattatatagaaagtaaactgtggtcaatacttgcatttaattagacgaaacggggagtaattatgacacgaagtacttatgtttatttcttagtgagctggattatcttgaacctgtgctattaaatggaaatttccatacatcttccccatactattttttataaaagagcctattcaatagctcagaggttgaactctggttaaacaagataatatgttattaataaaaatagaagaagaaagaataaagcttagtcctgtgtctttaaaaattaaaaattttacttgattcccatctatgggctttagacctattactgggtggagtcttaaagttataattgttcaatatgttttttgaacagtgtgctaaatcaatagcaaacccactgccatattagttattctgaatatactaaaaaaatccagctagattgcagtttaataattaaactgtacatactgtgcatataatgaatttttatcttatgtaaattatttttagaacacaagttgggaaatgtggcttctgttcatttcgtttaattaaagctacctcctaaactatagtggctgccagtagcagactgttaaattgtggtttatatactttttgcattgtaaatagtctttgttgtacattgtcagtgtaataaaaacagaatctttgtatatcaaaatcatgtagtttgtataaaatgtgggaaggatttatttacagtgtgttgtaattttgtaaggccaactatttacaagttttaaaaattgctatcatgtatatttacacatctgataaatattaaatcataacttggtaagaaactcctaattaaaaggttttttccaaaattcaggttattgaaaacttttcattttattcatttaaaaactagaataacagatatataaaagtgttaatctttgtgctatatggtatgaaatacaatattgtactcagtgttttgaattattaaagtttctagaaagcaaa

SEQ ID NO: 5586 - DNA, 3194 bp, Homo sapiens
cgcgccctggtgacagctcgcgcgtgctgatgatggcgattctttggatgggaagagaccttgaaaggacctctagtttatcctgcaactccagtcaatatcccacttaaatcattccaggtaatagagaagaggaaacctaaccaatgactgtggaataatatggaagaagatggaaaaaacttgtttaatgggttgagaaagtggcgacttctataagacatggatagatgcaaacatgtagggcggttacggctcgcccaggaccactccatcctgaaccctcagaagtggtgctgcttagagtgtgccaccaccgagtccgtgtgggcctgcctcaagtgctcccacgtggcctgcggccgctatattgaggaccacgccctgaaacactttgaggagacgggacacccgctagccatggaagtccgggatctctacgtgttctgttacctgtgcaaggactacgtgctcaatgataacccagagggggacctgaagctgctaagaagctccctcctggcggtccggggccagaaacaggacacgccggtgagacgtgggcggacgctgcggtccatggcttcgggtgaggacgtggtcctgccgcagcgcgctcctcagggacagccgcagatgctcacggctctgtggtaccggcgtcagcgcctgctggccaggacgctgcggctgtggttcgagaagagctcccggggccaggcgaagctggagcagcggcggcaggaggaggccctggagcgcaagaaggaggaggcgcggaggcggcggcgcgaggtgaaacggcggctgctggaggagctggccagcacccctccgcgcaagagtgcacggctgctcctgcacacgccccgcgacgcgggcccggctgcctcgcgccccgccgccctccctacctcacgcagagtgcccgccgccacactcaagctgcgtcgccagccggccatggccccaggcgtcacgggcctgcgcaacctgggcaacacctgctacatgaactccatcctccaggtgctcagccacctccagaagttccgagaatgtttcctcaaccttgacccttccaaaacggaacatctgtttcccaaagccaccaacgggaagactcagctttctggcaagccaaccaacagctcggccacggagctgtccttgagaaatgacagggccgaggcatgcgagcgggagggcttctgctggaacggcagggcctccattagtcggagtctggagctcatccagaacaaggagccgagttcaaagcacatttccctctgccgtgaactgcacaccctcttccgagtcatgtggtccgggaagtgggccctagtgtcgcccttcgccatgctgcactcagtgtggagcctgatccctgccttccgcggctacgaccaacaggacgcgcaggaatttctctgcgagctgctgcacaaggtgcagcaggaactcgagtctgagggcaccacacgccggatcctcatccccttctcccagaggaagctcaccaaacaggtcttaaaggtggtgaataccatatttcatgggcagctgctcagtcaggtcacatgtatatcatgcaattacaaatccaataccattgagcccttttgggacctatccctggaattccctgaacgctatcactgcatagaaaaggggtttgtccctttgaatcaaacagagtgcttgctcactgagatgctggccaaattcacagagacagaggccctggaagggagaatctacgcttgtgaccagtgtaacagcaaacgacgaaaatccaatcccaaaccccttgttctgagtgaagctagaaagcagttaatgatctacagactacctcaggttctccggctgcaccttaaaagattcaggtggtctggccgtaatcatcgagagaagattggggtccatgtcgtctttgaccaggtattaaccatggaaccttactgctgcagggacatgctctcctctcttgacaaagagacctttgcctatgatctctccgcagtggtcatgcatcacgggaaagggtttggctcaggacactacacagcctattgctacaacacagagggaggtgcgtgcgctttactctgtggggtgggggacacggaaaggggttgatttgtccacattttattgttttccttttatttccatcccatggattacctagagggaaattacatacatcaaaaatccagtggaaagaattgtgaaaattgggttgggcgccgtggctcacacctgtaatcctagcgctttgggaggccgcggtgggtggatcacctgaggtcaggagttcgagaccagcctggccaacatggttaaaccccgtctctactaaaatagtacaaaaattagccgggcgtggtggtgggcactggtaatcccaggtactcaagaggctgaggcaggagaatcgcttgaacctgggaggcagaggttgcagtgagccaagattatgccactgcacttcagcctgggtgacagagcaagactcttatctcaaaaaaaataaaaagaattatgaaagttggattcaaattttgggtatattactaagtaacaacatatggttgttctaagaattaaaaggaactgacatgtaaaagtgcttagaacaggacctaggccctgtgcaatggctcacacctgtaattccaacactttgggaggcagaggcgggaggattgcttgaggccgagggttcaagactagcctgggcaacatagcgagactgcatctctacaaaaaatttaaaaattatccaggtgtaatggtgtgcacctgtgatcctagctacttgggaggctgaggtgggagaattgctcaagcccaggagtttgaagttgcaatgagctatgatttcaccactgcattctagcctgggcaacagagtgagatcctgactcaaataaataaataagaagagcagttgcctaccacatagtacttattcagtcagtgttagaggatattgtagtattatcaaaagtattggttattgataatattactgttttgtggtaatgctacttctgcacaccccagtttccttcttggttatgcagaaacagtagaacctgtgtaacctcaaggagatattgtatgaatctcactagccgcagcttataataaagccgagaacatttaaaaaaaaaaaaaaaaaa

SEQ ID NO: 5587 - DNA, 4786 bp, Homo sapiens
ctcggcgctgaaattcaaatttgaacggctgcagaggccgagtccgtcactggaagccgagaggagaggacagctggttgtgggagagttcccccgcctcagactcctggttttttccaggagacacactgagctgagactcacttttctcttcctgaatttgaaccaccgtttccatcgtctcgtagtccgacgcctggggcgatggatccgtttacggagaaactgctggagcgaacccgtgccaggcgagagaatcttcagagaaaaatggctgagaggcccacagcagctccaaggtctatgactcatgctaagcgagctagacagccactttcagaagcaagtaaccagcagcccctctctggtggtgaagagaaatcttgtacaaaaccatcgccatcaaaaaaacgctgttctgacaacactgaagtagaagtttctaacttggaaaataaacaaccagttgagtcgacatctgcaaaatcttgttctccaagtcctgtgtctcctcaggtgcagccacaagcagcagataccatcagtgattctgttgctgtcccggcatcactgctgggcatgaggagagggctgaactcaagattggaagcaactgcagcctcctcagttaaaacacgtatgcaaaaacttgcagagcaacggcgccgttgggataatgatgatatgacagatgacattcctgaaagctcactcttctcaccaatgccatcagaggaaaaggctgcttcccctcccagacctctgctttcaaatgcctcggcaactccagttggcagaaggggccgtctggccaatcttgctgcaactatttgctcctgggaagatgatgtaaatcactcatttgcaaaacaaaacagtgtacaagaacagcctggtaccgcttgtttatccaaattttcctctgcaagtggagcatctgctaggatcaatagcagcagtgttaagcaggaagctacattctgttcccaaagggatggcgatgcctctttgaataaagccctatcctcaagtgctgatgatgcgtctttggttaatgcctcaatttccagctctgtgaaagctacttctccagtgaaatctactacatctatcactgatgctaaaagttgtgagggacaaaatcctgagctacttccaaaaactcctattagtcctctgaaaacgggggtatcgaaaccaattgtgaagtcaactttatcccagacagttccatccaagggagaattaagtagagaaatttgtctgcaatctcaatctaaagacaaatctacgacaccaggaggaacaggaattaagcctttcctggaacgctttggagagcgttgtcaagaacatagcaaagaaagtccagctcgtagcacaccccacagaacccccattattactccaaatacaaaggccatccaagaaagattattcaagcaagacacatcttcatctactacccatttagcacaacagctcaagcaggaacgtcaaaaagaactagcatgtcttcgtggccgatttgacaagggcaatatatggagtgcagaaaaaggcggaaactcaaaaagcaaacaactagaaaccaaacaggaaactcactgtcagagcactcccctcaaaaaacaccaaggtgtttcaaaaactcagtcacttccagtaacagaaaaggtgaccgaaaaccagataccagccaaaaattctagtacagaacctaaaggtttcactgaatgcgaaatgacgaaatctagccctttgaaaataacattgtttttagaagaggacaaatccttaaaagtaacatcagacccaaaggttgagcagaaaattgaagtgatacgtgaaattgagatgagtgtggatgatgatgatatcaatagttcgaaagtaattaatgacctcttcagtgatgtcctagaggaaggtgaactagatatggagaagagccaagaggagatggatcaagcattagcagaaagcagcgaagaacaggaagatgcactgaatatctcctcaatgtctttacttgcaccattggcacaaacagttggtgtggtaagtccagagagtttagtgtccacacctagactggaattgaaagacaccagcagaagtgatgaaagtccaaaaccaggaaaattccaaagaactcgtgtccctcgagctgaatctggtgatagccttggttctgaagatcgtgatcttctttacagcattgatgcatatagatctcaaagattcaaagaaacagaacgtccatcaataaagcaggtgattgttcggaaggaagatgttacttcaaaactggatgaaaaaaataatgcctttccttgtcaagttaatatcaaacagaaaatgcaggaactcaataacgaaataaatatgcaacagacagtgatctatcaagctagccaggctcttaactgctgtgttgatgaagaacatggaaaagggtccctagaagaagctgaagcagaaagacttcttctaattgcaactgggaagagaacacttttgattgatgaattgaataaattgaagaacgaaggacctcagaggaagaataaggctagtccccaaagtgaatttatgccatccaaaggatcagttactttgtcagaaatccgcttgcctctaaaagcagattttgtctgcagtacggttcagaaaccagatgcagcaaattactattacttaattatactaaaagcaggagctgaaaatatggtagccacaccattagcaagtacttcaaactctcttaacggtgatgctctgacattcactactacatttactctgcaagatgtatccaatgactttgaaataaatattgaagtttacagcttggtgcaaaagaaagatccctcaggccttgataagaagaaaaaaacatccaagtccaaggctattactccaaagcgactcctcacatctataaccacaaaaagcaacattcattcttcagtcatggccagtccaggaggtcttagtgctgtgcgaaccagcaacttcgcccttgttggatcttacacattatcattgtcttcagtaggaaatactaagtttgttctggacaaggtcccctttttatcttctttggaaggtcatatttatttaaaaataaaatgtcaagtgaattccagtgttgaagaaagaggttttctaaccatatttgaagatgttagtggttttggtgcctggcatcgaagatggtgtgttctttctggaaactgtatatcttattggacttatccagatgatgagaaacgcaagaatcccataggaaggataaatctggctaattgtaccagtcgtcagatagaaccagccaacagagaattttgtgcaagacgcaacacttttgaattaattactgtccgaccacaaagagaagatgaccgagagactcttgtcagccaatgcagggacacactctgtgttaccaagaactggctgtctgcagatactaaagaagagcgggatctctggatgcaaaaactcaatcaagttcttgttgatattcgcctctggcaacctgatgcttgctacaaacctattggaaagccttaaaccgggaaatttccatgctatctagaggtttttgatgtcatcttaagaaacacacttaagagcatcagatttactgattgcattttatgctttaagtacgaaagggtttgtgccaatattcactacgtattatgcagtatttatatcttttgtatgtaaaactttaactgatttctgtcattcatcaatgagtagaagtaaatacattatagttgattttgctaaatcttaatttaaaagcctcattttcctagaaatctaattattcagttattcatgacaatatttttttaaaagtaagaaattctgagttgtcttcttggagctgtaggtcttgaagcagcaacgtctttcaggggttggagacagaaacccattctccaatctcagtagttttttcgaaaggctgtgatcatttattgatcgtgatatgacttgttactagggtactgaaaaaaatgtctaaggcctttacagaaacatttttagtaatgaggatgagaactttttcaaatagcaaatatatattggcttaaagcatgaggctgtcttcagaaaagtgatgtggacataggaggcaatgtgtgagacttgggggttcaatattttatatagaagagttaataagcacatggtttacatttactcagctactatatatgcagtgtggtgcacattttcacagaattctggcttcattaagatcattatttttgctgcgtagcttacagacttagcatattagttttttctactcctacaagtgtaaattgaaaaatctttatattaaaaaagtaaactgttatgaagctgctatgtactaataatactttgcttgccaaagtgtttgggttttgttgttgtttgtttgtttgtttgtttttggttcatgaacaacagtgtctagaaacccattttgaaagtggaaaattattaagtcacctatcacctttaaacgcctttttttaaaattataaaatattgtaaagcagggtctcaacttttaaatacactttgaacttcttctctgaattattaaagttctttatgacctcatttataaacactaaattctgtcacctcctgtcattttattttttattcattcaaatgtattttttcttgtgcatattataaaaatatattttatgagctcttactcaaataaatacctgtaaatgtctaaaggaaaaaaaaaaaaaaaaaa

SEQ ID NO: 5588 - DNA, 4195 bp, Homo sapiens
gagagaagctgctgctgctaatgctgctgctgctgctgccgccgccgccgctgctgctgctgctgttggtctgaggctgcagtaggtttctgtgcagcattgcagaatccacacctagagaacagaagacacagacacgtacgtctactacccttgttagaaggaagctttggatcttcggtggataacaagagtaatccacagacttaaaacatgagctcagatgccagccaaggcgtgattaccactcctcctcctcccagcatgcctcacaaagagagatattttgaccgcatcaatgaaaatgacccagaatacattagggagaggaacatgtctcctgatctacgacaagacttcaacatgatggagcagaggaaacgagttactcagatcctgcaaagtcctgcctttcgggaagacttggaatgccttattcaagaacagatgaagaaaggccacaacccaactggattactagcattacagcagattgcagattacatcatggccaattctttctcgggtttttcttcacctcctctcagtcttggcatggtcacacctatcaatgaccttcctggtgcagatacatcctcatatgtgaagggagaaaaacttactcgctgtaaacttgccagcctgtacagacttgtagacttgtttggatgggcacacctggcaaatacctatatctcagtaagaataagtaaggagcaagaccacattataataattcccagaggcctatctttttctgaagctacagcctccaatttggtgaaagtcaatataataggagaagtggttgaccagggaagtaccaatttgaaaattgaccatacaggattcagtccccatgctgcaatctattcaacacgtcctgatgttaagtgtgtgatacacatccatacccttgcaacagcagctgtatcctccatgaaatgtgggatccttccaatttctcaagagtctcttcttctgggagatgttgcctattatgactaccaagggtcacttgaagaacaggaggagagaattcaactgcagaaggttctgggaccaagttgtaaggtgctggtactcaggaatcatggtgtggttgcacttggagaaacattagaggaggcttttcattatatttttaatgtgcaactagcctgtgagattcaggtgcaggccctagcaggtgcaggtggagtagacaatctccatgtactggactttcagaagtataaagctttcacttacactgtagcagcgtctggtggaggaggtgtgaatatgggttcccatcaaaaatggaaggttggcgaaattgagtttgaagggcttatgaggactctggacaacttggggtatagaacaggctatgcttacaggcatcctctcattcgagagaagcctaggcacaagagtgatgtggaaatcccagcaactgtgactgctttttcctttgaagacgatacagtgccactctctcctctcaaatacatggcacagaggcaacagcgtgaaaaaacaagatggctgaactcaccaaatacttacatgaaagtgaatgtgcctgaggagtctcggaacggagaaaccagtccccgaaccaaaatcacgtggatgaaagcagaagactcatctaaagttagtggtggaacacctatcaaaattgaagatccaaatcagtttgttcctttaaacacaaacccgaatgaggtactagaaaagagaaataagattcgggaacaaaatcgatatgacttgaaaacagcaggaccacaatctcagttgcttgctggaattgttgtggataagccaccttctactatgcaatttgaagatgatgatcatggcccaccagctcctcctaacccatttagtcatctcacagaaggagaacttgaagagtataagaggacaatcgaacgtaaacaacaaggcctagaagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttccttttttattagtttagaaagccccttatttttcaacaaaggggattttgtacacataacatgggttatttagtttaactctggcaaaaaaaaaaaaaaaaattttgtatgttgatgtttgtataccgttcagtataaaagtgtcctaagcatattagccaatcttttcacagtagagcatacttaaggctgcttggtactgagtatacttaaatataactccagaatccagggacttggtgttaaaacaggattagagcatgtaaaggtacatctagattcatatttgaatcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatataaaaaaaaaaa

(The sequence listing continues in the following parts.)

The invention claimed is:

1. A combination of 50 polynucleotide probe sets,
said 50 polynucleotide probe sets comprising:
probe set #1 consisting of the nucleic acids consisting of SEQ ID NO: 333, 335 and 334;
probe set #2 consisting of the nucleic acids consisting of SEQ ID NO: 364, 365 and 366;
probe set #3 consisting of the nucleic acids consisting of SEQ ID NO: 364, 366 and 365;
probe set #4 consisting of the nucleic acids consisting of SEQ ID NO: 312, 348 and 313;
probe set #5 consisting of the nucleic acids consisting of SEQ ID NO: 312, 314 and 313;
probe set #6 consisting of the nucleic acids consisting of SEQ ID NO: 171, 172 and 173;
probe set #7 consisting of the nucleic acids consisting of SEQ ID NO: 315, 336 and 331;
probe set #8 consisting of the nucleic acids consisting of SEQ ID NO: 1198, 1199 and 1200;
probe set #9 consisting of the nucleic acids consisting of SEQ ID NO: 315, 317 and 316;
probe set #10 consisting of the nucleic acids consisting of SEQ ID NO: 1522, 1523 and 1524;
probe set #11 consisting of the nucleic acids consisting of SEQ ID NO: 339, 341 and 340;
probe set #12 consisting of the nucleic acids consisting of SEQ ID NO: 353, 361 and 360;
probe set #13 consisting of the nucleic acids consisting of SEQ ID NO: 1185, 1186 and 1194;
probe set #14 consisting of the nucleic acids consisting of SEQ ID NO: 315, 370 and 316;
probe set #15 consisting of the nucleic acids consisting of SEQ ID NO: 324, 326 and 325;
probe set #16 consisting of the nucleic acids consisting of SEQ ID NO: 1165 and 1166;
probe set #17 consisting of the nucleic acid consisting of SEQ ID NO: 177;
probe set #18 consisting of the nucleic acids consisting of SEQ ID NO: 1551, 1552 and 1553;
probe set #19 consisting of the nucleic acids consisting of SEQ ID NO: 315, 316 and 370;
probe set #20 consisting of the nucleic acids consisting of SEQ ID NO: 1185, 1186 and 1194;
probe set #21 consisting of the nucleic acids consisting of SEQ ID NO: 1523, 1524 and 1557;
probe set #22 consisting of the nucleic acid consisting of SEQ ID NO: 1158;
probe set #23 consisting of the nucleic acids consisting of SEQ ID NO: 345, 347 and 346;
probe set #24 consisting of the nucleic acids consisting of SEQ ID NO: 367, 369 and 368;
probe set #25 consisting of the nucleic acids consisting of SEQ ID NO: 315, 331 and 330;
probe set #26 consisting of the nucleic acids consisting of SEQ ID NO: 327, 329 and 328;
probe set #27 consisting of the nucleic acid consisting of SEQ ID NO: 1203;
probe set #28 consisting of the nucleic acids consisting of SEQ ID NO: 1262, 1263 and 1264;
probe set #29 consisting of the nucleic acids consisting of SEQ ID NO: 1534, 1535 and 1536;
probe set #30 consisting of the nucleic acids consisting of SEQ ID NO: 2179, 2180 and 2181;
probe set #31 consisting of the nucleic acids consisting of SEQ ID NO: 1159, 1160 and 1161;
probe set #32 consisting of the nucleic acids consisting of SEQ ID NO: 327, 329 and 328;
probe set #33 consisting of the nucleic acids consisting of SEQ ID NO: 157, 158 and 159;
probe set #34 consisting of the nucleic acids consisting of SEQ ID NO: 1267, 1268 and 1269;
probe set #35 consisting of the nucleic acids consisting of SEQ ID NO: 167, 168 and 169;
probe set #36 consisting of the nucleic acids consisting of SEQ ID NO: 167, 168 and 177;
probe set #37 consisting of the nucleic acids consisting of SEQ ID NO: 1167, 1168 and 1169;
probe set #38 consisting of the nucleic acids consisting of SEQ ID NO: 1544, 1545 and 1546;
probe set #39 consisting of the nucleic acids consisting of SEQ ID NO: 969, 972 and 981;
probe set #40 consisting of the nucleic acids consisting of SEQ ID NO: 1162, 1170 and 1171;
probe set #41 consisting of the nucleic acids consisting of SEQ ID NO: 790, 791 and 792;
probe set #42 consisting of the nucleic acids consisting of SEQ ID NO: 368, 374 and 375;
probe set #43 consisting of the nucleic acids consisting of SEQ ID NO: 1551, 1552 and 1553;
probe set #44 consisting of the nucleic acids consisting of SEQ ID NO: 1554, 1555 and 1556;
probe set #45 consisting of the nucleic acids consisting of SEQ ID NO: 2026, 2027 and 2028;
probe set #46 consisting of the nucleic acids consisting of SEQ ID NO: 1081, 1082 and 1083;
probe set #47 consisting of the nucleic acids consisting of SEQ ID NO: 1129, 1140 and 1141;
probe set #48 consisting of the nucleic acids consisting of SEQ ID NO: 1519, 1520 and 1521;
probe set #49 consisting of the nucleic acids consisting of SEQ ID NO: 136, 137 and 138; and
probe set #50 consisting of the nucleic acids consisting of SEQ ID NO: 793, 794 and 795.

2. The combination according to claim 1, comprising 100 polynucleotide probe sets,
said 100 polynucleotide probe sets comprising probe set #1 to probe set #50, and
probe set #51 consisting of the nucleic acids consisting of SEQ ID NO: 1075; 1076 and 1077;
probe set #52 consisting of the nucleic acids consisting of SEQ ID NO: 369 and 376;
probe set #53 consisting of the nucleic acids consisting of SEQ ID NO: 1509; 1510 and 1511;
probe set #54 consisting of the nucleic acids consisting of SEQ ID NO: 1528 and 1529;
probe set #55 consisting of the nucleic acids consisting of SEQ ID NO: 2176; 2177 and 2178;
probe set #56 consisting of the nucleic acids consisting of SEQ ID NO: 2023; 2024 and 2025;
probe set #57 consisting of the nucleic acids consisting of SEQ ID NO: 1162; 1180 and 1181;
probe set #58 consisting of the nucleic acids consisting of SEQ ID NO: 367 and 378;
probe set #59 consisting of the nucleic acids consisting of SEQ ID NO: 971;
probe set #60 consisting of the nucleic acids consisting of SEQ ID NO: 788 and 789;
probe set #61 consisting of the nucleic acids consisting of SEQ ID NO: 349; 361 and 350;
probe set #62 consisting of the nucleic acids consisting of SEQ ID NO: 1519; 1520 and 1521;

probe set #63 consisting of the nucleic acids consisting of SEQ ID NO: 555; 556 and 557;
probe set #64 consisting of the nucleic acids consisting of SEQ ID NO: 154; 155 and 156;
probe set #65 consisting of the nucleic acids consisting of SEQ ID NO: 317; 338 and 337;
probe set #66 consisting of the nucleic acids consisting of SEQ ID NO: 1201; 1202 and 1203;
probe set #67 consisting of the nucleic acids consisting of SEQ ID NO: 1187; 1188 and 1189;
probe set #68 consisting of the nucleic acids consisting of SEQ ID NO: 1129; 1130 and 1131;
probe set #69 consisting of the nucleic acids consisting of SEQ ID NO: 821; 822 and 823;
probe set #70 consisting of the nucleic acids consisting of SEQ ID NO: 558; 566 and 567;
probe set #71 consisting of the nucleic acids consisting of SEQ ID NO: 800; 801 and 802;
probe set #72 consisting of the nucleic acids consisting of SEQ ID NO: 2762; 2763 and 2764;
probe set #73 consisting of the nucleic acids consisting of SEQ ID NO: 1190; 1191 and 1192;
probe set #74 consisting of the nucleic acids consisting of SEQ ID NO: 1103; 1104 and 1105;
probe set #75 consisting of the nucleic acids consisting of SEQ ID NO: 2860; 2861 and 2862;
probe set #76 consisting of the nucleic acids consisting of SEQ ID NO: 1524; 1561 and 1562;
probe set #77 consisting of the nucleic acids consisting of SEQ ID NO: 1195 and 1196;
probe set #78 consisting of the nucleic acids consisting of SEQ ID NO: 315; 331; 330;
probe set #79 consisting of the nucleic acids consisting of SEQ ID NO: 120;
probe set #80 consisting of the nucleic acids consisting of SEQ ID NO: 821; 822 and 823;
probe set #81 consisting of the nucleic acids consisting of SEQ ID NO: 1162; 1163 and 1164;
probe set #82 consisting of the nucleic acids consisting of SEQ ID NO: 379; 380 and 381;
probe set #83 consisting of the nucleic acids consisting of SEQ ID NO: 1519; 1520 and 1521;
probe set #84 consisting of the nucleic acids consisting of SEQ ID NO: 354; 356 and 355;
probe set #85 consisting of the nucleic acids consisting of SEQ ID NO: 1087; 1088 and 1089;
probe set #86 consisting of the nucleic acids consisting of SEQ ID NO: 332;
probe set #87 consisting of the nucleic acids consisting of SEQ ID NO: 328; 371 and 363;
probe set #88 consisting of the nucleic acids consisting of SEQ ID NO: 1123; 1124 and 1125;
probe set #89 consisting of the nucleic acids consisting of SEQ ID NO: 2173; 2174 and 2175;
probe set #90 consisting of the nucleic acids consisting of SEQ ID NO: 1193; 1194 and 1207;
probe set #91 consisting of the nucleic acids consisting of SEQ ID NO: 1682; 1683 and 1684;
probe set #92 consisting of the nucleic acids consisting of SEQ ID NO: 1776; 1777 and 1778;
probe set #93 consisting of the nucleic acids consisting of SEQ ID NO: 1163; 1164 and 1172;
probe set #94 consisting of the nucleic acids consisting of SEQ ID NO: 1114; 1115 and 1116;
probe set #95 consisting of the nucleic acids consisting of SEQ ID NO: 2883; 2884 and 2885;
probe set #96 consisting of the nucleic acids consisting of SEQ ID NO: 1187; 1188 and 1189;
probe set #97 consisting of the nucleic acids consisting of SEQ ID NO: 174; 175 and 176;
probe set #98 consisting of the nucleic acids consisting of SEQ ID NO: 560; 561 and 562;
probe set #99 consisting of the nucleic acids consisting of SEQ ID NO: 1056; 1057 and 1058; and
probe set #100 consisting of the nucleic acids consisting of SEQ ID NO: 351; 353 and 352.

3. The combination according to claim 2, comprising 150 polynucleotide probe sets, said 150 polynucleotide probe sets comprising probe set #1 to probe set #100, and
probe set #101 consisting of the nucleic acids consisting of SEQ ID NO: 1315; 2599 and 2600;
probe set #102 consisting of the nucleic acids consisting of SEQ ID NO: 1690; 1691 and 1692;
probe set #103 consisting of the nucleic acids consisting of SEQ ID NO: 1199;
probe set #104 consisting of the nucleic acids consisting of SEQ ID NO: 788; 796 and 797;
probe set #105 consisting of the nucleic acids consisting of SEQ ID NO: 1057; 1058 and 1080;
probe set #106 consisting of the nucleic acids consisting of SEQ ID NO: 1469; 1470 and 1471;
probe set #107 consisting of the nucleic acids consisting of SEQ ID NO: 798; 799 and 801;
probe set #108 consisting of the nucleic acids consisting of SEQ ID NO: 1788; 1789 and 1790;
probe set #109 consisting of the nucleic acids consisting of SEQ ID NO: 1550;
probe set #110 consisting of the nucleic acids consisting of SEQ ID NO: 806; 807 and 808;
probe set #111 consisting of the nucleic acids consisting of SEQ ID NO: 1061; 1062 and 1063;
probe set #112 consisting of the nucleic acids consisting of SEQ ID NO: 788; 796 and 797;
probe set #113 consisting of the nucleic acids consisting of SEQ ID NO: 2576; 2577 and 2578;
probe set #114 consisting of the nucleic acids consisting of SEQ ID NO: 1580; 1581 and 1582;
probe set #115 consisting of the nucleic acids consisting of SEQ ID NO: 968; 969 and 970;
probe set #116 consisting of the nucleic acids consisting of SEQ ID NO: 1469; 1470 and 1471;
probe set #117 consisting of the nucleic acids consisting of SEQ ID NO: 1064; 1065 and 1066;
probe set #118 consisting of the nucleic acids consisting of SEQ ID NO: 1558; 1559 and 1560;
probe set #119 consisting of the nucleic acids consisting of SEQ ID NO: 362; 371 and 363;
probe set #120 consisting of the nucleic acids consisting of SEQ ID NO: 197; 1139 and 1141;
probe set #121 consisting of the nucleic acids consisting of SEQ ID NO: 1537; 1538 and 1539;
probe set #122 consisting of the nucleic acids consisting of SEQ ID NO: 803; 804 and 805;
probe set #123 consisting of the nucleic acids consisting of SEQ ID NO: 513; 514 and 515;
probe set #124 consisting of the nucleic acids consisting of SEQ ID NO: 1067; 1068 and 1069;
probe set #125 consisting of the nucleic acids consisting of SEQ ID NO: 812; 813 and 814;
probe set #126 consisting of the nucleic acids consisting of SEQ ID NO: 2196 and 2201;
probe set #127 consisting of the nucleic acids consisting of SEQ ID NO: 558; 559 and 567;

probe set #128 consisting of the nucleic acids consisting of SEQ ID NO: 248; 254 and 255;
probe set #129 consisting of the nucleic acids consisting of SEQ ID NO: 368 and 377;
probe set #130 consisting of the nucleic acids consisting of SEQ ID NO: 2536; 2537 and 2538;
probe set #131 consisting of the nucleic acids consisting of SEQ ID NO: 4; 5 and 6;
probe set #132 consisting of the nucleic acids consisting of SEQ ID NO: 2065; 2067 and 2091;
probe set #133 consisting of the nucleic acids consisting of SEQ ID NO: 1671; 1685 and 1686;
probe set #134 consisting of the nucleic acids consisting of SEQ ID NO: 1174; 1175 and 1176;
probe set #135 consisting of the nucleic acids consisting of SEQ ID NO: 783; 784 and 785;
probe set #136 consisting of the nucleic acids consisting of SEQ ID NO: 2774; 2775 and 2776;
probe set #137 consisting of the nucleic acids consisting of SEQ ID NO: 305; 307 and 306;
probe set #138 consisting of the nucleic acids consisting of SEQ ID NO: 1952; 1953 and 1954;
probe set #139 consisting of the nucleic acids consisting of SEQ ID NO: 806; 807 and 808;
probe set #140 consisting of the nucleic acids consisting of SEQ ID NO: 1162; 1284 and 1285;
probe set #141 consisting of the nucleic acids consisting of SEQ ID NO: 1204; 1205 and 1206;
probe set #142 consisting of the nucleic acids consisting of SEQ ID NO: 1197;
probe set #143 consisting of the nucleic acids consisting of SEQ ID NO: 2229; 2230 and 2231;
probe set #144 consisting of the nucleic acids consisting of SEQ ID NO: 1963;
probe set #145 consisting of the nucleic acids consisting of SEQ ID NO: 1890; 1891 and 1892;
probe set #146 consisting of the nucleic acids consisting of SEQ ID NO: 813; 814 and 818;
probe set #147 consisting of the nucleic acids consisting of SEQ ID NO: 2088; 2089 and 2090;
probe set #148 consisting of the nucleic acids consisting of SEQ ID NO: 1515; 1516 and 1517;
probe set #149 consisting of the nucleic acids consisting of SEQ ID NO: 1056; 1070 and 1071; and
probe set #150 consisting of the nucleic acids consisting of SEQ ID NO: 552; 553 and 554.

4. The combination according to claim 3, comprising 200 polynucleotide probe sets,
said 200 polynucleotide probe sets comprising probe set #1 to probe set #150, and
probe set #151 consisting of the nucleic acids consisting of SEQ ID NO: 972; 973 and 974;
probe set #152 consisting of the nucleic acids consisting of SEQ ID NO: 845; 846 and 847;
probe set #153 consisting of the nucleic acids consisting of SEQ ID NO: 815; 816 and 817;
probe set #154 consisting of the nucleic acids consisting of SEQ ID NO: 195; 196 and 868;
probe set #155 consisting of the nucleic acids consisting of SEQ ID NO: 1512; 1513 and 1514;
probe set #156 consisting of the nucleic acids consisting of SEQ ID NO: 1162; 1284 and 1285;
probe set #157 consisting of the nucleic acids consisting of SEQ ID NO: 2088; 2089 and 2090;
probe set #158 consisting of the nucleic acids consisting of SEQ ID NO: 1335;
probe set #159 consisting of the nucleic acids consisting of SEQ ID NO: 1123; 1124 and 1125;
probe set #160 consisting of the nucleic acids consisting of SEQ ID NO: 840; 841 and 845;
probe set #161 consisting of the nucleic acids consisting of SEQ ID NO: 1084; 1085 and 1086;
probe set #162 consisting of the nucleic acids consisting of SEQ ID NO: 198; 199 and 200;
probe set #163 consisting of the nucleic acids consisting of SEQ ID NO: 824; 825 and 826;
probe set #164 consisting of the nucleic acids consisting of SEQ ID NO: 809; 810 and 811;
probe set #165 consisting of the nucleic acids consisting of SEQ ID NO: 1586; 1587 and 1588;
probe set #166 consisting of the nucleic acids consisting of SEQ ID NO: 2794;
probe set #167 consisting of the nucleic acids consisting of SEQ ID NO: 1094; 1095 and 1096;
probe set #168 consisting of the nucleic acids consisting of SEQ ID NO: 2778; 2779 and 2783;
probe set #169 consisting of the nucleic acids consisting of SEQ ID NO: 1162; 1284 and 1285;
probe set #170 consisting of the nucleic acids consisting of SEQ ID NO: 1952; 1953 and 1954;
probe set #171 consisting of the nucleic acids consisting of SEQ ID NO: 975; 976 and 977;
probe set #172 consisting of the nucleic acids consisting of SEQ ID NO: 1110; 1111 and 1112;
probe set #173 consisting of the nucleic acids consisting of SEQ ID NO: 2762; 2763 and 2764;
probe set #174 consisting of the nucleic acids consisting of SEQ ID NO: 1229; 1230 and 1242;
probe set #175 consisting of the nucleic acids consisting of SEQ ID NO: 1250; 1251 and 1252;
probe set #176 consisting of the nucleic acids consisting of SEQ ID NO: 1126; 1127 and 1128;
probe set #177 consisting of the nucleic acids consisting of SEQ ID NO: 2065; 2067 and 2091;
probe set #178 consisting of the nucleic acids consisting of SEQ ID NO: 2601; 2602 and 2603;
probe set #179 consisting of the nucleic acids consisting of SEQ ID NO: 2381; 2382 and 2383;
probe set #180 consisting of the nucleic acids consisting of SEQ ID NO: 1407 and 1408;
probe set #181 consisting of the nucleic acids consisting of SEQ ID NO: 2065; 2067 and 2068;
probe set #182 consisting of the nucleic acids consisting of SEQ ID NO: 130; 131 and 132;
probe set #183 consisting of the nucleic acids consisting of SEQ ID NO: 1194; 1265 and 1266;
probe set #184 consisting of the nucleic acids consisting of SEQ ID NO: 968; 969 and 970;
probe set #185 consisting of the nucleic acids consisting of SEQ ID NO: 1743; 1744 and 1745;
probe set #186 consisting of the nucleic acids consisting of SEQ ID NO: 1557; 1563 and 1564;
probe set #187 consisting of the nucleic acids consisting of SEQ ID NO: 1687; 1688 and 1689;
probe set #188 consisting of the nucleic acids consisting of SEQ ID NO: 1114; 1115 and 1116;
probe set #189 consisting of the nucleic acids consisting of SEQ ID NO: 2083; 2084 and 2085;
probe set #190 consisting of the nucleic acids consisting of SEQ ID NO: 2072; 2089 and 2092;
probe set #191 consisting of the nucleic acids consisting of SEQ ID NO: 1586; 1587 and 1588;

probe set #192 consisting of the nucleic acids consisting of SEQ ID NO: 563; 564 and 565;
probe set #193 consisting of the nucleic acids consisting of SEQ ID NO: 1270; 1271 and 1272;
probe set #194 consisting of the nucleic acids consisting of SEQ ID NO: 1243; 1244 and 1245;
probe set #195 consisting of the nucleic acids consisting of SEQ ID NO: 1896; 1897 and 1898;
probe set #196 consisting of the nucleic acids consisting of SEQ ID NO: 1059; 1060 and 1085;
probe set #197 consisting of the nucleic acids consisting of SEQ ID NO: 1469; 1470 and 1471;
probe set #198 consisting of the nucleic acids consisting of SEQ ID NO: 121; 122 and 123;
probe set #199 consisting of the nucleic acids consisting of SEQ ID NO: 2061; 2062 and 2063; and
probe set #200 consisting of the nucleic acids consisting of SEQ ID NO: 1974.

5. The combination according to claim 4, comprising 1228 polynucleotide probe sets,
said 1228 polynucleotide probe sets comprising probe set #1 to probe set #200, and
probe set #201 consisting of the nucleic acids consisting of SEQ ID NO: 246; 247 and 248;
probe set #202 consisting of the nucleic acids consisting of SEQ ID NO: 1243; 1244 and 1245;
probe set #203 consisting of the nucleic acids consisting of SEQ ID NO: 2061; 2103 and 2104;
probe set #204 consisting of the nucleic acids consisting of SEQ ID NO: 1284; 1489 and 1490;
probe set #205 consisting of the nucleic acids consisting of SEQ ID NO: 342; 344 and 343;
probe set #206 consisting of the nucleic acids consisting of SEQ ID NO: 2202; 2203 and 2204;
probe set #207 consisting of the nucleic acids consisting of SEQ ID NO: 1931; 1932 and 1971;
probe set #208 consisting of the nucleic acids consisting of SEQ ID NO: 1293; 1294 and 1295;
probe set #209 consisting of the nucleic acids consisting of SEQ ID NO: 1515; 1517 and 1518;
probe set #210 consisting of the nucleic acids consisting of SEQ ID NO: 1193; 1194 and 1207;
probe set #211 consisting of the nucleic acids consisting of SEQ ID NO: 1068; 1078 and 1079;
probe set #212 consisting of the nucleic acids consisting of SEQ ID NO: 1243; 1244 and 1245;
probe set #213 consisting of the nucleic acids consisting of SEQ ID NO: 1952; 1953 and 1954;
probe set #214 consisting of the nucleic acids consisting of SEQ ID NO: 2061; 2062 and 2103;
probe set #215 consisting of the nucleic acids consisting of SEQ ID NO: 2798; 2799 and 2800;
probe set #216 consisting of the nucleic acids consisting of SEQ ID NO: 1773; 1774 and 1775;
probe set #217 consisting of the nucleic acids consisting of SEQ ID NO: 2471; 2472 and 2473;
probe set #218 consisting of the nucleic acids consisting of SEQ ID NO: 1243; 1244 and 1245;
probe set #219 consisting of the nucleic acids consisting of SEQ ID NO: 1109;
probe set #220 consisting of the nucleic acids consisting of SEQ ID NO: 1547; 1548 and 1549;
probe set #221 consisting of the nucleic acids consisting of SEQ ID NO: 1525; 1526 and 1527;
probe set #222 consisting of the nucleic acids consisting of SEQ ID NO: 2193; 2196 and 2200;
probe set #223 consisting of the nucleic acids consisting of SEQ ID NO: 2212 and 2213;
probe set #224 consisting of the nucleic acids consisting of SEQ ID NO: 972; 973 and 974;
probe set #225 consisting of the nucleic acids consisting of SEQ ID NO: 841; 845 and 846;
probe set #226 consisting of the nucleic acids consisting of SEQ ID NO: 1243; 1244 and 1245;
probe set #227 consisting of the nucleic acids consisting of SEQ ID NO: 813; 819 and 820;
probe set #228 consisting of the nucleic acids consisting of SEQ ID NO: 2060; 2077 and 2089;
probe set #229 consisting of the nucleic acids consisting of SEQ ID NO: 1530; 1531 and 1532;
probe set #230 consisting of the nucleic acids consisting of SEQ ID NO: 2060; 2072 and 2097;
probe set #231 consisting of the nucleic acids consisting of SEQ ID NO: 786; 787 and 796;
probe set #232 consisting of the nucleic acids consisting of SEQ ID NO: 379; 380 and 381;
probe set #233 consisting of the nucleic acids consisting of SEQ ID NO: 1662; 1663 and 1664;
probe set #234 consisting of the nucleic acids consisting of SEQ ID NO: 560; 561 and 562;
probe set #235 consisting of the nucleic acids consisting of SEQ ID NO: 1174; 1175 and 1176;
probe set #236 consisting of the nucleic acids consisting of SEQ ID NO: 1177; 1178 and 1179;
probe set #237 consisting of the nucleic acids consisting of SEQ ID NO: 1952; 1953 and 1954;
probe set #238 consisting of the nucleic acids consisting of SEQ ID NO: 1187; 1188 and 1189;
probe set #239 consisting of the nucleic acids consisting of SEQ ID NO: 151; 152 and 153;
probe set #240 consisting of the nucleic acids consisting of SEQ ID NO: 2235; 2236 and 2237;
probe set #241 consisting of the nucleic acids consisting of SEQ ID NO: 1218; 1238 and 1253;
probe set #242 consisting of the nucleic acids consisting of SEQ ID NO: 446; 447 and 454;
probe set #243 consisting of the nucleic acids consisting of SEQ ID NO: 1229; 1242 and 1260;
probe set #244 consisting of the nucleic acids consisting of SEQ ID NO: 824; 825 and 826;
probe set #245 consisting of the nucleic acids consisting of SEQ ID NO: 848; 849 and 850;
probe set #246 consisting of the nucleic acids consisting of SEQ ID NO: 2058; 2059 and 2089;
probe set #247 consisting of the nucleic acids consisting of SEQ ID NO: 1475; 1476 and 1477;
probe set #248 consisting of the nucleic acids consisting of SEQ ID NO: 2533; 2534 and 2535;
probe set #249 consisting of the nucleic acids consisting of SEQ ID NO: 2192; 2193 and 2194;
probe set #250 consisting of the nucleic acids consisting of SEQ ID NO: 832; 833 and 834;
probe set #251 consisting of the nucleic acids consisting of SEQ ID NO: 1234 and 1235;
probe set #252 consisting of the nucleic acids consisting of SEQ ID NO: 1893; 1894 and 1895;
probe set #253 consisting of the nucleic acids consisting of SEQ ID NO: 1932; 1971 and 1987;
probe set #254 consisting of the nucleic acids consisting of SEQ ID NO: 2083; 2084 and 2085;
probe set #255 consisting of the nucleic acids consisting of SEQ ID NO: 264; 273 and 274;

probe set #256 consisting of the nucleic acids consisting of SEQ ID NO: 428;
probe set #257 consisting of the nucleic acids consisting of SEQ ID NO: 198; 199 and 200;
probe set #258 consisting of the nucleic acids consisting of SEQ ID NO: 2200; 2205 and 2206;
probe set #259 consisting of the nucleic acids consisting of SEQ ID NO: 2777; 2778 and 2779;
probe set #260 consisting of the nucleic acids consisting of SEQ ID NO: 1287; 1288 and 1289;
probe set #261 consisting of the nucleic acids consisting of SEQ ID NO: 446; 453 and 454;
probe set #262 consisting of the nucleic acids consisting of SEQ ID NO: 2192; 2193 and 2194;
probe set #263 consisting of the nucleic acids consisting of SEQ ID NO: 1952; 1953 and 1954;
probe set #264 consisting of the nucleic acids consisting of SEQ ID NO: 1216; 1217 and 1218;
probe set #265 consisting of the nucleic acids consisting of SEQ ID NO: 1216; 1217 and 1218;
probe set #266 consisting of the nucleic acids consisting of SEQ ID NO: 388; 389 and 390;
probe set #267 consisting of the nucleic acids consisting of SEQ ID NO: 1310; 1311 and 1312;
probe set #268 consisting of the nucleic acids consisting of SEQ ID NO: 1313; 1314 and 1315;
probe set #269 consisting of the nucleic acids consisting of SEQ ID NO: 1142; 1143 and 1144;
probe set #270 consisting of the nucleic acids consisting of SEQ ID NO: 1229; 1230 and 1242;
probe set #271 consisting of the nucleic acids consisting of SEQ ID NO: 972; 973 and 974;
probe set #272 consisting of the nucleic acids consisting of SEQ ID NO: 1673; 1674 and 1675;
probe set #273 consisting of the nucleic acids consisting of SEQ ID NO: 446; 453 and 454;
probe set #274 consisting of the nucleic acids consisting of SEQ ID NO: 2195; 2196 and 2197;
probe set #275 consisting of the nucleic acids consisting of SEQ ID NO: 2784;
probe set #276 consisting of the nucleic acids consisting of SEQ ID NO: 2061; 2062 and 2103;
probe set #277 consisting of the nucleic acids consisting of SEQ ID NO: 459 and 460;
probe set #278 consisting of the nucleic acids consisting of SEQ ID NO: 1583; 1584 and 1585;
probe set #279 consisting of the nucleic acids consisting of SEQ ID NO: 1246; 1247 and 1248;
probe set #280 consisting of the nucleic acids consisting of SEQ ID NO: 2061; 2063 and 2068;
probe set #281 consisting of the nucleic acids consisting of SEQ ID NO: 1216; 1217 and 1218;
probe set #282 consisting of the nucleic acids consisting of SEQ ID NO: 170;
probe set #283 consisting of the nucleic acids consisting of SEQ ID NO: 2072; 2089 and 2102;
probe set #284 consisting of the nucleic acids consisting of SEQ ID NO: 1216; 1217 and 1238;
probe set #285 consisting of the nucleic acids consisting of SEQ ID NO: 127; 128 and 129;
probe set #286 consisting of the nucleic acids consisting of SEQ ID NO: 1216; 1217 and 1218;
probe set #287 consisting of the nucleic acids consisting of SEQ ID NO: 840; 841 and 845;
probe set #288 consisting of the nucleic acids consisting of SEQ ID NO: 840; 841 and 845;
probe set #289 consisting of the nucleic acids consisting of SEQ ID NO: 1216; 1217 and 1218;
probe set #290 consisting of the nucleic acids consisting of SEQ ID NO: 1218; 1253 and 1254;
probe set #291 consisting of the nucleic acids consisting of SEQ ID NO: 1369; 1370 and 1371;
probe set #292 consisting of the nucleic acids consisting of SEQ ID NO: 1239; 1240 and 1241;
probe set #293 consisting of the nucleic acids consisting of SEQ ID NO: 1229; 1242 and 1260;
probe set #294 consisting of the nucleic acids consisting of SEQ ID NO: 1218; 1253 and 1254;
probe set #295 consisting of the nucleic acids consisting of SEQ ID NO: 1515; 1517 and 1518;
probe set #296 consisting of the nucleic acids consisting of SEQ ID NO: 2307;
probe set #297 consisting of the nucleic acids consisting of SEQ ID NO: 246; 247 and 248;
probe set #298 consisting of the nucleic acids consisting of SEQ ID NO: 1216; 1218 and 1253;
probe set #299 consisting of the nucleic acids consisting of SEQ ID NO: 2059; 2100 and 2101;
probe set #300 consisting of the nucleic acids consisting of SEQ ID NO: 841; 845 and 846;
probe set #301 consisting of the nucleic acids consisting of SEQ ID NO: 1746; 1747 and 1748;
probe set #302 consisting of the nucleic acids consisting of SEQ ID NO: 1313; 1314 and 1315;
probe set #303 consisting of the nucleic acids consisting of SEQ ID NO: 845; 846 and 847;
probe set #304 consisting of the nucleic acids consisting of SEQ ID NO: 1942; 1943 and 1948;
probe set #305 consisting of the nucleic acids consisting of SEQ ID NO: 1047; 1048 and 1049;
probe set #306 consisting of the nucleic acids consisting of SEQ ID NO: 1216; 1217 and 1218;
probe set #307 consisting of the nucleic acids consisting of SEQ ID NO: 2483; 2484 and 2485;
probe set #308 consisting of the nucleic acids consisting of SEQ ID NO: 827 and 828;
probe set #309 consisting of the nucleic acids consisting of SEQ ID NO: 1943; 1948 and 1973;
probe set #310 consisting of the nucleic acids consisting of SEQ ID NO: 1039 and 1040;
probe set #311 consisting of the nucleic acids consisting of SEQ ID NO: 2558; 2559 and 2560;
probe set #312 consisting of the nucleic acids consisting of SEQ ID NO: 2060; 2072 and 2097;
probe set #313 consisting of the nucleic acids consisting of SEQ ID NO: 2058; 2059 and 2089;
probe set #314 consisting of the nucleic acids consisting of SEQ ID NO: 1218; 1238 and 1253;
probe set #315 consisting of the nucleic acids consisting of SEQ ID NO: 1239; 1240 and 1241;
probe set #316 consisting of the nucleic acids consisting of SEQ ID NO: 1256; 1257 and 1258;
probe set #317 consisting of the nucleic acids consisting of SEQ ID NO: 2063; 2068 and 2103;
probe set #318 consisting of the nucleic acids consisting of SEQ ID NO: 446; 453 and 454;
probe set #319 consisting of the nucleic acids consisting of SEQ ID NO: 422; 423 and 424;
probe set #320 consisting of the nucleic acids consisting of SEQ ID NO: 451; 452 and 454;
probe set #321 consisting of the nucleic acids consisting of SEQ ID NO: 2076; 2103 and 2108;

probe set #322 consisting of the nucleic acids consisting of SEQ ID NO: 139; 140 and 141;
probe set #323 consisting of the nucleic acids consisting of SEQ ID NO: 228; 229 and 230;
probe set #324 consisting of the nucleic acids consisting of SEQ ID NO: 1218; 1242 and 1260;
probe set #325 consisting of the nucleic acids consisting of SEQ ID NO: 2510; 2511 and 2512;
probe set #326 consisting of the nucleic acids consisting of SEQ ID NO: 2670; 2723 and 2759;
probe set #327 consisting of the nucleic acids consisting of SEQ ID NO: 1148; 1149 and 1150;
probe set #328 consisting of the nucleic acids consisting of SEQ ID NO: 1568; 1569 and 1570;
probe set #329 consisting of the nucleic acids consisting of SEQ ID NO: 1290; 1291 and 1292;
probe set #330 consisting of the nucleic acids consisting of SEQ ID NO: 2061; 2063 and 2068;
probe set #331 consisting of the nucleic acids consisting of SEQ ID NO: 1174; 1175 and 1176;
probe set #332 consisting of the nucleic acids consisting of SEQ ID NO: 1239; 1240 and 1241;
probe set #333 consisting of the nucleic acids consisting of SEQ ID NO: 761; 762 and 763;
probe set #334 consisting of the nucleic acids consisting of SEQ ID NO: 669; 670 and 671;
probe set #335 consisting of the nucleic acids consisting of SEQ ID NO: 1216; 1218 and 1253;
probe set #336 consisting of the nucleic acids consisting of SEQ ID NO: 1136; 1137 and 1138;
probe set #337 consisting of the nucleic acids consisting of SEQ ID NO: 1671; 1672 and 1685;
probe set #338 consisting of the nucleic acids consisting of SEQ ID NO: 1565; 1566 and 1567;
probe set #339 consisting of the nucleic acids consisting of SEQ ID NO: 308;
probe set #340 consisting of the nucleic acids consisting of SEQ ID NO: 1583; 1584 and 1585;
probe set #341 consisting of the nucleic acids consisting of SEQ ID NO: 1985;
probe set #342 consisting of the nucleic acids consisting of SEQ ID NO: 1583; 1584 and 1600;
probe set #343 consisting of the nucleic acids consisting of SEQ ID NO: 2520; 2521 and 2522;
probe set #344 consisting of the nucleic acids consisting of SEQ ID NO: 842; 843 and 844;
probe set #345 consisting of the nucleic acids consisting of SEQ ID NO: 1216; 1217 and 1218;
probe set #346 consisting of the nucleic acids consisting of SEQ ID NO: 837; 838 and 839;
probe set #347 consisting of the nucleic acids consisting of SEQ ID NO: 2063; 2068 and 2103;
probe set #348 consisting of the nucleic acids consisting of SEQ ID NO: 669; 670 and 671;
probe set #349 consisting of the nucleic acids consisting of SEQ ID NO: 1583; 1584 and 1585;
probe set #350 consisting of the nucleic acids consisting of SEQ ID NO: 2492; 2493 and 2494;
probe set #351 consisting of the nucleic acids consisting of SEQ ID NO: 1218; 1253 and 1261;
probe set #352 consisting of the nucleic acids consisting of SEQ ID NO: 1869; 1870 and 1871;
probe set #353 consisting of the nucleic acids consisting of SEQ ID NO: 1213; 1214 and 1215;
probe set #354 consisting of the nucleic acids consisting of SEQ ID NO: 318; 320 and 319;
probe set #355 consisting of the nucleic acids consisting of SEQ ID NO: 448; 449 and 450;
probe set #356 consisting of the nucleic acids consisting of SEQ ID NO: 2158; 2163 and 2164;
probe set #357 consisting of the nucleic acids consisting of SEQ ID NO: 971;
probe set #358 consisting of the nucleic acids consisting of SEQ ID NO: 1059; 1060 and 1093;
probe set #359 consisting of the nucleic acids consisting of SEQ ID NO: 2662; 2663 and 2664;
probe set #360 consisting of the nucleic acids consisting of SEQ ID NO: 125; 126 and 127;
probe set #361 consisting of the nucleic acids consisting of SEQ ID NO: 2069; 2070 and 2071;
probe set #362 consisting of the nucleic acids consisting of SEQ ID NO: 761; 762 and 763;
probe set #363 consisting of the nucleic acids consisting of SEQ ID NO: 1589; 1590 and 1591;
probe set #364 consisting of the nucleic acids consisting of SEQ ID NO: 2523;
probe set #365 consisting of the nucleic acids consisting of SEQ ID NO: 2760;
probe set #366 consisting of the nucleic acids consisting of SEQ ID NO: 2078 and 2079;
probe set #367 consisting of the nucleic acids consisting of SEQ ID NO: 197; 868 and 1139;
probe set #368 consisting of the nucleic acids consisting of SEQ ID NO: 1229; 1242 and 1260;
probe set #369 consisting of the nucleic acids consisting of SEQ ID NO: 429; 430 and 431;
probe set #370 consisting of the nucleic acids consisting of SEQ ID NO: 845; 846 and 847;
probe set #371 consisting of the nucleic acids consisting of SEQ ID NO: 1472; 1473 and 1474;
probe set #372 consisting of the nucleic acids consisting of SEQ ID NO: 2061; 2062 and 2063;
probe set #373 consisting of the nucleic acids consisting of SEQ ID NO: 1478; 1479 and 1480;
probe set #374 consisting of the nucleic acids consisting of SEQ ID NO: 1229; 1242 and 1260;
probe set #375 consisting of the nucleic acids consisting of SEQ ID NO: 1931; 1932 and 1962;
probe set #376 consisting of the nucleic acids consisting of SEQ ID NO: 304;
probe set #377 consisting of the nucleic acids consisting of SEQ ID NO: 2064; 2065 and 2066;
probe set #378 consisting of the nucleic acids consisting of SEQ ID NO: 1229; 1242 and 1260;
probe set #379 consisting of the nucleic acids consisting of SEQ ID NO: 1218; 1242 and 1260;
probe set #380 consisting of the nucleic acids consisting of SEQ ID NO: 2928; 2929 and 2930;
probe set #381 consisting of the nucleic acids consisting of SEQ ID NO: 975; 976 and 977;
probe set #382 consisting of the nucleic acids consisting of SEQ ID NO: 246; 247 and 248;
probe set #383 consisting of the nucleic acids consisting of SEQ ID NO: 2069; 2070 and 2071;
probe set #384 consisting of the nucleic acids consisting of SEQ ID NO: 1952; 1953 and 1954;
probe set #385 consisting of the nucleic acids consisting of SEQ ID NO: 538; 539 and 540;
probe set #386 consisting of the nucleic acids consisting of SEQ ID NO: 160;
probe set #387 consisting of the nucleic acids consisting of SEQ ID NO: 722; 723 and 724;

probe set #388 consisting of the nucleic acids consisting of SEQ ID NO: 702; 703 and 704;
probe set #389 consisting of the nucleic acids consisting of SEQ ID NO: 975; 976 and 977;
probe set #390 consisting of the nucleic acids consisting of SEQ ID NO: 2513;
probe set #391 consisting of the nucleic acids consisting of SEQ ID NO: 2338; 2339 and 2340;
probe set #392 consisting of the nucleic acids consisting of SEQ ID NO: 869; 873 and 874;
probe set #393 consisting of the nucleic acids consisting of SEQ ID NO: 1299; 1300 and 1301;
probe set #394 consisting of the nucleic acids consisting of SEQ ID NO: 2886; 2887 and 2888;
probe set #395 consisting of the nucleic acids consisting of SEQ ID NO: 2099;
probe set #396 consisting of the nucleic acids consisting of SEQ ID NO: 2471; 2472 and 2473;
probe set #397 consisting of the nucleic acids consisting of SEQ ID NO: 1679; 1680 and 1681;
probe set #398 consisting of the nucleic acids consisting of SEQ ID NO: 841; 845 and 846;
probe set #399 consisting of the nucleic acids consisting of SEQ ID NO: 1113;
probe set #400 consisting of the nucleic acids consisting of SEQ ID NO: 1592; 1593 and 1594;
probe set #401 consisting of the nucleic acids consisting of SEQ ID NO: 2338; 2339 and 2340;
probe set #402 consisting of the nucleic acids consisting of SEQ ID NO: 2483; 2484 and 2485;
probe set #403 consisting of the nucleic acids consisting of SEQ ID NO: 2300; 2301 and 2302;
probe set #404 consisting of the nucleic acids consisting of SEQ ID NO: 2548; 2549 and 2550;
probe set #405 consisting of the nucleic acids consisting of SEQ ID NO: 1939; 1940 and 1941;
probe set #406 consisting of the nucleic acids consisting of SEQ ID NO: 195; 196 and 197;
probe set #407 consisting of the nucleic acids consisting of SEQ ID NO: 2061; 2103 and 2104;
probe set #408 consisting of the nucleic acids consisting of SEQ ID NO: 2060; 2072 and 2097;
probe set #409 consisting of the nucleic acids consisting of SEQ ID NO: 1382; 1383 and 1384;
probe set #410 consisting of the nucleic acids consisting of SEQ ID NO: 1943; 1948 and 1978;
probe set #411 consisting of the nucleic acids consisting of SEQ ID NO: 2927;
probe set #412 consisting of the nucleic acids consisting of SEQ ID NO: 1920 and 1921;
probe set #413 consisting of the nucleic acids consisting of SEQ ID NO: 2061; 2063 and 2068;
probe set #414 consisting of the nucleic acids consisting of SEQ ID NO: 1686; 1693 and 1694;
probe set #415 consisting of the nucleic acids consisting of SEQ ID NO: 1217; 1236 and 1237;
probe set #416 consisting of the nucleic acids consisting of SEQ ID NO: 755; 756 and 757;
probe set #417 consisting of the nucleic acids consisting of SEQ ID NO: 2372; 2373 and 2374;
probe set #418 consisting of the nucleic acids consisting of SEQ ID NO: 1595; 1596 and 1597;
probe set #419 consisting of the nucleic acids consisting of SEQ ID NO: 1193; 1208 and 1209;
probe set #420 consisting of the nucleic acids consisting of SEQ ID NO: 2049; 2050 and 2051;
probe set #421 consisting of the nucleic acids consisting of SEQ ID NO: 1193; 1194 and 1207;
probe set #422 consisting of the nucleic acids consisting of SEQ ID NO: 265; 266 and 267;
probe set #423 consisting of the nucleic acids consisting of SEQ ID NO: 1580; 1581 and 1582;
probe set #424 consisting of the nucleic acids consisting of SEQ ID NO: 146; 147 and 150;
probe set #425 consisting of the nucleic acids consisting of SEQ ID NO: 1662; 1663 and 1664;
probe set #426 consisting of the nucleic acids consisting of SEQ ID NO: 1242; 1249 and 1268;
probe set #427 consisting of the nucleic acids consisting of SEQ ID NO: 2791; 2792 and 2793;
probe set #428 consisting of the nucleic acids consisting of SEQ ID NO: 124;
probe set #429 consisting of the nucleic acids consisting of SEQ ID NO: 2061; 2062 and 2103;
probe set #430 consisting of the nucleic acids consisting of SEQ ID NO: 1649; 1650 and 1651;
probe set #431 consisting of the nucleic acids consisting of SEQ ID NO: 703; 711 and 736;
probe set #432 consisting of the nucleic acids consisting of SEQ ID NO: 1927; 1932 and 1987;
probe set #433 consisting of the nucleic acids consisting of SEQ ID NO: 2086 and 2087;
probe set #434 consisting of the nucleic acids consisting of SEQ ID NO: 975; 976 and 977;
probe set #435 consisting of the nucleic acids consisting of SEQ ID NO: 840; 841 and 845;
probe set #436 consisting of the nucleic acids consisting of SEQ ID NO: 197; 868 and 1132;
probe set #437 consisting of the nucleic acids consisting of SEQ ID NO: 2060; 2065 and 2072;
probe set #438 consisting of the nucleic acids consisting of SEQ ID NO: 842; 843 and 844;
probe set #439 consisting of the nucleic acids consisting of SEQ ID NO: 1306;
probe set #440 consisting of the nucleic acids consisting of SEQ ID NO: 2214 and 2215;
probe set #441 consisting of the nucleic acids consisting of SEQ ID NO: 1284; 1290 and 1489;
probe set #442 consisting of the nucleic acids consisting of SEQ ID NO: 298; 300 and 299;
probe set #443 consisting of the nucleic acids consisting of SEQ ID NO: 2106;
probe set #444 consisting of the nucleic acids consisting of SEQ ID NO: 986;
probe set #445 consisting of the nucleic acids consisting of SEQ ID NO: 2049; 2050 and 2051;
probe set #446 consisting of the nucleic acids consisting of SEQ ID NO: 2206; 2207 and 2208;
probe set #447 consisting of the nucleic acids consisting of SEQ ID NO: 2527; 2528 and 2529;
probe set #448 consisting of the nucleic acids consisting of SEQ ID NO: 1259;
probe set #449 consisting of the nucleic acids consisting of SEQ ID NO: 2677; 2678 and 2708;
probe set #450 consisting of the nucleic acids consisting of SEQ ID NO: 1217; 1236 and 1237;
probe set #451 consisting of the nucleic acids consisting of SEQ ID NO: 2060; 2072 and 2102;
probe set #452 consisting of the nucleic acids consisting of SEQ ID NO: 2369; 2370 and 2371;
probe set #453 consisting of the nucleic acids consisting of SEQ ID NO: 696; 697 and 698;

probe set #454 consisting of the nucleic acids consisting of SEQ ID NO: 1255;
probe set #455 consisting of the nucleic acids consisting of SEQ ID NO: 265; 266 and 267;
probe set #456 consisting of the nucleic acids consisting of SEQ ID NO: 2192; 2193 and 2200;
probe set #457 consisting of the nucleic acids consisting of SEQ ID NO: 2069; 2070 and 2071;
probe set #458 consisting of the nucleic acids consisting of SEQ ID NO: 2063; 2068 and 2103;
probe set #459 consisting of the nucleic acids consisting of SEQ ID NO: 304;
probe set #460 consisting of the nucleic acids consisting of SEQ ID NO: 372 and 373;
probe set #461 consisting of the nucleic acids consisting of SEQ ID NO: 2075; 2076 and 2109;
probe set #462 consisting of the nucleic acids consisting of SEQ ID NO: 2366; 2367 and 2368;
probe set #463 consisting of the nucleic acids consisting of SEQ ID NO: 1948; 1979 and 1980;
probe set #464 consisting of the nucleic acids consisting of SEQ ID NO: 216; 217 and 218;
probe set #465 consisting of the nucleic acids consisting of SEQ ID NO: 2061; 2062 and 2063;
probe set #466 consisting of the nucleic acids consisting of SEQ ID NO: 1100; 1101 and 1102;
probe set #467 consisting of the nucleic acids consisting of SEQ ID NO: 1303; 1304 and 1305;
probe set #468 consisting of the nucleic acids consisting of SEQ ID NO: 985;
probe set #469 consisting of the nucleic acids consisting of SEQ ID NO: 2188; 2189 and 2190;
probe set #470 consisting of the nucleic acids consisting of SEQ ID NO: 2069; 2070 and 2071;
probe set #471 consisting of the nucleic acids consisting of SEQ ID NO: 1982; 1983 and 1984;
probe set #472 consisting of the nucleic acids consisting of SEQ ID NO: 1887; 1888 and 1889;
probe set #473 consisting of the nucleic acids consisting of SEQ ID NO: 1995; 1996 and 1997;
probe set #474 consisting of the nucleic acids consisting of SEQ ID NO: 2931;
probe set #475 consisting of the nucleic acids consisting of SEQ ID NO: 865; 866 and 867;
probe set #476 consisting of the nucleic acids consisting of SEQ ID NO: 268; 269 and 270;
probe set #477 consisting of the nucleic acids consisting of SEQ ID NO: 2286; 2287 and 2288;
probe set #478 consisting of the nucleic acids consisting of SEQ ID NO: 1117; 1118 and 1124;
probe set #479 consisting of the nucleic acids consisting of SEQ ID NO: 2059; 2100 and 2101;
probe set #480 consisting of the nucleic acids consisting of SEQ ID NO: 388; 389 and 390;
probe set #481 consisting of the nucleic acids consisting of SEQ ID NO: 2286; 2287 and 2288;
probe set #482 consisting of the nucleic acids consisting of SEQ ID NO: 2055;
probe set #483 consisting of the nucleic acids consisting of SEQ ID NO: 2573; 2574 and 2575;
probe set #484 consisting of the nucleic acids consisting of SEQ ID NO: 2075 and 2076;
probe set #485 consisting of the nucleic acids consisting of SEQ ID NO: 2689; 2690 and 2691;
probe set #486 consisting of the nucleic acids consisting of SEQ ID NO: 2072; 2089 and 2102;
probe set #487 consisting of the nucleic acids consisting of SEQ ID NO: 1388; 1389 and 1390;
probe set #488 consisting of the nucleic acids consisting of SEQ ID NO: 2889; 2890 and 2891;
probe set #489 consisting of the nucleic acids consisting of SEQ ID NO: 1565; 1599 and 1601;
probe set #490 consisting of the nucleic acids consisting of SEQ ID NO: 2157; 2158 and 2159;
probe set #491 consisting of the nucleic acids consisting of SEQ ID NO: 1931; 1932 and 1987;
probe set #492 consisting of the nucleic acids consisting of SEQ ID NO: 2061; 2063 and 2068;
probe set #493 consisting of the nucleic acids consisting of SEQ ID NO: 1574; 1575 and 1576;
probe set #494 consisting of the nucleic acids consisting of SEQ ID NO: 743; 744 and 745;
probe set #495 consisting of the nucleic acids consisting of SEQ ID NO: 1931; 1932 and 1962;
probe set #496 consisting of the nucleic acids consisting of SEQ ID NO: 1927; 1947 and 1987;
probe set #497 consisting of the nucleic acids consisting of SEQ ID NO: 2286; 2287 and 2288;
probe set #498 consisting of the nucleic acids consisting of SEQ ID NO: 2286; 2287 and 2288;
probe set #499 consisting of the nucleic acids consisting of SEQ ID NO: 1676; 1677 and 1678;
probe set #500 consisting of the nucleic acids consisting of SEQ ID NO: 1041; 1042 and 1043;
probe set #501 consisting of the nucleic acids consisting of SEQ ID NO: 2375; 2376 and 2377;
probe set #502 consisting of the nucleic acids consisting of SEQ ID NO: 1920 and 1921;
probe set #503 consisting of the nucleic acids consisting of SEQ ID NO: 2061; 2093 and 2107;
probe set #504 consisting of the nucleic acids consisting of SEQ ID NO: 1931; 1932 and 1962;
probe set #505 consisting of the nucleic acids consisting of SEQ ID NO: 2908; 2917 and 2918;
probe set #506 consisting of the nucleic acids consisting of SEQ ID NO: 1920; 1921 and 1922;
probe set #507 consisting of the nucleic acids consisting of SEQ ID NO: 1922;
probe set #508 consisting of the nucleic acids consisting of SEQ ID NO: 2489; 2490 and 2491;
probe set #509 consisting of the nucleic acids consisting of SEQ ID NO: 2909; 2910 and 2917;
probe set #510 consisting of the nucleic acids consisting of SEQ ID NO: 725; 726 and 727;
probe set #511 consisting of the nucleic acids consisting of SEQ ID NO: 2304; 2305 and 2308;
probe set #512 consisting of the nucleic acids consisting of SEQ ID NO: 829; 830 and 831;
probe set #513 consisting of the nucleic acids consisting of SEQ ID NO: 2414; 2415 and 2416;
probe set #514 consisting of the nucleic acids consisting of SEQ ID NO: 2003; 2005 and 2006;
probe set #515 consisting of the nucleic acids consisting of SEQ ID NO: 731; 732 and 736;
probe set #516 consisting of the nucleic acids consisting of SEQ ID NO: 1926 and 1962;
probe set #517 consisting of the nucleic acids consisting of SEQ ID NO: 2662; 2663 and 2664;
probe set #518 consisting of the nucleic acids consisting of SEQ ID NO: 1142; 1143 and 1144;
probe set #519 consisting of the nucleic acids consisting of SEQ ID NO: 1296; 1297 and 1298;

probe set #520 consisting of the nucleic acids consisting of SEQ ID NO: 1943; 1948 and 1978;
probe set #521 consisting of the nucleic acids consisting of SEQ ID NO: 2899; 2900 and 2901;
probe set #522 consisting of the nucleic acids consisting of SEQ ID NO: 2060; 2065 and 2072;
probe set #523 consisting of the nucleic acids consisting of SEQ ID NO: 982;
probe set #524 consisting of the nucleic acids consisting of SEQ ID NO: 1920; 1933 and 1999;
probe set #525 consisting of the nucleic acids consisting of SEQ ID NO: 1655;
probe set #526 consisting of the nucleic acids consisting of SEQ ID NO: 1008; 1009 and 1010;
probe set #527 consisting of the nucleic acids consisting of SEQ ID NO: 2060; 2072 and 2097;
probe set #528 consisting of the nucleic acids consisting of SEQ ID NO: 37; 38 and 39;
probe set #529 consisting of the nucleic acids consisting of SEQ ID NO: 2852; 2853 and 2854;
probe set #530 consisting of the nucleic acids consisting of SEQ ID NO: 1721; 1722 and 1723;
probe set #531 consisting of the nucleic acids consisting of SEQ ID NO: 2902; 2903 and 2904;
probe set #532 consisting of the nucleic acids consisting of SEQ ID NO: 1920 and 1921;
probe set #533 consisting of the nucleic acids consisting of SEQ ID NO: 761; 762 and 765;
probe set #534 consisting of the nucleic acids consisting of SEQ ID NO: 2086 and 2087;
probe set #535 consisting of the nucleic acids consisting of SEQ ID NO: 435; 436 and 437;
probe set #536 consisting of the nucleic acids consisting of SEQ ID NO: 1397; 1398 and 1399;
probe set #537 consisting of the nucleic acids consisting of SEQ ID NO: 2808; 2809 and 2810;
probe set #538 consisting of the nucleic acids consisting of SEQ ID NO: 1032; 1033 and 1034;
probe set #539 consisting of the nucleic acids consisting of SEQ ID NO: 1129; 1140 and 1141;
probe set #540 consisting of the nucleic acids consisting of SEQ ID NO: 2517; 2518 and 2519;
probe set #541 consisting of the nucleic acids consisting of SEQ ID NO: 1931; 1932 and 1962;
probe set #542 consisting of the nucleic acids consisting of SEQ ID NO: 1029; 1030 and 1031;
probe set #543 consisting of the nucleic acids consisting of SEQ ID NO: 2296; 2297 and 2298;
probe set #544 consisting of the nucleic acids consisting of SEQ ID NO: 1869; 1870 and 1871;
probe set #545 consisting of the nucleic acids consisting of SEQ ID NO: 985;
probe set #546 consisting of the nucleic acids consisting of SEQ ID NO: 1464; 1465 and 1466;
probe set #547 consisting of the nucleic acids consisting of SEQ ID NO: 1418; 1419 and 1420;
probe set #548 consisting of the nucleic acids consisting of SEQ ID NO: 1916; 1917 and 1918;
probe set #549 consisting of the nucleic acids consisting of SEQ ID NO: 1406; 1407 and 1413;
probe set #550 consisting of the nucleic acids consisting of SEQ ID NO: 35 and 36;
probe set #551 consisting of the nucleic acids consisting of SEQ ID NO: 2254; 2255 and 2256;
probe set #552 consisting of the nucleic acids consisting of SEQ ID NO: 1920 and 1921;
probe set #553 consisting of the nucleic acids consisting of SEQ ID NO: 1737; 1738 and 1739;
probe set #554 consisting of the nucleic acids consisting of SEQ ID NO: 573; 643 and 644;
probe set #555 consisting of the nucleic acids consisting of SEQ ID NO: 2304; 2305 and 2307;
probe set #556 consisting of the nucleic acids consisting of SEQ ID NO: 2530; 2531 and 2532;
probe set #557 consisting of the nucleic acids consisting of SEQ ID NO: 2628; 2629 and 2630;
probe set #558 consisting of the nucleic acids consisting of SEQ ID NO: 1223; 1224 and 1225;
probe set #559 consisting of the nucleic acids consisting of SEQ ID NO: 1210; 1211 and 1212;
probe set #560 consisting of the nucleic acids consisting of SEQ ID NO: 1839; 1840 and 1841;
probe set #561 consisting of the nucleic acids consisting of SEQ ID NO: 2561; 2562 and 2563;
probe set #562 consisting of the nucleic acids consisting of SEQ ID NO: 1920; 1933 and 1999;
probe set #563 consisting of the nucleic acids consisting of SEQ ID NO: 446; 453 and 454;
probe set #564 consisting of the nucleic acids consisting of SEQ ID NO: 321; 323 and 322;
probe set #565 consisting of the nucleic acids consisting of SEQ ID NO: 2423; 2424 and 2425;
probe set #566 consisting of the nucleic acids consisting of SEQ ID NO: 2216 and 2217;
probe set #567 consisting of the nucleic acids consisting of SEQ ID NO: 2658; 2670 and 2708;
probe set #568 consisting of the nucleic acids consisting of SEQ ID NO: 1366; 1367 and 1368;
probe set #569 consisting of the nucleic acids consisting of SEQ ID NO: 1920 and 1921;
probe set #570 consisting of the nucleic acids consisting of SEQ ID NO: 1926; 1961 and 1962;
probe set #571 consisting of the nucleic acids consisting of SEQ ID NO: 1050; 1051 and 1052;
probe set #572 consisting of the nucleic acids consisting of SEQ ID NO: 1931; 1932 and 1962;
probe set #573 consisting of the nucleic acids consisting of SEQ ID NO: 2100; 2101 and 2105;
probe set #574 consisting of the nucleic acids consisting of SEQ ID NO: 1151; 1152 and 1153;
probe set #575 consisting of the nucleic acids consisting of SEQ ID NO: 2717; 2718 and 2719;
probe set #576 consisting of the nucleic acids consisting of SEQ ID NO: 1382; 1383 and 1384;
probe set #577 consisting of the nucleic acids consisting of SEQ ID NO: 2061;
probe set #578 consisting of the nucleic acids consisting of SEQ ID NO: 1211; 1212 and 1226;
probe set #579 consisting of the nucleic acids consisting of SEQ ID NO: 1227 and 1228;
probe set #580 consisting of the nucleic acids consisting of SEQ ID NO: 1665; 1666 and 1667;
probe set #581 consisting of the nucleic acids consisting of SEQ ID NO: 2659; 2660 and 2709;
probe set #582 consisting of the nucleic acids consisting of SEQ ID NO: 2580; 2581 and 2582;
probe set #583 consisting of the nucleic acids consisting of SEQ ID NO: 2662; 2663 and 2664;
probe set #584 consisting of the nucleic acids consisting of SEQ ID NO: 1017; 1018 and 1019;
probe set #585 consisting of the nucleic acids consisting of SEQ ID NO: 573; 642 and 644;

probe set #586 consisting of the nucleic acids consisting of SEQ ID NO: 80; 81 and 82;
probe set #587 consisting of the nucleic acids consisting of SEQ ID NO: 222; 223 and 224;
probe set #588 consisting of the nucleic acids consisting of SEQ ID NO: 1948;
probe set #589 consisting of the nucleic acids consisting of SEQ ID NO: 749; 750 and 751;
probe set #590 consisting of the nucleic acids consisting of SEQ ID NO: 1565; 1598 and 1599;
probe set #591 consisting of the nucleic acids consisting of SEQ ID NO: 2911; 2912 and 2913;
probe set #592 consisting of the nucleic acids consisting of SEQ ID NO: 2668; 2669 and 2709;
probe set #593 consisting of the nucleic acids consisting of SEQ ID NO: 2670; 2676 and 2759;
probe set #594 consisting of the nucleic acids consisting of SEQ ID NO: 1934;
probe set #595 consisting of the nucleic acids consisting of SEQ ID NO: 1932; 1935 and 1978;
probe set #596 consisting of the nucleic acids consisting of SEQ ID NO: 840; 841 and 845;
probe set #597 consisting of the nucleic acids consisting of SEQ ID NO: 1749; 1750 and 1751;
probe set #598 consisting of the nucleic acids consisting of SEQ ID NO: 2049; 2050 and 2051;
probe set #599 consisting of the nucleic acids consisting of SEQ ID NO: 752; 753 and 754;
probe set #600 consisting of the nucleic acids consisting of SEQ ID NO: 541; 542 and 543;
probe set #601 consisting of the nucleic acids consisting of SEQ ID NO: 1106; 1107 and 1108;
probe set #602 consisting of the nucleic acids consisting of SEQ ID NO: 2072; 2089 and 2102;
probe set #603 consisting of the nucleic acids consisting of SEQ ID NO: 1965; 1966 and 1967;
probe set #604 consisting of the nucleic acids consisting of SEQ ID NO: 2417; 2418 and 2419;
probe set #605 consisting of the nucleic acids consisting of SEQ ID NO: 519; 520 and 521;
probe set #606 consisting of the nucleic acids consisting of SEQ ID NO: 971;
probe set #607 consisting of the nucleic acids consisting of SEQ ID NO: 884 and 888;
probe set #608 consisting of the nucleic acids consisting of SEQ ID NO: 40; 41 and 42;
probe set #609 consisting of the nucleic acids consisting of SEQ ID NO: 24; 25 and 26;
probe set #610 consisting of the nucleic acids consisting of SEQ ID NO: 1182; 1183 and 1184;
probe set #611 consisting of the nucleic acids consisting of SEQ ID NO: 2658; 2676 and 2759;
probe set #612 consisting of the nucleic acids consisting of SEQ ID NO: 2765; 2766 and 2767;
probe set #613 consisting of the nucleic acids consisting of SEQ ID NO: 410; 411 and 412;
probe set #614 consisting of the nucleic acids consisting of SEQ ID NO: 975; 976 and 977;
probe set #615 consisting of the nucleic acids consisting of SEQ ID NO: 1782; 1783 and 1784;
probe set #616 consisting of the nucleic acids consisting of SEQ ID NO: 1926 and 1962;
probe set #617 consisting of the nucleic acids consisting of SEQ ID NO: 975; 976 and 977;
probe set #618 consisting of the nucleic acids consisting of SEQ ID NO: 2072; 2089 and 2092;
probe set #619 consisting of the nucleic acids consisting of SEQ ID NO: 429; 430 and 438;
probe set #620 consisting of the nucleic acids consisting of SEQ ID NO: 1072; 1073 and 1074;
probe set #621 consisting of the nucleic acids consisting of SEQ ID NO: 309; 311 and 310;
probe set #622 consisting of the nucleic acids consisting of SEQ ID NO: 2321; 2322 and 2323;
probe set #623 consisting of the nucleic acids consisting of SEQ ID NO: 1540;
probe set #624 consisting of the nucleic acids consisting of SEQ ID NO: 2072; 2089 and 2102;
probe set #625 consisting of the nucleic acids consisting of SEQ ID NO: 733; 734 and 735;
probe set #626 consisting of the nucleic acids consisting of SEQ ID NO: 99; 100 and 101;
probe set #627 consisting of the nucleic acids consisting of SEQ ID NO: 1394;
probe set #628 consisting of the nucleic acids consisting of SEQ ID NO: 2780; 2781 and 2782;
probe set #629 consisting of the nucleic acids consisting of SEQ ID NO: 1372; 1373 and 1374;
probe set #630 consisting of the nucleic acids consisting of SEQ ID NO: 2679; 2680 and 2681;
probe set #631 consisting of the nucleic acids consisting of SEQ ID NO: 2670; 2708 and 2754;
probe set #632 consisting of the nucleic acids consisting of SEQ ID NO: 1965; 1966 and 1967;
probe set #633 consisting of the nucleic acids consisting of SEQ ID NO: 2795;
probe set #634 consisting of the nucleic acids consisting of SEQ ID NO: 2002;
probe set #635 consisting of the nucleic acids consisting of SEQ ID NO: 68; 69 and 70;
probe set #636 consisting of the nucleic acids consisting of SEQ ID NO: 1020; 1021 and 1022;
probe set #637 consisting of the nucleic acids consisting of SEQ ID NO: 148; 149 and 150;
probe set #638 consisting of the nucleic acids consisting of SEQ ID NO: 1307; 1308 and 1309;
probe set #639 consisting of the nucleic acids consisting of SEQ ID NO: 1944; 1945 and 1946;
probe set #640 consisting of the nucleic acids consisting of SEQ ID NO: 446; 454 and 455;
probe set #641 consisting of the nucleic acids consisting of SEQ ID NO: 1767; 1768 and 1769;
probe set #642 consisting of the nucleic acids consisting of SEQ ID NO: 1971; 1972 and 1987;
probe set #643 consisting of the nucleic acids consisting of SEQ ID NO: 2795;
probe set #644 consisting of the nucleic acids consisting of SEQ ID NO: 899; 900 and 901;
probe set #645 consisting of the nucleic acids consisting of SEQ ID NO: 1962; 1998 and 1999;
probe set #646 consisting of the nucleic acids consisting of SEQ ID NO: 2041; 2042 and 2043;
probe set #647 consisting of the nucleic acids consisting of SEQ ID NO: 1927; 1955 and 1978;
probe set #648 consisting of the nucleic acids consisting of SEQ ID NO: 1990;
probe set #649 consisting of the nucleic acids consisting of SEQ ID NO: 1403; 1404 and 1408;
probe set #650 consisting of the nucleic acids consisting of SEQ ID NO: 1968; 1969 and 1970;
probe set #651 consisting of the nucleic acids consisting of SEQ ID NO: 2209; 2210 and 2211;

probe set #652 consisting of the nucleic acids consisting of SEQ ID NO: 1770; 1771 and 1772;
probe set #653 consisting of the nucleic acids consisting of SEQ ID NO: 1382; 1383 and 1384;
probe set #654 consisting of the nucleic acids consisting of SEQ ID NO: 1927; 1932 and 1987;
probe set #655 consisting of the nucleic acids consisting of SEQ ID NO: 2248;
probe set #656 consisting of the nucleic acids consisting of SEQ ID NO: 2501; 2502 and 2503;
probe set #657 consisting of the nucleic acids consisting of SEQ ID NO: 1133; 1134 and 1135;
probe set #658 consisting of the nucleic acids consisting of SEQ ID NO: 1668; 1669 and 1670;
probe set #659 consisting of the nucleic acids consisting of SEQ ID NO: 2925; 2926 and 2927;
probe set #660 consisting of the nucleic acids consisting of SEQ ID NO: 201; 202 and 203;
probe set #661 consisting of the nucleic acids consisting of SEQ ID NO: 1602; 1603 and 1604;
probe set #662 consisting of the nucleic acids consisting of SEQ ID NO: 1936; 1937 and 1938;
probe set #663 consisting of the nucleic acids consisting of SEQ ID NO: 2504; 2512 and 2543;
probe set #664 consisting of the nucleic acids consisting of SEQ ID NO: 1119; 1120 and 1121;
probe set #665 consisting of the nucleic acids consisting of SEQ ID NO: 1400; 1401 and 1402;
probe set #666 consisting of the nucleic acids consisting of SEQ ID NO: 2700; 2701 and 2702;
probe set #667 consisting of the nucleic acids consisting of SEQ ID NO: 2811; 2812 and 2813;
probe set #668 consisting of the nucleic acids consisting of SEQ ID NO: 1955 and 1964;
probe set #669 consisting of the nucleic acids consisting of SEQ ID NO: 672; 673 and 674;
probe set #670 consisting of the nucleic acids consisting of SEQ ID NO: 582; 583 and 584;
probe set #671 consisting of the nucleic acids consisting of SEQ ID NO: 1920; 1933 and 1999;
probe set #672 consisting of the nucleic acids consisting of SEQ ID NO: 2755; 2756 and 2757;
probe set #673 consisting of the nucleic acids consisting of SEQ ID NO: 2659 and 2746;
probe set #674 consisting of the nucleic acids consisting of SEQ ID NO: 2035; 2036 and 2037;
probe set #675 consisting of the nucleic acids consisting of SEQ ID NO: 2662; 2663 and 2664;
probe set #676 consisting of the nucleic acids consisting of SEQ ID NO: 2771; 2772 and 2773;
probe set #677 consisting of the nucleic acids consisting of SEQ ID NO: 2317; 2318 and 2319;
probe set #678 consisting of the nucleic acids consisting of SEQ ID NO: 456; 457 and 458;
probe set #679 consisting of the nucleic acids consisting of SEQ ID NO: 2539; 2540 and 2541;
probe set #680 consisting of the nucleic acids consisting of SEQ ID NO: 2582; 2583 and 2584;
probe set #681 consisting of the nucleic acids consisting of SEQ ID NO: 868; 1117 and 1118;
probe set #682 consisting of the nucleic acids consisting of SEQ ID NO: 2801;
probe set #683 consisting of the nucleic acids consisting of SEQ ID NO: 2659; 2707 and 2709;
probe set #684 consisting of the nucleic acids consisting of SEQ ID NO: 2659; 2660 and 2709;
probe set #685 consisting of the nucleic acids consisting of SEQ ID NO: 1920; 1933 and 1999;
probe set #686 consisting of the nucleic acids consisting of SEQ ID NO: 1791; 1792 and 1793;
probe set #687 consisting of the nucleic acids consisting of SEQ ID NO: 633; 634 and 635;
probe set #688 consisting of the nucleic acids consisting of SEQ ID NO: 1351; 1352 and 1353;
probe set #689 consisting of the nucleic acids consisting of SEQ ID NO: 934; 935 and 941;
probe set #690 consisting of the nucleic acids consisting of SEQ ID NO: 938; 939 and 940;
probe set #691 consisting of the nucleic acids consisting of SEQ ID NO: 1009; 1023 and 1024;
probe set #692 consisting of the nucleic acids consisting of SEQ ID NO: 2314; 2315 and 2316;
probe set #693 consisting of the nucleic acids consisting of SEQ ID NO: 2704; 2705 and 2706;
probe set #694 consisting of the nucleic acids consisting of SEQ ID NO: 2341; 2342 and 2343;
probe set #695 consisting of the nucleic acids consisting of SEQ ID NO: 1797; 1798 and 1799;
probe set #696 consisting of the nucleic acids consisting of SEQ ID NO: 1767; 1768 and 1769;
probe set #697 consisting of the nucleic acids consisting of SEQ ID NO: 1467 and 1468;
probe set #698 consisting of the nucleic acids consisting of SEQ ID NO: 1770; 1771 and 1772;
probe set #699 consisting of the nucleic acids consisting of SEQ ID NO: 2035; 2036 and 2037;
probe set #700 consisting of the nucleic acids consisting of SEQ ID NO: 37; 38 and 39;
probe set #701 consisting of the nucleic acids consisting of SEQ ID NO: 678; 679 and 680;
probe set #702 consisting of the nucleic acids consisting of SEQ ID NO: 1920; 1933 and 1999;
probe set #703 consisting of the nucleic acids consisting of SEQ ID NO: 2242; 2252 and 2271;
probe set #704 consisting of the nucleic acids consisting of SEQ ID NO: 2417; 2418 and 2419;
probe set #705 consisting of the nucleic acids consisting of SEQ ID NO: 2356; 2357 and 2358;
probe set #706 consisting of the nucleic acids consisting of SEQ ID NO: 1541; 1542 and 1543;
probe set #707 consisting of the nucleic acids consisting of SEQ ID NO: 2245; 2246 and 2247;
probe set #708 consisting of the nucleic acids consisting of SEQ ID NO: 2194; 2198 and 2199;
probe set #709 consisting of the nucleic acids consisting of SEQ ID NO: 2498; 2499 and 2500;
probe set #710 consisting of the nucleic acids consisting of SEQ ID NO: 287; 289 and 288;
probe set #711 consisting of the nucleic acids consisting of SEQ ID NO: 2671; 2672 and 2708;
probe set #712 consisting of the nucleic acids consisting of SEQ ID NO: 2130; 2131 and 2132;
probe set #713 consisting of the nucleic acids consisting of SEQ ID NO: 448; 449 and 450;
probe set #714 consisting of the nucleic acids consisting of SEQ ID NO: 413; 414 and 415;
probe set #715 consisting of the nucleic acids consisting of SEQ ID NO: 2148; 2150 and 2151;
probe set #716 consisting of the nucleic acids consisting of SEQ ID NO: 2875; 2876 and 2877;
probe set #717 consisting of the nucleic acids consisting of SEQ ID NO: 2060; 2072 and 2097;

probe set #718 consisting of the nucleic acids consisting of SEQ ID NO: 2060; 2072 and 2092;
probe set #719 consisting of the nucleic acids consisting of SEQ ID NO: 983; 984 and 985;
probe set #720 consisting of the nucleic acids consisting of SEQ ID NO: 1276; 1277 and 1285;
probe set #721 consisting of the nucleic acids consisting of SEQ ID NO: 985;
probe set #722 consisting of the nucleic acids consisting of SEQ ID NO: 2631; 2632 and 2633;
probe set #723 consisting of the nucleic acids consisting of SEQ ID NO: 207; 208 and 209;
probe set #724 consisting of the nucleic acids consisting of SEQ ID NO: 999; 1000 and 1001;
probe set #725 consisting of the nucleic acids consisting of SEQ ID NO: 521; 527 and 528;
probe set #726 consisting of the nucleic acids consisting of SEQ ID NO: 111; 112 and 113;
probe set #727 consisting of the nucleic acids consisting of SEQ ID NO: 1400; 1401 and 1402;
probe set #728 consisting of the nucleic acids consisting of SEQ ID NO: 1339; 1340 and 1341;
probe set #729 consisting of the nucleic acids consisting of SEQ ID NO: 912; 913 and 914;
probe set #730 consisting of the nucleic acids consisting of SEQ ID NO: 1574; 1575 and 1576;
probe set #731 consisting of the nucleic acids consisting of SEQ ID NO: 573; 614 and 642;
probe set #732 consisting of the nucleic acids consisting of SEQ ID NO: 1761; 1762 and 1763;
probe set #733 consisting of the nucleic acids consisting of SEQ ID NO: 2713; 2714 and 2715;
probe set #734 consisting of the nucleic acids consisting of SEQ ID NO: 589; 590 and 591;
probe set #735 consisting of the nucleic acids consisting of SEQ ID NO: 53; 54 and 55;
probe set #736 consisting of the nucleic acids consisting of SEQ ID NO: 2768; 2769 and 2770;
probe set #737 consisting of the nucleic acids consisting of SEQ ID NO: 264; 271 and 272;
probe set #738 consisting of the nucleic acids consisting of SEQ ID NO: 2321; 2322 and 2323;
probe set #739 consisting of the nucleic acids consisting of SEQ ID NO: 2683; 2684 and 2685;
probe set #740 consisting of the nucleic acids consisting of SEQ ID NO: 2160; 2161 and 2162;
probe set #741 consisting of the nucleic acids consisting of SEQ ID NO: 1097; 1098 and 1099;
probe set #742 consisting of the nucleic acids consisting of SEQ ID NO: 2063; 2065 and 2098;
probe set #743 consisting of the nucleic acids consisting of SEQ ID NO: 263; 264 and 271;
probe set #744 consisting of the nucleic acids consisting of SEQ ID NO: 1278; 1279 and 1280;
probe set #745 consisting of the nucleic acids consisting of SEQ ID NO: 2596; 2597 and 2598;
probe set #746 consisting of the nucleic acids consisting of SEQ ID NO: 1964; 1988 and 1989;
probe set #747 consisting of the nucleic acids consisting of SEQ ID NO: 2547;
probe set #748 consisting of the nucleic acids consisting of SEQ ID NO: 1605; 1606 and 1607;
probe set #749 consisting of the nucleic acids consisting of SEQ ID NO: 204; 205 and 206;
probe set #750 consisting of the nucleic acids consisting of SEQ ID NO: 2245; 2246 and 2247;
probe set #751 consisting of the nucleic acids consisting of SEQ ID NO: 2659; 2703 and 2709;
probe set #752 consisting of the nucleic acids consisting of SEQ ID NO: 1406; 1407 and 1413;
probe set #753 consisting of the nucleic acids consisting of SEQ ID NO: 1435;
probe set #754 consisting of the nucleic acids consisting of SEQ ID NO: 766; 767 and 768;
probe set #755 consisting of the nucleic acids consisting of SEQ ID NO: 1381;
probe set #756 consisting of the nucleic acids consisting of SEQ ID NO: 2222; 2223 and 2224;
probe set #757 consisting of the nucleic acids consisting of SEQ ID NO: 1238;
probe set #758 consisting of the nucleic acids consisting of SEQ ID NO: 1920; 1933 and 1999;
probe set #759 consisting of the nucleic acids consisting of SEQ ID NO: 1981;
probe set #760 consisting of the nucleic acids consisting of SEQ ID NO: 746; 747 and 748;
probe set #761 consisting of the nucleic acids consisting of SEQ ID NO: 2659; 2707 and 2709;
probe set #762 consisting of the nucleic acids consisting of SEQ ID NO: 1927; 1943 and 1978;
probe set #763 consisting of the nucleic acids consisting of SEQ ID NO: 2232; 2233 and 2234;
probe set #764 consisting of the nucleic acids consisting of SEQ ID NO: 2052; 2053 and 2054;
probe set #765 consisting of the nucleic acids consisting of SEQ ID NO: 1713; 1714 and 1715;
probe set #766 consisting of the nucleic acids consisting of SEQ ID NO: 602 and 603;
probe set #767 consisting of the nucleic acids consisting of SEQ ID NO: 702; 703 and 704;
probe set #768 consisting of the nucleic acids consisting of SEQ ID NO: 2438; 2439 and 2440;
probe set #769 consisting of the nucleic acids consisting of SEQ ID NO: 1943; 1955 and 1978;
probe set #770 consisting of the nucleic acids consisting of SEQ ID NO: 2378; 2379 and 2380;
probe set #771 consisting of the nucleic acids consisting of SEQ ID NO: 702; 703 and 704;
probe set #772 consisting of the nucleic acids consisting of SEQ ID NO: 2073; 2074 and 2109;
probe set #773 consisting of the nucleic acids consisting of SEQ ID NO: 2936; 2937 and 2938;
probe set #774 consisting of the nucleic acids consisting of SEQ ID NO: 2280; 2281 and 2282;
probe set #775 consisting of the nucleic acids consisting of SEQ ID NO: 2438; 2439 and 2440;
probe set #776 consisting of the nucleic acids consisting of SEQ ID NO: 1231; 1232 and 1233;
probe set #777 consisting of the nucleic acids consisting of SEQ ID NO: 1764; 1765 and 1766;
probe set #778 consisting of the nucleic acids consisting of SEQ ID NO: 391; 392 and 393;
probe set #779 consisting of the nucleic acids consisting of SEQ ID NO: 1931; 1962 and 1999;
probe set #780 consisting of the nucleic acids consisting of SEQ ID NO: 2282; 2289 and 2305;
probe set #781 consisting of the nucleic acids consisting of SEQ ID NO: 582; 583 and 584;
probe set #782 consisting of the nucleic acids consisting of SEQ ID NO: 1220; 1221 and 1222;
probe set #783 consisting of the nucleic acids consisting of SEQ ID NO: 1935;

probe set #784 consisting of the nucleic acids consisting of SEQ ID NO: 1718; 1719 and 1720;
probe set #785 consisting of the nucleic acids consisting of SEQ ID NO: 1737; 1738 and 1739;
probe set #786 consisting of the nucleic acids consisting of SEQ ID NO: 2908; 2909 and 2917;
probe set #787 consisting of the nucleic acids consisting of SEQ ID NO: 1957;
probe set #788 consisting of the nucleic acids consisting of SEQ ID NO: 2622; 2623 and 2624;
probe set #789 consisting of the nucleic acids consisting of SEQ ID NO: 2438; 2439 and 2440;
probe set #790 consisting of the nucleic acids consisting of SEQ ID NO: 2192; 2193 and 2200;
probe set #791 consisting of the nucleic acids consisting of SEQ ID NO: 1920; 1933 and 1999;
probe set #792 consisting of the nucleic acids consisting of SEQ ID NO: 1296; 1487 and 1488;
probe set #793 consisting of the nucleic acids consisting of SEQ ID NO: 947; 948 and 949;
probe set #794 consisting of the nucleic acids consisting of SEQ ID NO: 2617; 2618 and 2619;
probe set #795 consisting of the nucleic acids consisting of SEQ ID NO: 2362;
probe set #796 consisting of the nucleic acids consisting of SEQ ID NO: 1129; 1139 and 1140;
probe set #797 consisting of the nucleic acids consisting of SEQ ID NO: 2659; 2703 and 2709;
probe set #798 consisting of the nucleic acids consisting of SEQ ID NO: 419; 420 and 421;
probe set #799 consisting of the nucleic acids consisting of SEQ ID NO: 23; 29 and 30;
probe set #800 consisting of the nucleic acids consisting of SEQ ID NO: 1122;
probe set #801 consisting of the nucleic acids consisting of SEQ ID NO: 1423; 1447 and 1448;
probe set #802 consisting of the nucleic acids consisting of SEQ ID NO: 2710; 2711 and 2712;
probe set #803 consisting of the nucleic acids consisting of SEQ ID NO: 675; 676 and 677;
probe set #804 consisting of the nucleic acids consisting of SEQ ID NO: 2458; 2461 and 2462;
probe set #805 consisting of the nucleic acids consisting of SEQ ID NO: 1831; 1832 and 1833;
probe set #806 consisting of the nucleic acids consisting of SEQ ID NO: 618; 619 and 620;
probe set #807 consisting of the nucleic acids consisting of SEQ ID NO: 983; 984 and 985;
probe set #808 consisting of the nucleic acids consisting of SEQ ID NO: 2000 and 2001;
probe set #809 consisting of the nucleic acids consisting of SEQ ID NO: 2625; 2626 and 2627;
probe set #810 consisting of the nucleic acids consisting of SEQ ID NO: 714; 715 and 716;
probe set #811 consisting of the nucleic acids consisting of SEQ ID NO: 2659; 2660 and 2758;
probe set #812 consisting of the nucleic acids consisting of SEQ ID NO: 448; 449 and 450;
probe set #813 consisting of the nucleic acids consisting of SEQ ID NO: 1986;
probe set #814 consisting of the nucleic acids consisting of SEQ ID NO: 2699;
probe set #815 consisting of the nucleic acids consisting of SEQ ID NO: 2726; 2727 and 2728;
probe set #816 consisting of the nucleic acids consisting of SEQ ID NO: 2145; 2146 and 2147;
probe set #817 consisting of the nucleic acids consisting of SEQ ID NO: 2437; 2459 and 2460;
probe set #818 consisting of the nucleic acids consisting of SEQ ID NO: 2743; 2744 and 2745;
probe set #819 consisting of the nucleic acids consisting of SEQ ID NO: 2659; 2703 and 2709;
probe set #820 consisting of the nucleic acids consisting of SEQ ID NO: 592; 593 and 594;
probe set #821 consisting of the nucleic acids consisting of SEQ ID NO: 476; 477 and 478;
probe set #822 consisting of the nucleic acids consisting of SEQ ID NO: 1011; 1012 and 1013;
probe set #823 consisting of the nucleic acids consisting of SEQ ID NO: 1571; 1572 and 1573;
probe set #824 consisting of the nucleic acids consisting of SEQ ID NO: 1345; 1346 and 1347;
probe set #825 consisting of the nucleic acids consisting of SEQ ID NO: 2242; 2252 and 2259;
probe set #826 consisting of the nucleic acids consisting of SEQ ID NO: 661 and 662;
probe set #827 consisting of the nucleic acids consisting of SEQ ID NO: 1608; 1609 and 1610;
probe set #828 consisting of the nucleic acids consisting of SEQ ID NO: 2170; 2171 and 2172;
probe set #829 consisting of the nucleic acids consisting of SEQ ID NO: 2855; 2856 and 2859;
probe set #830 consisting of the nucleic acids consisting of SEQ ID NO: 1785; 1786 and 1787;
probe set #831 consisting of the nucleic acids consisting of SEQ ID NO: 1231; 1232 and 1233;
probe set #832 consisting of the nucleic acids consisting of SEQ ID NO: 2659; 2660 and 2709;
probe set #833 consisting of the nucleic acids consisting of SEQ ID NO: 766; 767 and 768;
probe set #834 consisting of the nucleic acids consisting of SEQ ID NO: 518; 522 and 523;
probe set #835 consisting of the nucleic acids consisting of SEQ ID NO: 2876; 2877 and 2878;
probe set #836 consisting of the nucleic acids consisting of SEQ ID NO: 1351; 1352 and 1353;
probe set #837 consisting of the nucleic acids consisting of SEQ ID NO: 630; 631 and 632;
probe set #838 consisting of the nucleic acids consisting of SEQ ID NO: 1577; 1578 and 1579;
probe set #839 consisting of the nucleic acids consisting of SEQ ID NO: 275; 276 and 277;
probe set #840 consisting of the nucleic acids consisting of SEQ ID NO: 2637; 2638 and 2639;
probe set #841 consisting of the nucleic acids consisting of SEQ ID NO: 1806; 1821 and 1822;
probe set #842 consisting of the nucleic acids consisting of SEQ ID NO: 233; 249 and 250;
probe set #843 consisting of the nucleic acids consisting of SEQ ID NO: 769; 770 and 771;
probe set #844 consisting of the nucleic acids consisting of SEQ ID NO: 996; 997 and 998;
probe set #845 consisting of the nucleic acids consisting of SEQ ID NO: 927; 928 and 929;
probe set #846 consisting of the nucleic acids consisting of SEQ ID NO: 399; 400 and 401;
probe set #847 consisting of the nucleic acids consisting of SEQ ID NO: 219; 220 and 221;
probe set #848 consisting of the nucleic acids consisting of SEQ ID NO: 2347; 2348 and 2349;
probe set #849 consisting of the nucleic acids consisting of SEQ ID NO: 71; 72 and 73;

probe set #850 consisting of the nucleic acids consisting of SEQ ID NO: 35 and 36;
probe set #851 consisting of the nucleic acids consisting of SEQ ID NO: 2704; 2705 and 2706;
probe set #852 consisting of the nucleic acids consisting of SEQ ID NO: 2263;
probe set #853 consisting of the nucleic acids consisting of SEQ ID NO: 2438; 2439 and 2440;
probe set #854 consisting of the nucleic acids consisting of SEQ ID NO: 13; 14 and 16;
probe set #855 consisting of the nucleic acids consisting of SEQ ID NO: 1779; 1780 and 1781;
probe set #856 consisting of the nucleic acids consisting of SEQ ID NO: 2309 and 2310;
probe set #857 consisting of the nucleic acids consisting of SEQ ID NO: 1884; 1885 and 1886;
probe set #858 consisting of the nucleic acids consisting of SEQ ID NO: 1964; 1988 and 1989;
probe set #859 consisting of the nucleic acids consisting of SEQ ID NO: 1354; 1355 and 1356;
probe set #860 consisting of the nucleic acids consisting of SEQ ID NO: 2660; 2672 and 2708;
probe set #861 consisting of the nucleic acids consisting of SEQ ID NO: 1281; 1282 and 1283;
probe set #862 consisting of the nucleic acids consisting of SEQ ID NO: 1332; 1333 and 1334;
probe set #863 consisting of the nucleic acids consisting of SEQ ID NO: 1090; 1091 and 1092;
probe set #864 consisting of the nucleic acids consisting of SEQ ID NO: 2099;
probe set #865 consisting of the nucleic acids consisting of SEQ ID NO: 2659; 2705 and 2761;
probe set #866 consisting of the nucleic acids consisting of SEQ ID NO: 2747; 2748 and 2753;
probe set #867 consisting of the nucleic acids consisting of SEQ ID NO: 1834 and 1835;
probe set #868 consisting of the nucleic acids consisting of SEQ ID NO: 2010; 2011 and 2012;
probe set #869 consisting of the nucleic acids consisting of SEQ ID NO: 2658; 2747 and 2753;
probe set #870 consisting of the nucleic acids consisting of SEQ ID NO: 442; 443 and 444;
probe set #871 consisting of the nucleic acids consisting of SEQ ID NO: 2274; 2275 and 2276;
probe set #872 consisting of the nucleic acids consisting of SEQ ID NO: 1926 and 1962;
probe set #873 consisting of the nucleic acids consisting of SEQ ID NO: 2833; 2834 and 2835;
probe set #874 consisting of the nucleic acids consisting of SEQ ID NO: 2686; 2687 and 2688;
probe set #875 consisting of the nucleic acids consisting of SEQ ID NO: 2300; 2301 and 2306;
probe set #876 consisting of the nucleic acids consisting of SEQ ID NO: 719; 720 and 721;
probe set #877 consisting of the nucleic acids consisting of SEQ ID NO: 13; 14 and 16;
probe set #878 consisting of the nucleic acids consisting of SEQ ID NO: 702; 705 and 709;
probe set #879 consisting of the nucleic acids consisting of SEQ ID NO: 1351; 1352 and 1353;
probe set #880 consisting of the nucleic acids consisting of SEQ ID NO: 889; 890 and 891;
probe set #881 consisting of the nucleic acids consisting of SEQ ID NO: 164; 165 and 166;
probe set #882 consisting of the nucleic acids consisting of SEQ ID NO: 908; 909 and 910;
probe set #883 consisting of the nucleic acids consisting of SEQ ID NO: 2720; 2721 and 2722;
probe set #884 consisting of the nucleic acids consisting of SEQ ID NO: 2486; 2487 and 2488;
probe set #885 consisting of the nucleic acids consisting of SEQ ID NO: 871 and 872;
probe set #886 consisting of the nucleic acids consisting of SEQ ID NO: 105; 106 and 107;
probe set #887 consisting of the nucleic acids consisting of SEQ ID NO: 2153; 2154 and 2155;
probe set #888 consisting of the nucleic acids consisting of SEQ ID NO: 651;
probe set #889 consisting of the nucleic acids consisting of SEQ ID NO: 1611; 1612 and 1613;
probe set #890 consisting of the nucleic acids consisting of SEQ ID NO: 2165; 2166 and 2167;
probe set #891 consisting of the nucleic acids consisting of SEQ ID NO: 875 and 880;
probe set #892 consisting of the nucleic acids consisting of SEQ ID NO: 2089;
probe set #893 consisting of the nucleic acids consisting of SEQ ID NO: 2299;
probe set #894 consisting of the nucleic acids consisting of SEQ ID NO: 1154; 1155 and 1156;
probe set #895 consisting of the nucleic acids consisting of SEQ ID NO: 2052; 2053 and 2054;
probe set #896 consisting of the nucleic acids consisting of SEQ ID NO: 2660; 2694 and 2695;
probe set #897 consisting of the nucleic acids consisting of SEQ ID NO: 2431 and 2432;
probe set #898 consisting of the nucleic acids consisting of SEQ ID NO: 761; 762 and 764;
probe set #899 consisting of the nucleic acids consisting of SEQ ID NO: 2072; 2077 and 2092;
probe set #900 consisting of the nucleic acids consisting of SEQ ID NO: 1767; 1768 and 1769;
probe set #901 consisting of the nucleic acids consisting of SEQ ID NO: 902;
probe set #902 consisting of the nucleic acids consisting of SEQ ID NO: 702; 705 and 709;
probe set #903 consisting of the nucleic acids consisting of SEQ ID NO: 933; 936 and 937;
probe set #904 consisting of the nucleic acids consisting of SEQ ID NO: 762; 765 and 773;
probe set #905 consisting of the nucleic acids consisting of SEQ ID NO: 2060; 2072 and 2097;
probe set #906 consisting of the nucleic acids consisting of SEQ ID NO: 2145; 2146 and 2147;
probe set #907 consisting of the nucleic acids consisting of SEQ ID NO: 687; 688 and 689;
probe set #908 consisting of the nucleic acids consisting of SEQ ID NO: 83; 84 and 85;
probe set #909 consisting of the nucleic acids consisting of SEQ ID NO: 2318; 2319 and 2320;
probe set #910 consisting of the nucleic acids consisting of SEQ ID NO: 2580; 2581 and 2582;
probe set #911 consisting of the nucleic acids consisting of SEQ ID NO: 2879; 2880 and 2882;
probe set #912 consisting of the nucleic acids consisting of SEQ ID NO: 2551; 2552 and 2553;
probe set #913 consisting of the nucleic acids consisting of SEQ ID NO: 2734; 2735 and 2736;
probe set #914 consisting of the nucleic acids consisting of SEQ ID NO: 2268; 2269 and 2270;
probe set #915 consisting of the nucleic acids consisting of SEQ ID NO: 934; 935 and 941;

probe set #916 consisting of the nucleic acids consisting of SEQ ID NO: 2838;
probe set #917 consisting of the nucleic acids consisting of SEQ ID NO: 1412 and 1414;
probe set #918 consisting of the nucleic acids consisting of SEQ ID NO: 1273; 1274 and 1275;
probe set #919 consisting of the nucleic acids consisting of SEQ ID NO: 65; 66 and 67;
probe set #920 consisting of the nucleic acids consisting of SEQ ID NO: 2052; 2056 and 2057;
probe set #921 consisting of the nucleic acids consisting of SEQ ID NO: 1727; 1728 and 1729;
probe set #922 consisting of the nucleic acids consisting of SEQ ID NO: 1357; 1358 and 1359;
probe set #923 consisting of the nucleic acids consisting of SEQ ID NO: 2737; 2738 and 2739;
probe set #924 consisting of the nucleic acids consisting of SEQ ID NO: 2879; 2880 and 2881;
probe set #925 consisting of the nucleic acids consisting of SEQ ID NO: 2932;
probe set #926 consisting of the nucleic acids consisting of SEQ ID NO: 93; 94 and 95;
probe set #927 consisting of the nucleic acids consisting of SEQ ID NO: 2133;
probe set #928 consisting of the nucleic acids consisting of SEQ ID NO: 574; 587 and 588;
probe set #929 consisting of the nucleic acids consisting of SEQ ID NO: 2397; 2398 and 2399;
probe set #930 consisting of the nucleic acids consisting of SEQ ID NO: 2914; 2915 and 2916;
probe set #931 consisting of the nucleic acids consisting of SEQ ID NO: 1496; 1498 and 1506;
probe set #932 consisting of the nucleic acids consisting of SEQ ID NO: 1731; 1732 and 1733;
probe set #933 consisting of the nucleic acids consisting of SEQ ID NO: 2292; 2293 and 2294;
probe set #934 consisting of the nucleic acids consisting of SEQ ID NO: 1461; 1462 and 1463;
probe set #935 consisting of the nucleic acids consisting of SEQ ID NO: 2646; 2647 and 2648;
probe set #936 consisting of the nucleic acids consisting of SEQ ID NO: 2788; 2789 and 2790;
probe set #937 consisting of the nucleic acids consisting of SEQ ID NO: 2428; 2429 and 2430;
probe set #938 consisting of the nucleic acids consisting of SEQ ID NO: 884; 885 and 886;
probe set #939 consisting of the nucleic acids consisting of SEQ ID NO: 416; 417 and 418;
probe set #940 consisting of the nucleic acids consisting of SEQ ID NO: 402; 403 and 404;
probe set #941 consisting of the nucleic acids consisting of SEQ ID NO: 56; 57 and 58;
probe set #942 consisting of the nucleic acids consisting of SEQ ID NO: 473; 474 and 475;
probe set #943 consisting of the nucleic acids consisting of SEQ ID NO: 663; 664 and 665;
probe set #944 consisting of the nucleic acids consisting of SEQ ID NO: 1876; 1877 and 1878;
probe set #945 consisting of the nucleic acids consisting of SEQ ID NO: 1716 and 1717;
probe set #946 consisting of the nucleic acids consisting of SEQ ID NO: 2233; 2234 and 2238;
probe set #947 consisting of the nucleic acids consisting of SEQ ID NO: 1813; 1814 and 1815;
probe set #948 consisting of the nucleic acids consisting of SEQ ID NO: 740; 741 and 742;
probe set #949 consisting of the nucleic acids consisting of SEQ ID NO: 1028;
probe set #950 consisting of the nucleic acids consisting of SEQ ID NO: 2889; 2890 and 2891;
probe set #951 consisting of the nucleic acids consisting of SEQ ID NO: 2780; 2781 and 2782;
probe set #952 consisting of the nucleic acids consisting of SEQ ID NO: 482; 483 and 484;
probe set #953 consisting of the nucleic acids consisting of SEQ ID NO: 1855; 1856 and 1857;
probe set #954 consisting of the nucleic acids consisting of SEQ ID NO: 884; 885 and 886;
probe set #955 consisting of the nucleic acids consisting of SEQ ID NO: 1407; 1412 and 1413;
probe set #956 consisting of the nucleic acids consisting of SEQ ID NO: 595;
probe set #957 consisting of the nucleic acids consisting of SEQ ID NO: 2585; 2586 and 2587;
probe set #958 consisting of the nucleic acids consisting of SEQ ID NO: 908; 909 and 910;
probe set #959 consisting of the nucleic acids consisting of SEQ ID NO: 659; 660 and 661;
probe set #960 consisting of the nucleic acids consisting of SEQ ID NO: 2218; 2219 and 2220;
probe set #961 consisting of the nucleic acids consisting of SEQ ID NO: 2670; 2672 and 2708;
probe set #962 consisting of the nucleic acids consisting of SEQ ID NO: 621; 622 and 623;
probe set #963 consisting of the nucleic acids consisting of SEQ ID NO: 213; 214 and 215;
probe set #964 consisting of the nucleic acids consisting of SEQ ID NO: 1851; 1853 and 1854;
probe set #965 consisting of the nucleic acids consisting of SEQ ID NO: 2420; 2421 and 2422;
probe set #966 consisting of the nucleic acids consisting of SEQ ID NO: 1909;
probe set #967 consisting of the nucleic acids consisting of SEQ ID NO: 485; 486 and 487;
probe set #968 consisting of the nucleic acids consisting of SEQ ID NO: 2249; 2250 and 2251;
probe set #969 consisting of the nucleic acids consisting of SEQ ID NO: 1400; 1401 and 1402;
probe set #970 consisting of the nucleic acids consisting of SEQ ID NO: 2073; 2074 and 2109;
probe set #971 consisting of the nucleic acids consisting of SEQ ID NO: 518; 522 and 523;
probe set #972 consisting of the nucleic acids consisting of SEQ ID NO: 702; 703 and 704;
probe set #973 consisting of the nucleic acids consisting of SEQ ID NO: 1794; 1795 and 1796;
probe set #974 consisting of the nucleic acids consisting of SEQ ID NO: 2153; 2154 and 2155;
probe set #975 consisting of the nucleic acids consisting of SEQ ID NO: 1173;
probe set #976 consisting of the nucleic acids consisting of SEQ ID NO: 2277; 2278 and 2279;
probe set #977 consisting of the nucleic acids consisting of SEQ ID NO: 2659; 2660 and 2672;
probe set #978 consisting of the nucleic acids consisting of SEQ ID NO: 2438; 2439 and 2440;
probe set #979 consisting of the nucleic acids consisting of SEQ ID NO: 2704; 2705 and 2706;
probe set #980 consisting of the nucleic acids consisting of SEQ ID NO: 2544; 2545 and 2546;
probe set #981 consisting of the nucleic acids consisting of SEQ ID NO: 233; 249 and 250;

probe set #982 consisting of the nucleic acids consisting of SEQ ID NO: 2589; 2591 and 2592;
probe set #983 consisting of the nucleic acids consisting of SEQ ID NO: 684; 685 and 686;
probe set #984 consisting of the nucleic acids consisting of SEQ ID NO: 2124; 2125 and 2126;
probe set #985 consisting of the nucleic acids consisting of SEQ ID NO: 240; 241 and 242;
probe set #986 consisting of the nucleic acids consisting of SEQ ID NO: 1624; 1625 and 1626;
probe set #987 consisting of the nucleic acids consisting of SEQ ID NO: 2474; 2475 and 2476;
probe set #988 consisting of the nucleic acids consisting of SEQ ID NO: 1652; 1653 and 1654;
probe set #989 consisting of the nucleic acids consisting of SEQ ID NO: 1958; 1959 and 1960;
probe set #990 consisting of the nucleic acids consisting of SEQ ID NO: 902 and 911;
probe set #991 consisting of the nucleic acids consisting of SEQ ID NO: 2605; 2606 and 2610;
probe set #992 consisting of the nucleic acids consisting of SEQ ID NO: 2729; 2730 and 2731;
probe set #993 consisting of the nucleic acids consisting of SEQ ID NO: 1577; 1578 and 1579;
probe set #994 consisting of the nucleic acids consisting of SEQ ID NO: 2397; 2398 and 2399;
probe set #995 consisting of the nucleic acids consisting of SEQ ID NO: 1421; 1422 and 1423;
probe set #996 consisting of the nucleic acids consisting of SEQ ID NO: 2080; 2081 and 2082;
probe set #997 consisting of the nucleic acids consisting of SEQ ID NO: 941; 942 and 943;
probe set #998 consisting of the nucleic acids consisting of SEQ ID NO: 1407; 1412 and 1413;
probe set #999 consisting of the nucleic acids consisting of SEQ ID NO: 610; 611 and 612;
probe set #1000 consisting of the nucleic acids consisting of SEQ ID NO: 780; 781 and 782;
probe set #1001 consisting of the nucleic acids consisting of SEQ ID NO: 2849; 2850 and 2851;
probe set #1002 consisting of the nucleic acids consisting of SEQ ID NO: 2318; 2319 and 2324;
probe set #1003 consisting of the nucleic acids consisting of SEQ ID NO: 2065; 2068 and 2098;
probe set #1004 consisting of the nucleic acids consisting of SEQ ID NO: 1905; 1906 and 1907;
probe set #1005 consisting of the nucleic acids consisting of SEQ ID NO: 1617; 1618 and 1619;
probe set #1006 consisting of the nucleic acids consisting of SEQ ID NO: 2118 and 2119;
probe set #1007 consisting of the nucleic acids consisting of SEQ ID NO: 1391; 1392 and 1393;
probe set #1008 consisting of the nucleic acids consisting of SEQ ID NO: 2063; 2065 and 2098;
probe set #1009 consisting of the nucleic acids consisting of SEQ ID NO: 2673; 2674 and 2675;
probe set #1010 consisting of the nucleic acids consisting of SEQ ID NO: 2879; 2880 and 2881;
probe set #1011 consisting of the nucleic acids consisting of SEQ ID NO: 405; 406 and 407;
probe set #1012 consisting of the nucleic acids consisting of SEQ ID NO: 2153; 2154 and 2155;
probe set #1013 consisting of the nucleic acids consisting of SEQ ID NO: 1106; 1107 and 1108;
probe set #1014 consisting of the nucleic acids consisting of SEQ ID NO: 2466;
probe set #1015 consisting of the nucleic acids consisting of SEQ ID NO: 964;
probe set #1016 consisting of the nucleic acids consisting of SEQ ID NO: 2153; 2154 and 2156;
probe set #1017 consisting of the nucleic acids consisting of SEQ ID NO: 2000 and 2001;
probe set #1018 consisting of the nucleic acids consisting of SEQ ID NO: 83; 84 and 85;
probe set #1019 consisting of the nucleic acids consisting of SEQ ID NO: 2182; 2183 and 2184;
probe set #1020 consisting of the nucleic acids consisting of SEQ ID NO: 2127; 2128 and 2129;
probe set #1021 consisting of the nucleic acids consisting of SEQ ID NO: 646;
probe set #1022 consisting of the nucleic acids consisting of SEQ ID NO: 80; 81 and 82;
probe set #1023 consisting of the nucleic acids consisting of SEQ ID NO: 589; 590 and 591;
probe set #1024 consisting of the nucleic acids consisting of SEQ ID NO: 930 and 931;
probe set #1025 consisting of the nucleic acids consisting of SEQ ID NO: 2290; 2291 and 2310;
probe set #1026 consisting of the nucleic acids consisting of SEQ ID NO: 237; 238 and 239;
probe set #1027 consisting of the nucleic acids consisting of SEQ ID NO: 2438; 2439 and 2440;
probe set #1028 consisting of the nucleic acids consisting of SEQ ID NO: 2148; 2150 and 2151;
probe set #1029 consisting of the nucleic acids consisting of SEQ ID NO: 2514; 2515 and 2516;
probe set #1030 consisting of the nucleic acids consisting of SEQ ID NO: 2438; 2439 and 2440;
probe set #1031 consisting of the nucleic acids consisting of SEQ ID NO: 133; 134 and 135;
probe set #1032 consisting of the nucleic acids consisting of SEQ ID NO: 1342; 1343 and 1344;
probe set #1033 consisting of the nucleic acids consisting of SEQ ID NO: 2329; 2335 and 2336;
probe set #1034 consisting of the nucleic acids consisting of SEQ ID NO: 2433; 2434 and 2435;
probe set #1035 consisting of the nucleic acids consisting of SEQ ID NO: 2659; 2660 and 2709;
probe set #1036 consisting of the nucleic acids consisting of SEQ ID NO: 2060; 2072 and 2092;
probe set #1037 consisting of the nucleic acids consisting of SEQ ID NO: 875; 876 and 880;
probe set #1038 consisting of the nucleic acids consisting of SEQ ID NO: 1035;
probe set #1039 consisting of the nucleic acids consisting of SEQ ID NO: 2863; 2864 and 2865;
probe set #1040 consisting of the nucleic acids consisting of SEQ ID NO: 596; 597 and 598;
probe set #1041 consisting of the nucleic acids consisting of SEQ ID NO: 233; 249 and 250;
probe set #1042 consisting of the nucleic acids consisting of SEQ ID NO: 544 and 545;
probe set #1043 consisting of the nucleic acids consisting of SEQ ID NO: 2073; 2074 and 2110;
probe set #1044 consisting of the nucleic acids consisting of SEQ ID NO: 2153; 2154 and 2155;
probe set #1045 consisting of the nucleic acids consisting of SEQ ID NO: 2670; 2708 and 2754;
probe set #1046 consisting of the nucleic acids consisting of SEQ ID NO: 2148; 2149 and 2150;
probe set #1047 consisting of the nucleic acids consisting of SEQ ID NO: 251; 252 and 253;

probe set #1048 consisting of the nucleic acids consisting of SEQ ID NO: 2617; 2618 and 2619;
probe set #1049 consisting of the nucleic acids consisting of SEQ ID NO: 233; 249 and 250;
probe set #1050 consisting of the nucleic acids consisting of SEQ ID NO: 1923; 1924 and 1925;
probe set #1051 consisting of the nucleic acids consisting of SEQ ID NO: 2446 and 2447;
probe set #1052 consisting of the nucleic acids consisting of SEQ ID NO: 1360; 1361 and 1362;
probe set #1053 consisting of the nucleic acids consisting of SEQ ID NO: 2141; 2142 and 2143;
probe set #1054 consisting of the nucleic acids consisting of SEQ ID NO: 2283; 2284 and 2285;
probe set #1055 consisting of the nucleic acids consisting of SEQ ID NO: 2659; 2660 and 2709;
probe set #1056 consisting of the nucleic acids consisting of SEQ ID NO: 2148; 2149 and 2150;
probe set #1057 consisting of the nucleic acids consisting of SEQ ID NO: 2242; 2252 and 2253;
probe set #1058 consisting of the nucleic acids consisting of SEQ ID NO: 2749; 2750 and 2751;
probe set #1059 consisting of the nucleic acids consisting of SEQ ID NO: 1934;
probe set #1060 consisting of the nucleic acids consisting of SEQ ID NO: 234; 235 and 236;
probe set #1061 consisting of the nucleic acids consisting of SEQ ID NO: 2061;
probe set #1062 consisting of the nucleic acids consisting of SEQ ID NO: 1025; 1026 and 1027;
probe set #1063 consisting of the nucleic acids consisting of SEQ ID NO: 960; 961 and 962;
probe set #1064 consisting of the nucleic acids consisting of SEQ ID NO: 2652; 2653 and 2654;
probe set #1065 consisting of the nucleic acids consisting of SEQ ID NO: 2144;
probe set #1066 consisting of the nucleic acids consisting of SEQ ID NO: 1627; 1628 and 1629;
probe set #1067 consisting of the nucleic acids consisting of SEQ ID NO: 921; 922 and 923;
probe set #1068 consisting of the nucleic acids consisting of SEQ ID NO: 1956;
probe set #1069 consisting of the nucleic acids consisting of SEQ ID NO: 1014; 1015 and 1016;
probe set #1070 consisting of the nucleic acids consisting of SEQ ID NO: 1800; 1801 and 1802;
probe set #1071 consisting of the nucleic acids consisting of SEQ ID NO: 445;
probe set #1072 consisting of the nucleic acids consisting of SEQ ID NO: 12; 13 and 20;
probe set #1073 consisting of the nucleic acids consisting of SEQ ID NO: 43; 44 and 45;
probe set #1074 consisting of the nucleic acids consisting of SEQ ID NO: 576; 577 and 578;
probe set #1075 consisting of the nucleic acids consisting of SEQ ID NO: 2329; 2334 and 2335;
probe set #1076 consisting of the nucleic acids consisting of SEQ ID NO: 1219;
probe set #1077 consisting of the nucleic acids consisting of SEQ ID NO: 225; 226 and 227;
probe set #1078 consisting of the nucleic acids consisting of SEQ ID NO: 2384; 2385 and 2386;
probe set #1079 consisting of the nucleic acids consisting of SEQ ID NO: 2579 and 2582;
probe set #1080 consisting of the nucleic acids consisting of SEQ ID NO: 2580; 2581 and 2582;
probe set #1081 consisting of the nucleic acids consisting of SEQ ID NO: 231; 232 and 233;
probe set #1082 consisting of the nucleic acids consisting of SEQ ID NO: 2329; 2334 and 2335;
probe set #1083 consisting of the nucleic acids consisting of SEQ ID NO: 1624; 1625 and 1626;
probe set #1084 consisting of the nucleic acids consisting of SEQ ID NO: 607; 608 and 609;
probe set #1085 consisting of the nucleic acids consisting of SEQ ID NO: 80; 81 and 82;
probe set #1086 consisting of the nucleic acids consisting of SEQ ID NO: 1277;
probe set #1087 consisting of the nucleic acids consisting of SEQ ID NO: 978; 979 and 980;
probe set #1088 consisting of the nucleic acids consisting of SEQ ID NO: 2130; 2131 and 2134;
probe set #1089 consisting of the nucleic acids consisting of SEQ ID NO: 2257; 2258 and 2271;
probe set #1090 consisting of the nucleic acids consisting of SEQ ID NO: 2670; 2676 and 2759;
probe set #1091 consisting of the nucleic acids consisting of SEQ ID NO: 1825; 1826 and 1827;
probe set #1092 consisting of the nucleic acids consisting of SEQ ID NO: 2661 and 2748;
probe set #1093 consisting of the nucleic acids consisting of SEQ ID NO: 2823; 2824 and 2825;
probe set #1094 consisting of the nucleic acids consisting of SEQ ID NO: 2148; 2150 and 2151;
probe set #1095 consisting of the nucleic acids consisting of SEQ ID NO: 479; 480 and 481;
probe set #1096 consisting of the nucleic acids consisting of SEQ ID NO: 2065; 2068 and 2098;
probe set #1097 consisting of the nucleic acids consisting of SEQ ID NO: 2411; 2412 and 2426;
probe set #1098 consisting of the nucleic acids consisting of SEQ ID NO: 2148; 2150 and 2151;
probe set #1099 consisting of the nucleic acids consisting of SEQ ID NO: 1455; 1456 and 1457;
probe set #1100 consisting of the nucleic acids consisting of SEQ ID NO: 1630 and 1631;
probe set #1101 consisting of the nucleic acids consisting of SEQ ID NO: 2243; 2272 and 2273;
probe set #1102 consisting of the nucleic acids consisting of SEQ ID NO: 2839; 2840 and 2849;
probe set #1103 consisting of the nucleic acids consisting of SEQ ID NO: 2438; 2439 and 2440;
probe set #1104 consisting of the nucleic acids consisting of SEQ ID NO: 1627; 1628 and 1629;
probe set #1105 consisting of the nucleic acids consisting of SEQ ID NO: 2458; 2461 and 2462;
probe set #1106 consisting of the nucleic acids consisting of SEQ ID NO: 2295;
probe set #1107 consisting of the nucleic acids consisting of SEQ ID NO: 40; 41 and 42;
probe set #1108 consisting of the nucleic acids consisting of SEQ ID NO: 1923; 1924 and 1925;
probe set #1109 consisting of the nucleic acids consisting of SEQ ID NO: 2078 and 2079;
probe set #1110 consisting of the nucleic acids consisting of SEQ ID NO: 908; 909 and 910;
probe set #1111 consisting of the nucleic acids consisting of SEQ ID NO: 21; 22 and 31;
probe set #1112 consisting of the nucleic acids consisting of SEQ ID NO: 2145; 2146 and 2147;
probe set #1113 consisting of the nucleic acids consisting of SEQ ID NO: 2317; 2318 and 2319;

probe set #1114 consisting of the nucleic acids consisting of SEQ ID NO: 1709;
probe set #1115 consisting of the nucleic acids consisting of SEQ ID NO: 234; 235 and 236;
probe set #1116 consisting of the nucleic acids consisting of SEQ ID NO: 1949; 1950 and 1951;
probe set #1117 consisting of the nucleic acids consisting of SEQ ID NO: 693; 694 and 695;
probe set #1118 consisting of the nucleic acids consisting of SEQ ID NO: 2289; 2303 and 2305;
probe set #1119 consisting of the nucleic acids consisting of SEQ ID NO: 1296; 1297 and 1298;
probe set #1120 consisting of the nucleic acids consisting of SEQ ID NO: 32; 33 and 34;
probe set #1121 consisting of the nucleic acids consisting of SEQ ID NO: 90; 91 and 92;
probe set #1122 consisting of the nucleic acids consisting of SEQ ID NO: 885; 886 and 887;
probe set #1123 consisting of the nucleic acids consisting of SEQ ID NO: 2; 10 and 11;
probe set #1124 consisting of the nucleic acids consisting of SEQ ID NO: 2634; 2635 and 2636;
probe set #1125 consisting of the nucleic acids consisting of SEQ ID NO: 1624; 1625 and 1626;
probe set #1126 consisting of the nucleic acids consisting of SEQ ID NO: 2495; 2496 and 2497;
probe set #1127 consisting of the nucleic acids consisting of SEQ ID NO: 2696; 2697 and 2698;
probe set #1128 consisting of the nucleic acids consisting of SEQ ID NO: 504; 505 and 506;
probe set #1129 consisting of the nucleic acids consisting of SEQ ID NO: 568; 569 and 570;
probe set #1130 consisting of the nucleic acids consisting of SEQ ID NO: 2672; 2752 and 2758;
probe set #1131 consisting of the nucleic acids consisting of SEQ ID NO: 2153; 2154 and 2155;
probe set #1132 consisting of the nucleic acids consisting of SEQ ID NO: 234; 235 and 236;
probe set #1133 consisting of the nucleic acids consisting of SEQ ID NO: 2839; 2840 and 2849;
probe set #1134 consisting of the nucleic acids consisting of SEQ ID NO: 192; 193 and 194;
probe set #1135 consisting of the nucleic acids consisting of SEQ ID NO: 1936; 1937 and 1938;
probe set #1136 consisting of the nucleic acids consisting of SEQ ID NO: 1002; 1003 and 1004;
probe set #1137 consisting of the nucleic acids consisting of SEQ ID NO: 2325; 2326 and 2327;
probe set #1138 consisting of the nucleic acids consisting of SEQ ID NO: 1385; 1386 and 1387;
probe set #1139 consisting of the nucleic acids consisting of SEQ ID NO: 2353; 2354 and 2355;
probe set #1140 consisting of the nucleic acids consisting of SEQ ID NO: 2408; 2409 and 2410;
probe set #1141 consisting of the nucleic acids consisting of SEQ ID NO: 237; 238 and 239;
probe set #1142 consisting of the nucleic acids consisting of SEQ ID NO: 2093;
probe set #1143 consisting of the nucleic acids consisting of SEQ ID NO: 1656; 1657 and 1658;
probe set #1144 consisting of the nucleic acids consisting of SEQ ID NO: 2427;
probe set #1145 consisting of the nucleic acids consisting of SEQ ID NO: 80; 81 and 82;
probe set #1146 consisting of the nucleic acids consisting of SEQ ID NO: 2446; 2457 and 2458;
probe set #1147 consisting of the nucleic acids consisting of SEQ ID NO: 2605; 2606 and 2610;
probe set #1148 consisting of the nucleic acids consisting of SEQ ID NO: 289; 294 and 293;
probe set #1149 consisting of the nucleic acids consisting of SEQ ID NO: 1429; 1430; 1431 and 1432
probe set #1150 consisting of the nucleic acids consisting of SEQ ID NO: 2665; 2666 and 2667;
probe set #1151 consisting of the nucleic acids consisting of SEQ ID NO: 2185; 2186 and 2187;
probe set #1152 consisting of the nucleic acids consisting of SEQ ID NO: 2118; 2119 and 2120;
probe set #1153 consisting of the nucleic acids consisting of SEQ ID NO: 102; 103 and 104;
probe set #1154 consisting of the nucleic acids consisting of SEQ ID NO: 2905; 2906 and 2907;
probe set #1155 consisting of the nucleic acids consisting of SEQ ID NO: 2692 and 2693;
probe set #1156 consisting of the nucleic acids consisting of SEQ ID NO: 234; 235 and 236;
probe set #1157 consisting of the nucleic acids consisting of SEQ ID NO: 2740; 2741 and 2742;
probe set #1158 consisting of the nucleic acids consisting of SEQ ID NO: 1991; 1992 and 1993;
probe set #1159 consisting of the nucleic acids consisting of SEQ ID NO: 1348; 1349 and 1350;
probe set #1160 consisting of the nucleic acids consisting of SEQ ID NO: 574; 575 and 587;
probe set #1161 consisting of the nucleic acids consisting of SEQ ID NO: 2805; 2806 and 2807;
probe set #1162 consisting of the nucleic acids consisting of SEQ ID NO: 571; 572 and 573;
probe set #1163 consisting of the nucleic acids consisting of SEQ ID NO: 2659; 2660 and 2709;
probe set #1164 consisting of the nucleic acids consisting of SEQ ID NO: 2003; 2004 and 2008;
probe set #1165 consisting of the nucleic acids consisting of SEQ ID NO: 2659; 2660 and 2758;
probe set #1166 consisting of the nucleic acids consisting of SEQ ID NO: 2796 and 2797;
probe set #1167 consisting of the nucleic acids consisting of SEQ ID NO: 624; 625 and 626;
probe set #1168 consisting of the nucleic acids consisting of SEQ ID NO: 2135; 2136 and 2137;
probe set #1169 consisting of the nucleic acids consisting of SEQ ID NO: 59; 60 and 61;
probe set #1170 consisting of the nucleic acids consisting of SEQ ID NO: 549; 550 and 551;
probe set #1171 consisting of the nucleic acids consisting of SEQ ID NO: 856; 857 and 858;
probe set #1172 consisting of the nucleic acids consisting of SEQ ID NO: 884; 885 and 888;
probe set #1173 consisting of the nucleic acids consisting of SEQ ID NO: 2148; 2150 and 2151;
probe set #1174 consisting of the nucleic acids consisting of SEQ ID NO: 2436; 2437 and 2460;
probe set #1175 consisting of the nucleic acids consisting of SEQ ID NO: 1803; 1804 and 1816;
probe set #1176 consisting of the nucleic acids consisting of SEQ ID NO: 884 and 888;
probe set #1177 consisting of the nucleic acids consisting of SEQ ID NO: 2141; 2142 and 2143;
probe set #1178 consisting of the nucleic acids consisting of SEQ ID NO: 921; 922 and 923;
probe set #1179 consisting of the nucleic acids consisting of SEQ ID NO: 1922;

probe set #1180 consisting of the nucleic acids consisting of SEQ ID NO: 1286;
probe set #1181 consisting of the nucleic acids consisting of SEQ ID NO: 2012; 2016 and 2017;
probe set #1182 consisting of the nucleic acids consisting of SEQ ID NO: 2003; 2004 and 2007;
probe set #1183 consisting of the nucleic acids consisting of SEQ ID NO: 1756 and 1757;
probe set #1184 consisting of the nucleic acids consisting of SEQ ID NO: 408;
probe set #1185 consisting of the nucleic acids consisting of SEQ ID NO: 83; 84 and 85;
probe set #1186 consisting of the nucleic acids consisting of SEQ ID NO: 234; 235 and 236;
probe set #1187 consisting of the nucleic acids consisting of SEQ ID NO: 2150; 2151 and 2152;
probe set #1188 consisting of the nucleic acids consisting of SEQ ID NO: 1851; 1852 and 1854;
probe set #1189 consisting of the nucleic acids consisting of SEQ ID NO: 546; 547 and 548;
probe set #1190 consisting of the nucleic acids consisting of SEQ ID NO: 2605; 2606 and 2610;
probe set #1191 consisting of the nucleic acids consisting of SEQ ID NO: 2138; 2139 and 2140;
probe set #1192 consisting of the nucleic acids consisting of SEQ ID NO: 80; 81 and 82;
probe set #1193 consisting of the nucleic acids consisting of SEQ ID NO: 1740; 1741 and 1742;
probe set #1194 consisting of the nucleic acids consisting of SEQ ID NO: 234; 235 and 236;
probe set #1195 consisting of the nucleic acids consisting of SEQ ID NO: 1975; 1976 and 1977;
probe set #1196 consisting of the nucleic acids consisting of SEQ ID NO: 146; 147 and 150;
probe set #1197 consisting of the nucleic acids consisting of SEQ ID NO: 1452; 1453 and 1454;
probe set #1198 consisting of the nucleic acids consisting of SEQ ID NO: 692; 693 and 695;
probe set #1199 consisting of the nucleic acids consisting of SEQ ID NO: 2895;
probe set #1200 consisting of the nucleic acids consisting of SEQ ID NO: 993; 994 and 995;
probe set #1201 consisting of the nucleic acids consisting of SEQ ID NO: 2359; 2360 and 2361;
probe set #1202 consisting of the nucleic acids consisting of SEQ ID NO: 2826; 2827 and 2828;
probe set #1203 consisting of the nucleic acids consisting of SEQ ID NO: 2872; 2873 and 2878;
probe set #1204 consisting of the nucleic acids consisting of SEQ ID NO: 2567; 2568 and 2569;
probe set #1205 consisting of the nucleic acids consisting of SEQ ID NO: 114; 115 and 116;
probe set #1206 consisting of the nucleic acids consisting of SEQ ID NO: 2554; 2555 and 2556;
probe set #1207 consisting of the nucleic acids consisting of SEQ ID NO: 117; 118 and 119;
probe set #1208 consisting of the nucleic acids consisting of SEQ ID NO: 2507; 2508 and 2509;
probe set #1209 consisting of the nucleic acids consisting of SEQ ID NO: 1923; 1924 and 1925;
probe set #1210 consisting of the nucleic acids consisting of SEQ ID NO: 702; 717 and 718;
probe set #1211 consisting of the nucleic acids consisting of SEQ ID NO: 142; 143 and 144;
probe set #1212 consisting of the nucleic acids consisting of SEQ ID NO: 2242; 2252 and 2267;
probe set #1213 consisting of the nucleic acids consisting of SEQ ID NO: 2611; 2612 and 2613;
probe set #1214 consisting of the nucleic acids consisting of SEQ ID NO: 1881; 1882 and 1883;
probe set #1215 consisting of the nucleic acids consisting of SEQ ID NO: 1862; 1863 and 1864;
probe set #1216 consisting of the nucleic acids consisting of SEQ ID NO: 470; 471 and 472;
probe set #1217 consisting of the nucleic acids consisting of SEQ ID NO: 524; 525 and 526;
probe set #1218 consisting of the nucleic acids consisting of SEQ ID NO: 656; 657 and 658;
probe set #1219 consisting of the nucleic acids consisting of SEQ ID NO: 2444; 2445 and 2446;
probe set #1220 consisting of the nucleic acids consisting of SEQ ID NO: 50; 51 and 52;
probe set #1221 consisting of the nucleic acids consisting of SEQ ID NO: 2060; 2072 and 2092;
probe set #1222 consisting of the nucleic acids consisting of SEQ ID NO: 2820; 2821 and 2822;
probe set #1223 consisting of the nucleic acids consisting of SEQ ID NO: 2046; 2047 and 2048;
probe set #1224 consisting of the nucleic acids consisting of SEQ ID NO: 1806; 1807 and 1808;
probe set #1225 consisting of the nucleic acids consisting of SEQ ID NO: 2060; 2089 and 2092;
probe set #1226 consisting of the nucleic acids consisting of SEQ ID NO: 1415; 1416 and 1417;
probe set #1227 consisting of the nucleic acids consisting of SEQ ID NO: 2433; 2434 and 2435; and
probe set #1228 consisting of the nucleic acids consisting of SEQ ID NO: 2433; 2434 and 2435.

6. The combination according to claim 5, comprising 1640 polynucleotide probe sets,
said 1640 polynucleotide probe sets comprising probe set #1 to probe set #1228, and
probe set #1229 consisting of the nucleic acids consisting of SEQ ID NO: 690 and 691;
probe set #1230 consisting of the nucleic acids consisting of SEQ ID NO: 2094; 2095 and 2096;
probe set #1231 consisting of the nucleic acids consisting of SEQ ID NO: 532; 533 and 534;
probe set #1232 consisting of the nucleic acids consisting of SEQ ID NO: 2570; 2571 and 2572;
probe set #1233 consisting of the nucleic acids consisting of SEQ ID NO: 516; 517 and 518;
probe set #1234 consisting of the nucleic acids consisting of SEQ ID NO: 1449; 1450 and 1451;
probe set #1235 consisting of the nucleic acids consisting of SEQ ID NO: 950; 951 and 952;
probe set #1236 consisting of the nucleic acids consisting of SEQ ID NO: 1749; 1751 and 1752;
probe set #1237 consisting of the nucleic acids consisting of SEQ ID NO: 1614; 1615 and 1616;
probe set #1238 consisting of the nucleic acids consisting of SEQ ID NO: 1400; 1401 and 1402;
probe set #1239 consisting of the nucleic acids consisting of SEQ ID NO: 2477; 2478 and 2479;
probe set #1240 consisting of the nucleic acids consisting of SEQ ID NO: 1964;
probe set #1241 consisting of the nucleic acids consisting of SEQ ID NO: 2607; 2608 and 2609;
probe set #1242 consisting of the nucleic acids consisting of SEQ ID NO: 544; 545 and 544;
probe set #1243 consisting of the nucleic acids consisting of SEQ ID NO: 301; 303 and 302;

probe set #1244 consisting of the nucleic acids consisting of SEQ ID NO: 918; 919 and 920;
probe set #1245 consisting of the nucleic acids consisting of SEQ ID NO: 1923; 1924 and 1925;
probe set #1246 consisting of the nucleic acids consisting of SEQ ID NO: 1620; 1632 and 1633;
probe set #1247 consisting of the nucleic acids consisting of SEQ ID NO: 1464; 1465 and 1466;
probe set #1248 consisting of the nucleic acids consisting of SEQ ID NO: 184; 185 and 186;
probe set #1249 consisting of the nucleic acids consisting of SEQ ID NO: 681; 682 and 683;
probe set #1250 consisting of the nucleic acids consisting of SEQ ID NO: 2607; 2608 and 2609;
probe set #1251 consisting of the nucleic acids consisting of SEQ ID NO: 2384; 2385 and 2387;
probe set #1252 consisting of the nucleic acids consisting of SEQ ID NO: 2564; 2565 and 2566;
probe set #1253 consisting of the nucleic acids consisting of SEQ ID NO: 1634; 1635 and 1636;
probe set #1254 consisting of the nucleic acids consisting of SEQ ID NO: 1875;
probe set #1255 consisting of the nucleic acids consisting of SEQ ID NO: 2833; 2834 and 2835;
probe set #1256 consisting of the nucleic acids consisting of SEQ ID NO: 1753; 1754 and 1755;
probe set #1257 consisting of the nucleic acids consisting of SEQ ID NO: 2830; 2836 and 2837;
probe set #1258 consisting of the nucleic acids consisting of SEQ ID NO: 2869; 2870 and 2871;
probe set #1259 consisting of the nucleic acids consisting of SEQ ID NO: 1710; 1711 and 1712;
probe set #1260 consisting of the nucleic acids consisting of SEQ ID NO: 592; 593 and 594;
probe set #1261 consisting of the nucleic acids consisting of SEQ ID NO: 2331; 2332 and 2333;
probe set #1262 consisting of the nucleic acids consisting of SEQ ID NO: 357; 359 and 358;
probe set #1263 consisting of the nucleic acids consisting of SEQ ID NO: 2605; 2607 and 2610;
probe set #1264 consisting of the nucleic acids consisting of SEQ ID NO: 2403;
probe set #1265 consisting of the nucleic acids consisting of SEQ ID NO: 432; 433 and 434;
probe set #1266 consisting of the nucleic acids consisting of SEQ ID NO: 2264; 2265 and 2266;
probe set #1267 consisting of the nucleic acids consisting of SEQ ID NO: 956; 957 and 958;
probe set #1268 consisting of the nucleic acids consisting of SEQ ID NO: 758; 759 and 760;
probe set #1269 consisting of the nucleic acids consisting of SEQ ID NO: 2438; 2439 and 2440;
probe set #1270 consisting of the nucleic acids consisting of SEQ ID NO: 1409; 1410 and 1411;
probe set #1271 consisting of the nucleic acids consisting of SEQ ID NO: 1920; 1933 and 1999;
probe set #1272 consisting of the nucleic acids consisting of SEQ ID NO: 2438; 2439 and 2440;
probe set #1273 consisting of the nucleic acids consisting of SEQ ID NO: 21; 22 and 23;
probe set #1274 consisting of the nucleic acids consisting of SEQ ID NO: 2841; 2842 and 2843;
probe set #1275 consisting of the nucleic acids consisting of SEQ ID NO: 2063; 2065 and 2068;
probe set #1276 consisting of the nucleic acids consisting of SEQ ID NO: 1458; 1459 and 1460;
probe set #1277 consisting of the nucleic acids consisting of SEQ ID NO: 2019; 2020 and 2021;
probe set #1278 consisting of the nucleic acids consisting of SEQ ID NO: 706; 707 and 708;
probe set #1279 consisting of the nucleic acids consisting of SEQ ID NO: 1859; 1860 and 1861;
probe set #1280 consisting of the nucleic acids consisting of SEQ ID NO: 636; 637 and 638;
probe set #1281 consisting of the nucleic acids consisting of SEQ ID NO: 2388; 2389 and 2390;
probe set #1282 consisting of the nucleic acids consisting of SEQ ID NO: 385; 386 and 387;
probe set #1283 consisting of the nucleic acids consisting of SEQ ID NO: 777; 778 and 779;
probe set #1284 consisting of the nucleic acids consisting of SEQ ID NO: 1936; 1937 and 1938;
probe set #1285 consisting of the nucleic acids consisting of SEQ ID NO: 2094; 2095 and 2096;
probe set #1286 consisting of the nucleic acids consisting of SEQ ID NO: 1749; 1750 and 1752;
probe set #1287 consisting of the nucleic acids consisting of SEQ ID NO: 21; 22 and 31;
probe set #1288 consisting of the nucleic acids consisting of SEQ ID NO: 1366; 1367 and 1380;
probe set #1289 consisting of the nucleic acids consisting of SEQ ID NO: 1701; 1702 and 1703;
probe set #1290 consisting of the nucleic acids consisting of SEQ ID NO: 1936; 1937 and 1938;
probe set #1291 consisting of the nucleic acids consisting of SEQ ID NO: 2013; 2014 and 2015;
probe set #1292 consisting of the nucleic acids consisting of SEQ ID NO: 1913; 1914 and 1915;
probe set #1293 consisting of the nucleic acids consisting of SEQ ID NO: 1336; 1337 and 1338;
probe set #1294 consisting of the nucleic acids consisting of SEQ ID NO: 2060; 2072 and 2092;
probe set #1295 consisting of the nucleic acids consisting of SEQ ID NO: 184; 187 and 188;
probe set #1296 consisting of the nucleic acids consisting of SEQ ID NO: 1702; 1703 and 1704;
probe set #1297 consisting of the nucleic acids consisting of SEQ ID NO: 2605; 2607 and 2610;
probe set #1298 consisting of the nucleic acids consisting of SEQ ID NO: 884; 885 and 886;
probe set #1299 consisting of the nucleic acids consisting of SEQ ID NO: 853; 854 and 855;
probe set #1300 consisting of the nucleic acids consisting of SEQ ID NO: 2072; 2089 and 2092;
probe set #1301 consisting of the nucleic acids consisting of SEQ ID NO: 645;
probe set #1302 consisting of the nucleic acids consisting of SEQ ID NO: 231; 232 and 233;
probe set #1303 consisting of the nucleic acids consisting of SEQ ID NO: 2605; 2606 and 2610;
probe set #1304 consisting of the nucleic acids consisting of SEQ ID NO: 2896; 2897 and 2898;
probe set #1305 consisting of the nucleic acids consisting of SEQ ID NO: 579; 587 and 646;
probe set #1306 consisting of the nucleic acids consisting of SEQ ID NO: 2922; 2923 and 2924;
probe set #1307 consisting of the nucleic acids consisting of SEQ ID NO: 2593; 2594 and 2595;
probe set #1308 consisting of the nucleic acids consisting of SEQ ID NO: 2012 and 2018;
probe set #1309 consisting of the nucleic acids consisting of SEQ ID NO: 2857 and 2858;

probe set #1310 consisting of the nucleic acids consisting of SEQ ID NO: 1855; 1857 and 1858;
probe set #1311 consisting of the nucleic acids consisting of SEQ ID NO: 648; 649 and 650;
probe set #1312 consisting of the nucleic acids consisting of SEQ ID NO: 987; 988 and 989;
probe set #1313 consisting of the nucleic acids consisting of SEQ ID NO: 2003; 2007 and 2009;
probe set #1314 consisting of the nucleic acids consisting of SEQ ID NO: 702; 710 and 717;
probe set #1315 consisting of the nucleic acids consisting of SEQ ID NO: 1484; 1485 and 1486;
probe set #1316 consisting of the nucleic acids consisting of SEQ ID NO: 574; 587 and 647;
probe set #1317 consisting of the nucleic acids consisting of SEQ ID NO: 12; 13 and 20;
probe set #1318 consisting of the nucleic acids consisting of SEQ ID NO: 1868;
probe set #1319 consisting of the nucleic acids consisting of SEQ ID NO: 1157;
probe set #1320 consisting of the nucleic acids consisting of SEQ ID NO: 1758; 1759 and 1760;
probe set #1321 consisting of the nucleic acids consisting of SEQ ID NO: 933; 934 and 935;
probe set #1322 consisting of the nucleic acids consisting of SEQ ID NO: 1372; 1373 and 1379;
probe set #1323 consisting of the nucleic acids consisting of SEQ ID NO: 1378;
probe set #1324 consisting of the nucleic acids consisting of SEQ ID NO: 1627; 1628 and 1629;
probe set #1325 consisting of the nucleic acids consisting of SEQ ID NO: 21; 22 and 23;
probe set #1326 consisting of the nucleic acids consisting of SEQ ID NO: 2012; 2016 and 2022;
probe set #1327 consisting of the nucleic acids consisting of SEQ ID NO: 884; 885 and 888;
probe set #1328 consisting of the nucleic acids consisting of SEQ ID NO: 47; 48 and 49;
probe set #1329 consisting of the nucleic acids consisting of SEQ ID NO: 2396;
probe set #1330 consisting of the nucleic acids consisting of SEQ ID NO: 2814; 2815 and 2816;
probe set #1331 consisting of the nucleic acids consisting of SEQ ID NO: 237; 238 and 239;
probe set #1332 consisting of the nucleic acids consisting of SEQ ID NO: 2331; 2332 and 2333;
probe set #1333 consisting of the nucleic acids consisting of SEQ ID NO: 2709;
probe set #1334 consisting of the nucleic acids consisting of SEQ ID NO: 2605; 2607 and 2610;
probe set #1335 consisting of the nucleic acids consisting of SEQ ID NO: 1375; 1376 and 1377;
probe set #1336 consisting of the nucleic acids consisting of SEQ ID NO: 17; 18 and 19;
probe set #1337 consisting of the nucleic acids consisting of SEQ ID NO: 397;
probe set #1338 consisting of the nucleic acids consisting of SEQ ID NO: 921; 922 and 923;
probe set #1339 consisting of the nucleic acids consisting of SEQ ID NO: 250; 256 and 257;
probe set #1340 consisting of the nucleic acids consisting of SEQ ID NO: 1501; 1502 and 1503;
probe set #1341 consisting of the nucleic acids consisting of SEQ ID NO: 385; 386 and 387;
probe set #1342 consisting of the nucleic acids consisting of SEQ ID NO: 639; 640 and 641;
probe set #1343 consisting of the nucleic acids consisting of SEQ ID NO: 1836; 1837 and 1838;
probe set #1344 consisting of the nucleic acids consisting of SEQ ID NO: 62; 63 and 64;
probe set #1345 consisting of the nucleic acids consisting of SEQ ID NO: 2242; 2243 and 2244;
probe set #1346 consisting of the nucleic acids consisting of SEQ ID NO: 1044; 1045 and 1046;
probe set #1347 consisting of the nucleic acids consisting of SEQ ID NO: 1615; 1616 and 1620;
probe set #1348 consisting of the nucleic acids consisting of SEQ ID NO: 2724; 2732 and 2733;
probe set #1349 consisting of the nucleic acids consisting of SEQ ID NO: 87; 88 and 89;
probe set #1350 consisting of the nucleic acids consisting of SEQ ID NO: 706; 707 and 708;
probe set #1351 consisting of the nucleic acids consisting of SEQ ID NO: 881; 882 and 883;
probe set #1352 consisting of the nucleic acids consisting of SEQ ID NO: 2029; 2030 and 2031;
probe set #1353 consisting of the nucleic acids consisting of SEQ ID NO: 2448; 2449 and 2450;
probe set #1354 consisting of the nucleic acids consisting of SEQ ID NO: 46;
probe set #1355 consisting of the nucleic acids consisting of SEQ ID NO: 574; 575 and 613;
probe set #1356 consisting of the nucleic acids consisting of SEQ ID NO: 394; 395 and 396;
probe set #1357 consisting of the nucleic acids consisting of SEQ ID NO: 2844; 2845 and 2846;
probe set #1358 consisting of the nucleic acids consisting of SEQ ID NO: 2165; 2168 and 2169;
probe set #1359 consisting of the nucleic acids consisting of SEQ ID NO: 2111; 2112 and 2113;
probe set #1360 consisting of the nucleic acids consisting of SEQ ID NO: 2404; 2405 and 2407;
probe set #1361 consisting of the nucleic acids consisting of SEQ ID NO: 2463; 2464 and 2465;
probe set #1362 consisting of the nucleic acids consisting of SEQ ID NO: 2221;
probe set #1363 consisting of the nucleic acids consisting of SEQ ID NO: 1620; 1632 and 1633;
probe set #1364 consisting of the nucleic acids consisting of SEQ ID NO: 12; 13 and 20;
probe set #1365 consisting of the nucleic acids consisting of SEQ ID NO: 2325; 2326 and 2327;
probe set #1366 consisting of the nucleic acids consisting of SEQ ID NO: 210; 211 and 212;
probe set #1367 consisting of the nucleic acids consisting of SEQ ID NO: 918; 927 and 932;
probe set #1368 consisting of the nucleic acids consisting of SEQ ID NO: 604; 605 and 606;
probe set #1369 consisting of the nucleic acids consisting of SEQ ID NO: 2454; 2455 and 2456;
probe set #1370 consisting of the nucleic acids consisting of SEQ ID NO: 467; 468 and 469;
probe set #1371 consisting of the nucleic acids consisting of SEQ ID NO: 488; 489 and 490;
probe set #1372 consisting of the nucleic acids consisting of SEQ ID NO: 904; 905 and 906;
probe set #1373 consisting of the nucleic acids consisting of SEQ ID NO: 289; 294 and 293;
probe set #1374 consisting of the nucleic acids consisting of SEQ ID NO: 1319; 1320 and 1321;
probe set #1375 consisting of the nucleic acids consisting of SEQ ID NO: 2394;

probe set #1376 consisting of the nucleic acids consisting of SEQ ID NO: 382; 383 and 384;
probe set #1377 consisting of the nucleic acids consisting of SEQ ID NO: 14; 15 and 16;
probe set #1378 consisting of the nucleic acids consisting of SEQ ID NO: 580 and 581;
probe set #1379 consisting of the nucleic acids consisting of SEQ ID NO: 1928; 1929 and 1930;
probe set #1380 consisting of the nucleic acids consisting of SEQ ID NO: 869; 870 and 874;
probe set #1381 consisting of the nucleic acids consisting of SEQ ID NO: 1433; 1434 and 1457;
probe set #1382 consisting of the nucleic acids consisting of SEQ ID NO: 892; 893 and 894;
probe set #1383 consisting of the nucleic acids consisting of SEQ ID NO: 884; 885 and 888;
probe set #1384 consisting of the nucleic acids consisting of SEQ ID NO: 295; 297 and 296;
probe set #1385 consisting of the nucleic acids consisting of SEQ ID NO: 2874;
probe set #1386 consisting of the nucleic acids consisting of SEQ ID NO: 1845; 1846 and 1847;
probe set #1387 consisting of the nucleic acids consisting of SEQ ID NO: 2604; 2606 and 2610;
probe set #1388 consisting of the nucleic acids consisting of SEQ ID NO: 1329; 1330 and 1331;
probe set #1389 consisting of the nucleic acids consisting of SEQ ID NO: 2461; 2462 and 2467;
probe set #1390 consisting of the nucleic acids consisting of SEQ ID NO: 234; 235 and 236;
probe set #1391 consisting of the nucleic acids consisting of SEQ ID NO: 1621; 1622 and 1623;
probe set #1392 consisting of the nucleic acids consisting of SEQ ID NO: 2879; 2880 and 2882;
probe set #1393 consisting of the nucleic acids consisting of SEQ ID NO: 761; 762 and 765;
probe set #1394 consisting of the nucleic acids consisting of SEQ ID NO: 1851; 1853 and 1854;
probe set #1395 consisting of the nucleic acids consisting of SEQ ID NO: 2138; 2139 and 2140;
probe set #1396 consisting of the nucleic acids consisting of SEQ ID NO: 627; 628 and 629;
probe set #1397 consisting of the nucleic acids consisting of SEQ ID NO: 574; 575 and 613;
probe set #1398 consisting of the nucleic acids consisting of SEQ ID NO: 2462;
probe set #1399 consisting of the nucleic acids consisting of SEQ ID NO: 2504; 2505 and 2506;
probe set #1400 consisting of the nucleic acids consisting of SEQ ID NO: 1908;
probe set #1401 consisting of the nucleic acids consisting of SEQ ID NO: 108; 109 and 110;
probe set #1402 consisting of the nucleic acids consisting of SEQ ID NO: 516; 517 and 518;
probe set #1403 consisting of the nucleic acids consisting of SEQ ID NO: 1496; 1506 and 1508;
probe set #1404 consisting of the nucleic acids consisting of SEQ ID NO: 507; 508 and 509;
probe set #1405 consisting of the nucleic acids consisting of SEQ ID NO: 2655; 2656 and 2657;
probe set #1406 consisting of the nucleic acids consisting of SEQ ID NO: 902; 911 and 902;
probe set #1407 consisting of the nucleic acids consisting of SEQ ID NO: 835 and 836;
probe set #1408 consisting of the nucleic acids consisting of SEQ ID NO: 2328; 2329 and 2330;
probe set #1409 consisting of the nucleic acids consisting of SEQ ID NO: 1316; 1317 and 1318;
probe set #1410 consisting of the nucleic acids consisting of SEQ ID NO: 2153; 2154 and 2155;
probe set #1411 consisting of the nucleic acids consisting of SEQ ID NO: 2153; 2154 and 2155;
probe set #1412 consisting of the nucleic acids consisting of SEQ ID NO: 1296; 1297 and 1302;
probe set #1413 consisting of the nucleic acids consisting of SEQ ID NO: 599; 600 and 601;
probe set #1414 consisting of the nucleic acids consisting of SEQ ID NO: 2239; 2240 and 2241;
probe set #1415 consisting of the nucleic acids consisting of SEQ ID NO: 1724; 1725 and 1726;
probe set #1416 consisting of the nucleic acids consisting of SEQ ID NO: 1803; 1804 and 1805;
probe set #1417 consisting of the nucleic acids consisting of SEQ ID NO: 1819 and 1820;
probe set #1418 consisting of the nucleic acids consisting of SEQ ID NO: 1872; 1873 and 1874;
probe set #1419 consisting of the nucleic acids consisting of SEQ ID NO: 398;
probe set #1420 consisting of the nucleic acids consisting of SEQ ID NO: 497;
probe set #1421 consisting of the nucleic acids consisting of SEQ ID NO: 770; 771 and 772;
probe set #1422 consisting of the nucleic acids consisting of SEQ ID NO: 2588; 2589 and 2590;
probe set #1423 consisting of the nucleic acids consisting of SEQ ID NO: 663; 664 and 665;
probe set #1424 consisting of the nucleic acids consisting of SEQ ID NO: 2919; 2920 and 2921;
probe set #1425 consisting of the nucleic acids consisting of SEQ ID NO: 2363; 2364 and 2365;
probe set #1426 consisting of the nucleic acids consisting of SEQ ID NO: 1363; 1364 and 1365;
probe set #1427 consisting of the nucleic acids consisting of SEQ ID NO: 2044; 2045 and 2048;
probe set #1428 consisting of the nucleic acids consisting of SEQ ID NO: 2388; 2389 and 2390;
probe set #1429 consisting of the nucleic acids consisting of SEQ ID NO: 2660; 2672 and 2708;
probe set #1430 consisting of the nucleic acids consisting of SEQ ID NO: 2892; 2893 and 2894;
probe set #1431 consisting of the nucleic acids consisting of SEQ ID NO: 944; 945 and 946;
probe set #1432 consisting of the nucleic acids consisting of SEQ ID NO: 1005; 1006 and 1007;
probe set #1433 consisting of the nucleic acids consisting of SEQ ID NO: 889; 895 and 896;
probe set #1434 consisting of the nucleic acids consisting of SEQ ID NO: 2524; 2525 and 2526;
probe set #1435 consisting of the nucleic acids consisting of SEQ ID NO: 2403;
probe set #1436 consisting of the nucleic acids consisting of SEQ ID NO: 461; 462 and 463;
probe set #1437 consisting of the nucleic acids consisting of SEQ ID NO: 385; 386 and 387;
probe set #1438 consisting of the nucleic acids consisting of SEQ ID NO: 2933; 2934 and 2935;
probe set #1439 consisting of the nucleic acids consisting of SEQ ID NO: 960;
probe set #1440 consisting of the nucleic acids consisting of SEQ ID NO: 23; 29 and 30;
probe set #1441 consisting of the nucleic acids consisting of SEQ ID NO: 210; 211 and 212;

probe set #1442 consisting of the nucleic acids consisting of SEQ ID NO: 1817; 1818 and 1821;
probe set #1443 consisting of the nucleic acids consisting of SEQ ID NO: 924; 925 and 926;
probe set #1444 consisting of the nucleic acids consisting of SEQ ID NO: 504; 505 and 506;
probe set #1445 consisting of the nucleic acids consisting of SEQ ID NO: 178; 179 and 180;
probe set #1446 consisting of the nucleic acids consisting of SEQ ID NO: 161; 162 and 163;
probe set #1447 consisting of the nucleic acids consisting of SEQ ID NO: 2114 and 2115;
probe set #1448 consisting of the nucleic acids consisting of SEQ ID NO: 461; 462 and 463;
probe set #1449 consisting of the nucleic acids consisting of SEQ ID NO: 2153; 2154 and 2155;
probe set #1450 consisting of the nucleic acids consisting of SEQ ID NO: 1441; 1442 and 1443;
probe set #1451 consisting of the nucleic acids consisting of SEQ ID NO: 1036; 1037 and 1038;
probe set #1452 consisting of the nucleic acids consisting of SEQ ID NO: 915; 916 and 917;
probe set #1453 consisting of the nucleic acids consisting of SEQ ID NO: 661; 662 and 666;
probe set #1454 consisting of the nucleic acids consisting of SEQ ID NO: 1326; 1327 and 1328;
probe set #1455 consisting of the nucleic acids consisting of SEQ ID NO: 2855; 2858 and 2859;
probe set #1456 consisting of the nucleic acids consisting of SEQ ID NO: 1842; 1843 and 1844;
probe set #1457 consisting of the nucleic acids consisting of SEQ ID NO: 1828; 1829 and 1830;
probe set #1458 consisting of the nucleic acids consisting of SEQ ID NO: 1659; 1660 and 1661;
probe set #1459 consisting of the nucleic acids consisting of SEQ ID NO: 2116; 2117 and 2118;
probe set #1460 consisting of the nucleic acids consisting of SEQ ID NO: 1642; 1643 and 1645;
probe set #1461 consisting of the nucleic acids consisting of SEQ ID NO: 2395;
probe set #1462 consisting of the nucleic acids consisting of SEQ ID NO: 1345; 1346 and 1347;
probe set #1463 consisting of the nucleic acids consisting of SEQ ID NO: 2003; 2004 and 2007;
probe set #1464 consisting of the nucleic acids consisting of SEQ ID NO: 2831; 2847 and 2848;
probe set #1465 consisting of the nucleic acids consisting of SEQ ID NO: 1702; 1703 and 1708;
probe set #1466 consisting of the nucleic acids consisting of SEQ ID NO: 2404; 2405 and 2406;
probe set #1467 consisting of the nucleic acids consisting of SEQ ID NO: 711; 712 and 713;
probe set #1468 consisting of the nucleic acids consisting of SEQ ID NO: 1494 and 1495;
probe set #1469 consisting of the nucleic acids consisting of SEQ ID NO: 570; 585 and 586;
probe set #1470 consisting of the nucleic acids consisting of SEQ ID NO: 1848; 1849 and 1850;
probe set #1471 consisting of the nucleic acids consisting of SEQ ID NO: 1439; 1440 and 1457;
probe set #1472 consisting of the nucleic acids consisting of SEQ ID NO: 877; 878 and 879;
probe set #1473 consisting of the nucleic acids consisting of SEQ ID NO: 568; 569 and 579;
probe set #1474 consisting of the nucleic acids consisting of SEQ ID NO: 1902; 1903 and 1904;
probe set #1475 consisting of the nucleic acids consisting of SEQ ID NO: 1426; 1427 and 1428;
probe set #1476 consisting of the nucleic acids consisting of SEQ ID NO: 1145; 1146 and 1147;
probe set #1477 consisting of the nucleic acids consisting of SEQ ID NO: 425; 426 and 427;
probe set #1478 consisting of the nucleic acids consisting of SEQ ID NO: 494; 495 and 496;
probe set #1479 consisting of the nucleic acids consisting of SEQ ID NO: 2116; 2117 and 2118;
probe set #1480 consisting of the nucleic acids consisting of SEQ ID NO: 2331; 2332 and 2333;
probe set #1481 consisting of the nucleic acids consisting of SEQ ID NO: 897; 902 and 911;
probe set #1482 consisting of the nucleic acids consisting of SEQ ID NO: 1899; 1900 and 1901;
probe set #1483 consisting of the nucleic acids consisting of SEQ ID NO: 290; 292 and 291;
probe set #1484 consisting of the nucleic acids consisting of SEQ ID NO: 243; 244 and 245;
probe set #1485 consisting of the nucleic acids consisting of SEQ ID NO: 2502; 2503 and 2542;
probe set #1486 consisting of the nucleic acids consisting of SEQ ID NO: 1695; 1696 and 1697;
probe set #1487 consisting of the nucleic acids consisting of SEQ ID NO: 2617; 2620 and 2621;
probe set #1488 consisting of the nucleic acids consisting of SEQ ID NO: 1405; 1406 and 1410;
probe set #1489 consisting of the nucleic acids consisting of SEQ ID NO: 941; 954 and 955;
probe set #1490 consisting of the nucleic acids consisting of SEQ ID NO: 2814; 2815 and 2816;
probe set #1491 consisting of the nucleic acids consisting of SEQ ID NO: 2614; 2615 and 2616;
probe set #1492 consisting of the nucleic acids consisting of SEQ ID NO: 258; 259 and 260;
probe set #1493 consisting of the nucleic acids consisting of SEQ ID NO: 2260; 2261 and 2262;
probe set #1494 consisting of the nucleic acids consisting of SEQ ID NO: 2643; 2644 and 2645;
probe set #1495 consisting of the nucleic acids consisting of SEQ ID NO: 2337;
probe set #1496 consisting of the nucleic acids consisting of SEQ ID NO: 652; 653 and 654;
probe set #1497 consisting of the nucleic acids consisting of SEQ ID NO: 439; 440 and 441;
probe set #1498 consisting of the nucleic acids consisting of SEQ ID NO: 2817; 2818 and 2819;
probe set #1499 consisting of the nucleic acids consisting of SEQ ID NO: 1627; 1628 and 1629;
probe set #1500 consisting of the nucleic acids consisting of SEQ ID NO: 1496; 1505 and 1506;
probe set #1501 consisting of the nucleic acids consisting of SEQ ID NO: 1632; 1637 and 1638;
probe set #1502 consisting of the nucleic acids consisting of SEQ ID NO: 2411; 2412 and 2413;
probe set #1503 consisting of the nucleic acids consisting of SEQ ID NO: 1813; 1814 and 1815;
probe set #1504 consisting of the nucleic acids consisting of SEQ ID NO: 2557;
probe set #1505 consisting of the nucleic acids consisting of SEQ ID NO: 2605; 2606 and 2610;
probe set #1506 consisting of the nucleic acids consisting of SEQ ID NO: 1496; 1497 and 1506;
probe set #1507 consisting of the nucleic acids consisting of SEQ ID NO: 2331; 2332 and 2333;

probe set #1508 consisting of the nucleic acids consisting of SEQ ID NO: 1803; 1804 and 1809;
probe set #1509 consisting of the nucleic acids consisting of SEQ ID NO: 510; 511 and 512;
probe set #1510 consisting of the nucleic acids consisting of SEQ ID NO: 1928; 1929 and 1930;
probe set #1511 consisting of the nucleic acids consisting of SEQ ID NO: 2436; 2437 and 2460;
probe set #1512 consisting of the nucleic acids consisting of SEQ ID NO: 2605; 2607 and 2610;
probe set #1513 consisting of the nucleic acids consisting of SEQ ID NO: 1424; 1425 and 1450;
probe set #1514 consisting of the nucleic acids consisting of SEQ ID NO: 2111; 2112 and 2113;
probe set #1515 consisting of the nucleic acids consisting of SEQ ID NO: 1625; 1647 and 1648;
probe set #1516 consisting of the nucleic acids consisting of SEQ ID NO: 1624; 1625 and 1626;
probe set #1517 consisting of the nucleic acids consisting of SEQ ID NO: 498; 499 and 500;
probe set #1518 consisting of the nucleic acids consisting of SEQ ID NO: 2831; 2832 and 2848;
probe set #1519 consisting of the nucleic acids consisting of SEQ ID NO: 1878; 1879 and 1880;
probe set #1520 consisting of the nucleic acids consisting of SEQ ID NO: 869; 873 and 874;
probe set #1521 consisting of the nucleic acids consisting of SEQ ID NO: 990; 991 and 992;
probe set #1522 consisting of the nucleic acids consisting of SEQ ID NO: 1839; 1840 and 1841;
probe set #1523 consisting of the nucleic acids consisting of SEQ ID NO: 535; 536 and 537;
probe set #1524 consisting of the nucleic acids consisting of SEQ ID NO: 1325;
probe set #1525 consisting of the nucleic acids consisting of SEQ ID NO: 281; 283 and 282;
probe set #1526 consisting of the nucleic acids consisting of SEQ ID NO: 2331; 2332 and 2333;
probe set #1527 consisting of the nucleic acids consisting of SEQ ID NO: 1491; 1492 and 1493;
probe set #1528 consisting of the nucleic acids consisting of SEQ ID NO: 897; 903 and 907;
probe set #1529 consisting of the nucleic acids consisting of SEQ ID NO: 2388; 2389 and 2390;
probe set #1530 consisting of the nucleic acids consisting of SEQ ID NO: 851 and 852;
probe set #1531 consisting of the nucleic acids consisting of SEQ ID NO: 2716;
probe set #1532 consisting of the nucleic acids consisting of SEQ ID NO: 1496; 1506 and 1508;
probe set #1533 consisting of the nucleic acids consisting of SEQ ID NO: 2672; 2682 and 2708;
probe set #1534 consisting of the nucleic acids consisting of SEQ ID NO: 529; 530 and 531;
probe set #1535 consisting of the nucleic acids consisting of SEQ ID NO: 1705; 1706 and 1707;
probe set #1536 consisting of the nucleic acids consisting of SEQ ID NO: 7; 8 and 9;
probe set #1537 consisting of the nucleic acids consisting of SEQ ID NO: 77; 78 and 79;
probe set #1538 consisting of the nucleic acids consisting of SEQ ID NO: 1322; 1323 and 1324;
probe set #1539 consisting of the nucleic acids consisting of SEQ ID NO: 2451; 2452 and 2453;
probe set #1540 consisting of the nucleic acids consisting of SEQ ID NO: 935 and 942;
probe set #1541 consisting of the nucleic acids consisting of SEQ ID NO: 2032; 2033 and 2034;
probe set #1542 consisting of the nucleic acids consisting of SEQ ID NO: 501; 502 and 503;
probe set #1543 consisting of the nucleic acids consisting of SEQ ID NO: 2350; 2351 and 2352;
probe set #1544 consisting of the nucleic acids consisting of SEQ ID NO: 728; 729 and 730;
probe set #1545 consisting of the nucleic acids consisting of SEQ ID NO: 610; 611 and 655;
probe set #1546 consisting of the nucleic acids consisting of SEQ ID NO: 22; 27 and 28;
probe set #1547 consisting of the nucleic acids consisting of SEQ ID NO: 862; 863 and 864;
probe set #1548 consisting of the nucleic acids consisting of SEQ ID NO: 1642; 1643 and 1644;
probe set #1549 consisting of the nucleic acids consisting of SEQ ID NO: 2438; 2439 and 2440;
probe set #1550 consisting of the nucleic acids consisting of SEQ ID NO: 2225; 2226 and 2227;
probe set #1551 consisting of the nucleic acids consisting of SEQ ID NO: 1639; 1640 and 1641;
probe set #1552 consisting of the nucleic acids consisting of SEQ ID NO: 2400; 2401 and 2402;
probe set #1553 consisting of the nucleic acids consisting of SEQ ID NO: 464; 465 and 466;
probe set #1554 consisting of the nucleic acids consisting of SEQ ID NO: 145; 146 and 147;
probe set #1555 consisting of the nucleic acids consisting of SEQ ID NO: 2391; 2392 and 2393;
probe set #1556 consisting of the nucleic acids consisting of SEQ ID NO: 7; 8 and 9;
probe set #1557 consisting of the nucleic acids consisting of SEQ ID NO: 1810; 1811 and 1812;
probe set #1558 consisting of the nucleic acids consisting of SEQ ID NO: 2311; 2312 and 2313;
probe set #1559 consisting of the nucleic acids consisting of SEQ ID NO: 1994;
probe set #1560 consisting of the nucleic acids consisting of SEQ ID NO: 1395 and 1396;
probe set #1561 consisting of the nucleic acids consisting of SEQ ID NO: 933; 936 and 953;
probe set #1562 consisting of the nucleic acids consisting of SEQ ID NO: 2830; 2836 and 2837;
probe set #1563 consisting of the nucleic acids consisting of SEQ ID NO: 2605; 2606 and 2610;
probe set #1564 consisting of the nucleic acids consisting of SEQ ID NO: 80; 81 and 82;
probe set #1565 consisting of the nucleic acids consisting of SEQ ID NO: 2331; 2332 and 2333;
probe set #1566 consisting of the nucleic acids consisting of SEQ ID NO: 1734; 1735 and 1736;
probe set #1567 consisting of the nucleic acids consisting of SEQ ID NO: 2441; 2442 and 2443;
probe set #1568 consisting of the nucleic acids consisting of SEQ ID NO: 2617; 2618 and 2619;
probe set #1569 consisting of the nucleic acids consisting of SEQ ID NO: 181; 182 and 183;
probe set #1570 consisting of the nucleic acids consisting of SEQ ID NO: 2649; 2650 and 2651;
probe set #1571 consisting of the nucleic acids consisting of SEQ ID NO: 47; 48 and 49;
probe set #1572 consisting of the nucleic acids consisting of SEQ ID NO: 1504; 1505 and 1506;
probe set #1573 consisting of the nucleic acids consisting of SEQ ID NO: 1053; 1054 and 1055;

probe set #1574 consisting of the nucleic acids consisting of SEQ ID NO: 1625; 1647 and 1648;
probe set #1575 consisting of the nucleic acids consisting of SEQ ID NO: 1878;
probe set #1576 consisting of the nucleic acids consisting of SEQ ID NO: 287; 1823 and 1824;
probe set #1577 consisting of the nucleic acids consisting of SEQ ID NO: 965; 966 and 967;
probe set #1578 consisting of the nucleic acids consisting of SEQ ID NO: 576; 577 and 578;
probe set #1579 consisting of the nucleic acids consisting of SEQ ID NO: 1498; 1499 and 1507;
probe set #1580 consisting of the nucleic acids consisting of SEQ ID NO: 2391; 2392 and 2393;
probe set #1581 consisting of the nucleic acids consisting of SEQ ID NO: 1862; 1863 and 1864;
probe set #1582 consisting of the nucleic acids consisting of SEQ ID NO: 516; 517 and 518;
probe set #1583 consisting of the nucleic acids consisting of SEQ ID NO: 1444; 1445 and 1446;
probe set #1584 consisting of the nucleic acids consisting of SEQ ID NO: 1627; 1628 and 1629;
probe set #1585 consisting of the nucleic acids consisting of SEQ ID NO: 774; 775 and 776;
probe set #1586 consisting of the nucleic acids consisting of SEQ ID NO: 2468; 2469 and 2470;
probe set #1587 consisting of the nucleic acids consisting of SEQ ID NO: 1730;
probe set #1588 consisting of the nucleic acids consisting of SEQ ID NO: 2404; 2405 and 2407;
probe set #1589 consisting of the nucleic acids consisting of SEQ ID NO: 2724; 2725 and 2733;
probe set #1590 consisting of the nucleic acids consisting of SEQ ID NO: 1642; 1644 and 1646;
probe set #1591 consisting of the nucleic acids consisting of SEQ ID NO: 2829; 2830 and 2837;
probe set #1592 consisting of the nucleic acids consisting of SEQ ID NO: 869; 870 and 874;
probe set #1593 consisting of the nucleic acids consisting of SEQ ID NO: 2866; 2867 and 2868;
probe set #1594 consisting of the nucleic acids consisting of SEQ ID NO: 1; 2 and 3;
probe set #1595 consisting of the nucleic acids consisting of SEQ ID NO: 243; 244 and 245;
probe set #1596 consisting of the nucleic acids consisting of SEQ ID NO: 2188; 2190 and 2191;
probe set #1597 consisting of the nucleic acids consisting of SEQ ID NO: 1498; 1499 and 1500;
probe set #1598 consisting of the nucleic acids consisting of SEQ ID NO: 491; 492 and 493;
probe set #1599 consisting of the nucleic acids consisting of SEQ ID NO: 615; 616 and 617;
probe set #1600 consisting of the nucleic acids consisting of SEQ ID NO: 661; 667 and 668;
probe set #1601 consisting of the nucleic acids consisting of SEQ ID NO: 96; 97 and 98;
probe set #1602 consisting of the nucleic acids consisting of SEQ ID NO: 2480; 2481 and 2482;
probe set #1603 consisting of the nucleic acids consisting of SEQ ID NO: 1698; 1699 and 1700;
probe set #1604 consisting of the nucleic acids consisting of SEQ ID NO: 2331; 2332 and 2333;
probe set #1605 consisting of the nucleic acids consisting of SEQ ID NO: 278; 279 and 280;
probe set #1606 consisting of the nucleic acids consisting of SEQ ID NO: 1910; 1911 and 1912;
probe set #1607 consisting of the nucleic acids consisting of SEQ ID NO: 243; 244 and 245;
probe set #1608 consisting of the nucleic acids consisting of SEQ ID NO: 1481; 1482 and 1483;
probe set #1609 consisting of the nucleic acids consisting of SEQ ID NO: 699; 700 and 701;
probe set #1610 consisting of the nucleic acids consisting of SEQ ID NO: 2605; 2606 and 2610;
probe set #1611 consisting of the nucleic acids consisting of SEQ ID NO: 189; 190 and 191;
probe set #1612 consisting of the nucleic acids consisting of SEQ ID NO: 2344; 2345 and 2346;
probe set #1613 consisting of the nucleic acids consisting of SEQ ID NO: 1803; 1804 and 1805;
probe set #1614 consisting of the nucleic acids consisting of SEQ ID NO: 259; 261 and 262;
probe set #1615 consisting of the nucleic acids consisting of SEQ ID NO: 934; 941 and 963;
probe set #1616 consisting of the nucleic acids consisting of SEQ ID NO: 284; 286 and 285;
probe set #1617 consisting of the nucleic acids consisting of SEQ ID NO: 2802; 2803 and 2804;
probe set #1618 consisting of the nucleic acids consisting of SEQ ID NO: 2121; 2122 and 2123;
probe set #1619 consisting of the nucleic acids consisting of SEQ ID NO: 2391; 2392 and 2393;
probe set #1620 consisting of the nucleic acids consisting of SEQ ID NO: 1936; 1937 and 1938;
probe set #1621 consisting of the nucleic acids consisting of SEQ ID NO: 1436; 1437 and 1438;
probe set #1622 consisting of the nucleic acids consisting of SEQ ID NO: 1807;
probe set #1623 consisting of the nucleic acids consisting of SEQ ID NO: 2823; 2824 and 2825;
probe set #1624 consisting of the nucleic acids consisting of SEQ ID NO: 1865; 1866 and 1867;
probe set #1625 consisting of the nucleic acids consisting of SEQ ID NO: 2886; 2887 and 2888;
probe set #1626 consisting of the nucleic acids consisting of SEQ ID NO: 1533;
probe set #1627 consisting of the nucleic acids consisting of SEQ ID NO: 2785; 2786 and 2787;
probe set #1628 consisting of the nucleic acids consisting of SEQ ID NO: 77; 78 and 86;
probe set #1629 consisting of the nucleic acids consisting of SEQ ID NO: 2640; 2641 and 2642;
probe set #1630 consisting of the nucleic acids consisting of SEQ ID NO: 2225; 2226 and 2228;
probe set #1631 consisting of the nucleic acids consisting of SEQ ID NO: 918; 919 and 920;
probe set #1632 consisting of the nucleic acids consisting of SEQ ID NO: 859; 860 and 861;
probe set #1633 consisting of the nucleic acids consisting of SEQ ID NO: 1919;
probe set #1634 consisting of the nucleic acids consisting of SEQ ID NO: 898; 903 and 911;
probe set #1635 consisting of the nucleic acids consisting of SEQ ID NO: 1429;
probe set #1636 consisting of the nucleic acids consisting of SEQ ID NO: 74; 75 and 76;
probe set #1637 consisting of the nucleic acids consisting of SEQ ID NO: 737; 738 and 739;
probe set #1638 consisting of the nucleic acids consisting of SEQ ID NO: 14; 15 and 16;
probe set #1639 consisting of the nucleic acids consisting of SEQ ID NO: 409; and probe set #1640 consisting of the nucleic acids consisting of SEQ ID NO: 2038; 2039 and 2040.

7. A microarray comprising the group of polynucleotide probe sets according to claim 1.

8. A microarray comprising the combination of polynucleotide probe sets according to claim 2.

9. A microarray comprising the combination of polynucleotide probe sets according to claim 3.

10. A microarray comprising the combination of polynucleotide probe sets according to claim 4.

11. A microarray comprising the combination of polynucleotide probe sets according to claim 5.

12. A microarray comprising the combination of polynucleotide probe sets of claim 6.

* * * * *